United States Patent 7,745,391 (HUMAN THROMBOSPONDIN POLYPEPTIDE) - sequence listing, part 233

SEQ ID NO: 624654 - DNA, 228 bp, Homo sapiens
  misc_feature (200)..(201): n is a, c, g, or t
aagatgtagtgtgtggtggacatcaattactgcaactccgctcccgggtcatgtgattctcctgcctcagcctcccaagtagctgggattacagatgtgcaccaccaggcttggctaatttttgtatttttagtagagacagggttttcccaatgttggtcaggctcggtctggaactccttgacctcaagttgatccannctcacctcatgcctcccaaatgtgctg

SEQ ID NO: 624655 - DNA, 569 bp, Homo sapiens
tctgtctccaaaaaaagttggtgatgactttgccaaggcaacgggtgactggaagggcctgaggattacagtgaaacctgtgaccatttcaaaaacaagacaggcccagatttgagggtgtgggtgcctttctgtgccttctgtgccctgtgattcattcaaagccctcaaggaaccaccaagaagacagaaaagaaacagaaaaacattttaacacaggggggaattattcacttttgtgattgaagattgtgctcaacattgtgctctcgacaagattgcggcaccagattcctttagccaagaagaactctcttcgtggaaccatttaaaagaagactccgtgggagacgtgcgccagtctcaggtgggctgtatacagtgttgtgatgtggccgccattcctctcatgtgacattcattcgagtgacattcaaccagtgtgggtgcgtgtgtggaatgttgcccaagccagttttaagccacaaagggaaaaaccattttttcacattaacaggggactcattctgtgagcaactgtggttgaaaaaaacaaaaaaaacaagggg

SEQ ID NO: 624656 - DNA, 359 bp, Homo sapiens
tttctgatgagcaattgcagaccttaagccagtttcagccagcttatagaggctgcacacacactgtctttgtgtcctatagttcaccttttgccccaaagtgaatatgggatgtatattacatgtttgtttattcattgctcctgtgcttggctctcctcataaatatgtatagcttctaccccaaacctgctgaatacgtatgactctattgtgtaatacagactctcagaggaatgagacccaacctgtccttcccctgattgaagaaagagcaatacatatgagatccatgctaggagacatatatataacagcttgaaactgaaaacacaaataaagcatcttctaaaaaaaaa

SEQ ID NO: 624657 - DNA, 1522 bp, Homo sapiens
  misc_feature (322)..(322): n is a, c, g, or t
  misc_feature (442)..(442): n is a, c, g, or t
  misc_feature (1368)..(1368): n is a, c, g, or t
taaaacctccacctccaggggctggtgactgtggctcccaggtgatttattacgttatatggggtggcgtggtgggctcgtgggcggggccgtggagccaaaaggcgacttattttttattctcttccttatgtgccaccccaggtgtggggatggagagggaggtttcagagactctcacaggttttctctccctgtgtggccctttgttattctccacaagggcctctcctgtgtggccccacagtataataaggtgtgttgtggagaacctctctctctgtgcacaggcttctcctgtgaagttctcgtgcgctataanagagatgtggcgcccaccagagcatctggtgtgtggtggagaccaagggcgcgacaaatgtgtggtgagagcacacacatgtactatggcgcttaaagagaccctgttgggggccacaanaaagcgcgcggggacaacctctctctggggctaaacagcggggcgccactgtggtgtgtgtgcgctctccgcacagtgtgtgagagagaatggggggcgcacgcgcgtgtgtgtatcacgcgctcatgtgtgtgcccgtgtacaagtgtgggcgcaatgtgcgctcctgtgttgtcgcccaagagtgtgtgggcgcaagagagtgtgagagtgtgacctccacgagaaaagagtcattcctcgctggggctcggggggggccctcctagctcttaacatcttggggctctggtggtagtctcataggggaggcattaccctatattggggtgttacccccacgaaggcgtctaaaagggtgtggtgtgcgacctccttattatatcctggggagtatcacacgggggggggaggaggattaccacatacgcctgcttacgcggctctagaatatgtgaaacaagggacgcacttcatgttatgggggggcccccccctatgggggggggggtccgggccctattggaagggcggcaacaaaaacgacagcgaagaagaccaacacaacaacacgcagacaagcgaaaagaaacaagcgaacgagccagcaagagacgagaaggaaaagaaacaagagaaagacacagacaaagcagagaagacaagagacaagcacaagaacagaagaaagaaggacaaagcagcacaaaaacaaagagggggaggcagcggagcacctcagagacaacgggaatgcaacgccacagcagggagggggaggccaagcacgaagaagggagaagacgcgaccaccaccagacacaggatgaaaaccaaaaggggagggcgcacaccaacagagagggagagggcggcgaagtaacaaagaagcagcaggaaggcgagggggcagcaggcgagagganacaaacaaacaacagacgacgaggatgtgcagaacaagccaaaggcgacagagatgagagaaaagatgatagcgaaggagaaggagagaagcaacacaaattgagcgaggaggagggagcaagaaaccaagagggaggacagcaacagaagcgg

SEQ ID NO: 624658 - DNA, 367 bp, Homo sapiens
cccttttcctggaacattcttttgctagagagtacataatgtttcctttgtcttctttctctggtattaaatgttacctgatcagagaagtctttccacatcatactacctaaaacatctatttcttgctcttcatacctttacttttattttgaatttttttttcttaatgacacttgaccattgctggagtaaacgtctggattcccctctttgttctgttcagctttacatctatccctccttcagcagtgcctaatagtcaatgattgatcaacaaatttgattgaatagttgattgaataaatattgaatgagtgagtcatttgtgtccgtattgtacagccatttaggtagggtaccgagc

SEQ ID NO: 624659 - DNA, 103 bp, Homo sapiens
ggtcgatctgaggatccccgtcaatttctacacatatgacatcctcatatgaaagcactctcttatcttttacaagttcaactggtattgtgtaatctgctgt

SEQ ID NO: 624660 - DNA, 287 bp, Homo sapiens
cacgaccacctgctattatgtgactgtagtgaacactcatgccctgttccctgacctaggatgcctgtgattcgatgagacatgcaataatgggagactcttaccctcatgttttgattggtagcggatctccggacatgtgcaaagttttttagttcgtcgtttgttgttgttgtttccgagactgtcgcccaggctgaatgcaatggcacgatcacggctcactgcagcctctacttccggggcgtcagtgatcctcccacctcagcctcccaagtagctcggca

SEQ ID NO: 624661 - DNA, 710 bp, Homo sapiens
ttctccatacttcccagctacaaccgcataagtcgtcacagcccagcctcctgaccggcctgagtctaggagcattgtcagttgactctgcacagcatgcgagtcgcaacggtgtgcgcaccaggagtgctctgcggatgtctgagggtcccccatcacacgccctcaccttcctgtagcttgcctcggccgccacgccgatcccggcccgatacccccgctacctggcgctactggagacatctaacccgagacctggagccaccacgttcgctggttcatagggttcaatctgccagatcaacctagcgactcgaatcgtgtggatgccctctagcctccacaggagctaggtagagtagggcccagagcaggcaggcctatcctgatccttaggagtgaaggaggaatgagagaggccactagtcggctccagtgtgccctgcccttgggacgtggagcccaggggaggtttgaaggggatcctgggcttcgggcatcacgcaccaccatccttttggcagagggaccccagcacacaaactctggcgtggctgtccccaccgtgcaggggagggagtccgcagcctcccttcacgtggtgaccttgatgctaggggcctaggccatcctcatgtgactctgggctacctcagtttccccattttggccagactcaccggcccaaaacgccgggagttatcttactt

SEQ ID NO: 624662 - DNA, 196 bp, Homo sapiens
ccatctttcaaataaactgcatccaaatgcttgtcacagggtctgcagtttactgaaacatatgactcaaaccccaaattagatcaggagggcctttcaccaaaatgatgccttccacatcattgccatttagaacccgggttgcaaaggaacacatcctgaaaaattttttcctactaggcaaatatcctatgcc

SEQ ID NO: 624663 - DNA, 387 bp, Homo sapiens
taagcaactggaaggatagaactgccattaattacatgattgagattgcaaagagcaggactggggagaaaaatcaggagttccactgtggagatgttaaatgtggatgtctaatagacttggcaagaagacagctgatgtacaagtctgtattttgggcaattggtccaggctggagataaaaatttgggctttgtcatcatgtggatgtacataacaaggagactgaataagatctccgggaagtgaaagaggctagcaaaaagaaaaggtccaagtactgagccctggatcctccaacattagaagtcatggagtgagaaggcaccctttaataagtgaaggagcagcctctgatactatccagagaagaaccttaaagtcagg

SEQ ID NO: 624664 - DNA, 297 bp, Homo sapiens
catcaatattcgcactcgaacaaagagatcttctgagagagctcatttcaaattcatcagaggcatgggacaagatccggtatggaagcgtgacagatcccagtaaattagagctcgggaaagagctgcatattatgccttataccgaacaaacaagatcgaactctcactatcgtggatactggaatgggaatgaccgaggctgacttgatcaataacctaggtactatcgccaagtctgggaccaaagcgttcatggaagcttggcaggcgggtgcagatatctctatgattggc

SEQ ID NO: 624665 - DNA, 151 bp, Homo sapiens
cggacccaattattatgaacagtaagggagcagagtggttaagtaattcaggaacttaactattctaggaataaggaatgaatcaactgaccttgggccagcaggttttaacaaaattgtatacttgcctttctacacccagatataatca

SEQ ID NO: 624666 - DNA, 337 bp, Homo sapiens
  misc_feature (2)..(2): n is a, c, g, or t
  misc_feature (7)..(7): n is a, c, g, or t
  misc_feature (113)..(113): n is a, c, g, or t
  misc_feature (120)..(120): n is a, c, g, or t
  misc_feature (149)..(149): n is a, c, g, or t
anaatanaaaacaatccgtagaattctggtgttgaaaatgcaactacgaaatgtggcagatgatcagcagaagaagatttgtgagcttgaagacggctatttaaaatacacgnggagacnaaacaaaagattgaaatcaatgtaatatncctacaggatctagaaaatcacttcaaaagggcaaatctaagggttgttggccttaaatcagaagtagagaaagagatagagtaggaagcatacccaatgggataataaaagagaatttcccaaatctaaagaaagatatcaatagccaagtacaagaagattatagaacacaacgcagatttaaccc

SEQ ID NO: 624667 - DNA, 275 bp, Homo sapiens
ggatcctcccacctcagcctctccagtagctgagaccacaggtacacgccaccacgcctggctaattttttaaatttttagtagagacgaggtcttgctatgttgcccaggctggcctcgaactcctgggctcaagtcatcctcctgcctgaggctctcaaagtgctgggattacaggtgtgaaccactgtgcctggccacaccctgtataatttgttccaatatgtgcctagtttcttttctttttagaggggggggggggggggggggaattc

SEQ ID NO: 624668 - DNA, 247 bp, Homo sapiens
ataattaacaaccatgatgttcgattacctgccaattattgtataagtacttgaacaacgcagctgaattttatatcaatcatgtcactaggtctactcaaatagagacatcagcatcacggcgcccaggatacatctgcatttaatgtcacctagcacacgtagctctcagaggtacataatagaggggctgacggaaacatcatcccagatcgtggacccttgggagaggttgtttagattctga

SEQ ID NO: 624669 - DNA, 158 bp, Homo sapiens
atttcatagacggatcccgtgcggtgtacgacctaacaaagcaatataaagcacgctgtctgttatgcttaaagcctcgagtaggcttcccagccgggctaggcttttctaccgttgccgtttttcacgaagttcaaggttcacctccggggtaccgc

SEQ ID NO: 624670 - DNA, 146 bp, Homo sapiens
tagaggacccgcctcatttcagtcccacagcactggactacaggctgctccatcatgccagctagttattttattttttattagaaatagggtctcactatatcgcccaggtgatgtcaaactcctggcctcaagcagtcctccca

SEQ ID NO: 624671 - DNA, 124 bp, Homo sapiens
tgagtgaggaggagctgataggggcagctggtacggaagccggcaggcaggcagagatctggtgtgcaggggggagcttcaggaggcaggtaggggcagccctacagagctatctctgcttcgc

SEQ ID NO: 624672 - DNA, 176 bp, Homo sapiens
tgccttgatgtcctgtgccttgatgtcctgccgttcgaagctggcgctgccgctgtcggtctggcgctggccaatgttgttccagtcattgtgcagggtgatgccgctgcgcccgctggggatggcggcgatcagcagcttgccgccggcgttttcacccacgtcttcggctttca

SEQ ID NO: 624673 - DNA, 174 bp, Homo sapiens
gcgagaggagccggagacgagaccagaggccgaacttgggcttttacaagactggccgggcttccccgcaggattcaataaggaaacccagcggtttcatgcagaaccagctcctgcaataaagccgaccagattagagcaacgccgttattttaatgtgggaattgcttgccc

SEQ ID NO: 624674 - DNA, 778 bp, Homo sapiens
ctgtgaaagagcgaaaagaaacaattaagagaaggaaggagaacctacaattgtagaggaggatgatcctgagctgtgcaagacaagctgtatatgaacagacaatgaaactctttgcagagctgggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctggccttctcttcccacagcctgtaactcagtgttttgtacttcactggaattgtgatggttagaaacttcgggataggtttgtggaaatcatcccattaaacaatactggcttaaaacagtgttgctgtactcagaaaaacagctggagggggcc

SEQ ID NO: 624675 - DNA, 564 bp, Homo sapiens
gagtgctacgaggatagcccggacacagtggcctccctgagaatgatgggacacagaggttcagtggttaggatggtgccaaagggagatgctgggcggggcggtcctaagggtgagcctggcagccctggatgaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctggccttctcttcccacagcctgtaactcagtgttttgtacttcactggaattgtgatggttagaaacttcgggataggtttgtggaaatcatcccattaaacaatactggcttaaaacagtgttgctgtactcagaaaaacagctggagggggcc

SEQ ID NO: 624676 - DNA, 353 bp, Homo sapiens
gcgtgttggggagtacggattttataccatacatcctcacagactcttatattcgcactctataattcctactctcatctgtcgtaatgcctgtgtactgattcacttaacatattccagtattccattatgctgtgttattccttcagtcatcaaacatctattaagctcctctggcctgtgccaagcttgttcttggattatagagagctgtgaacaatagatgacaaaagattcatcatccctgttaatagtttacctcctgcagccatactttccaacagaaattgaattcaaggcccatatgtgatttcaaatttcctggtgaccactccttttttaacaaggacgaa

SEQ ID NO: 624677 - DNA, 371 bp, Homo sapiens
gggtgcagaggaggccatggggcgcctggctgtcggcccggctgtggaagtggctgaagtcccccagcagctgcaggctgggcctggccctgctgctggggggcgcgctcctgttctgggtgctgctccacaggcggtggtcggaggccgttgcgttggtcgcggcctgactgccagcgccggtcctccttctgtaggccccttggttaagggagtttgtattcttggagctggggggcccgcttccttcctccgggaggtatcctgtacgtccccggcctcgttttaataacacaaaaactataatgcatcacctaagcaactatgccaaagcacaaagtatacacacatataataagatataaaactca

SEQ ID NO: 624678 - DNA, 306 bp, Homo sapiens
ttagaaattatcagggtccagtaatgtggtaaatccacttgttgtggaataacgtatcccttgacaatctgatcataaagtggtgtctgtgtataagcgctgagtaaagatgttccagagtataaggtcaataaccaccctcatcttaagggatatttaaaatctctcagcctccaagggatcaacccttttttaaattaggcgtccgtatcctttataatattctgaacaaatggtgctaacaggcatgattggagattccccgacagcatgggtaatagcatggccccaacgtgccacactaaa

SEQ ID NO: 624679 - DNA, 511 bp, Homo sapiens
gccatgtctcctccttgtaacatctggagagattcttcacttagtgcctttttctccatcgatgatttctttgttttacgtttaacaattaaagtcttaccttctacgagtgttggttcctctttattttttattcacagcatcccttccgtgtttttatgttcttgaggatttcacttaggttttccttctccctgagttctcatctgttccctaattatctcttgtttcctaaagggtccatttttgttttttaatcgttattctcctcttactcctctgtgagtaaatctctgtggttattcattcgtattaaagaccaaggaactgaattgatttttcttgatggatgagatgggtctgtataatagtagctacatccattgcccactcacacattctatcattaactcatttaatctgcacagtagccctataggggagagttcctctcattgccattttacagaatagatgactgaggaccagagaggttaagaaattatctcca

SEQ ID NO: 624680 - DNA, 159 bp, Homo sapiens
gaacttaacggaaagagaaaaaacaagtttaaagaagaaatttttcataggcttcttgtttagtagcacaggccaaaggttgtcgtcgtcttgcagggtcttataaatgctgctaagtaccagacagcattttaccactgagtcctaatggaaacacac

SEQ ID NO: 624681 - DNA, 131 bp, Homo sapiens
ttattgactttattgtccctataaatatattgactagtagtgataccatcaagttgcacactcttttctctccctgttttgcagcaatcaaattgcgaagtgcttttgtttatgtttttagctcatttcca

SEQ ID NO: 624682 - DNA, 216 bp, Homo sapiens
acttcggctgttttgactgcggggttctggatggcttccctcatctttttcgctcttcgtctgctgtgctgtatcgtgctggcgtgtgatctgggacacacacctcccgctgattaggctgggctgaccatgataggagagtagaggggtccctcgcagacagcgcccgaatctcacttgctttccactttccatgccttctgctgtgcttgccag

SEQ ID NO: 624683 - DNA, 1357 bp, Homo sapiens
tacgacgatgtagagcctgtggtgtgtggtgcagcagaacgtgtgggtgcgcaggcgtggtgggtgggtgcctttgttactggccggtgatgtgtggcggtcccgatatgagcgaggacctggctcgcgtgggttggtagggggcccccgttgagttggtccgcgggttcccccgcgtggtggtcgtcgcgacgccgcccccgctggtgatatgatcagagtgctgtcgcggaaaaaagttgtttttttttggggagacccaagagtgtgtctttccccccgggggaaccgcgggaggttgtcgccgcgcaaagacgccccccgacccattgtgtggggagcccgccgttccacaccccaaaagctgttcttagtaccatgcgtcggggggttattccccccccttcggccttctcccgtttatgtgaggagattccacagcgagatagctccccacgtgtggcacacacccccacgggggttgtaaaaagagagttctttaatggccgaggaagccacggtttggagaggccccgtagacgcgccgggaaaacggggccccaccagtttttgagagaagtcgtgacgtggcgagcccgcgaggaggtctggccccatccaaaaaggtggccaggaagggggaagagaaacccaaggcccccaggatccgtggcgcctccggaacgccagtgaaagcgcgtgtgcaccaggattagatccagcgcccgccagagagaaggccccaggtcgccaccaattcttgcgccaaaaggcgcacaaggctttaaaagctgaaagctatatttccaaatccctggcatcacacagctcttgagcccacaccacataatattggaagaattcacccgcacagctttcacactgacacttttgcgccccacacccagtatatagtccagccgcctttttgcccaaactgggccccaggagcctcccgcaccacttattccttacttgcccctcccaaccctcggccggatatttccacaccacgcctatgtgttggcttccagggcccatgggtgtaatatggagccctccacccaagacccccagatgcccagggacatcccagacatccactcttcccagatgggacccacgccagcgaatagtcccgggtcacacagaatagccaagatctttgatagaggaacttgatcgcctcccagatagagtttaatggagactgggcttggcccgggagttctcggggacacaggaagacagatatttcctgattctggctcttagctttcctcgcccagaatatttggtttttatttttttatttgaactttattcgtgtaataaactcccccctgcccaacccaga

SEQ ID NO: 624684 - DNA, 1900 bp, Homo sapiens
gacttccgcccggccgcgggcttggatggagtgcggcgctggaggcctgcggctggggttgagcctgcctggaggccgcccccggcggccgggccttctggtggccgcccctggtttctcctggggggtgatgaaccgggacgcggctctggcccgagcttattgcgcacggtgagcccggagctgactccctggactcccgatggtgcctttcattgcccgcctttcccagggacaggacgcccagtttgctgtgcccgtgagcccaactgaaggtctcacactggtccgggcccccaaggaccctttctccctgcgacacccttttccgccggacctgtgcggcccccgtgcctcgacccttactcgggctgctaccacgggcgccacggaggcgcaccctgggaattctccctcgcagaggttccctttggccaccaagtgccctggaccctggatcaccttgcgtgtggccccccatgtgtgtcggacgccagcacgccggtctggcggaaggtgttgccgcgcaccacttgcgcacagagtttgcccccaattgttgcccaggaagggagttcggccccccagggcgtgaccccagcgtggatgttgggacggccaccttggccccagttgctttggcccgaattgcataggaaaccaacgtgacggtggctgagcggccatcaaagaagccttgctctaaatgtgcgctcccgaacaatctcctaccccgagtcaaaaagcaccgcgcactccggccaccccggcacgaacgcaccgatatagggcaccgggatgcaccttacggctgcggcccacggcaggaccgagtaggtcgcagaacatacagaaacagaatgattgtgctaccgagcgagcacataaacacacgtgcaggcaaagaacatgtatgtatacagcgaacacgtcatcacaagccggctatagtgggtatctcccatcctgcccgcgagtgcctagtacgcagtgctaccaaccacgcacacggactgctcaggttcgttggcggggcgcgacgtcgggacgggaggggagagcgatggcgcgagggcgaggaggcagcggcaagagtggaacaagagaaggaggagggggggtggggcggatcggggaggggcgccgtgagacggggcggcgggcccgtaggccgacggcaggagagagcttcacgagaaggccggcacggacgccggcaggaggcgcccggagagggagtcacggagagtcgagagacctcgcacagcgaggcgaacgcgaccaggaagaagaagcacgacacggcggtcgcgggccggatgagacggaggggcggtcggagccgcgcgggtgagcagcggagccgagcggcgactcccgcgaccccaccacagcaccgaccgggaacaacgccgcgacagtgaggacgcagaggccagagagtcgagtcgaggcggcgataggagggaggccgtgtgacgaggtccggcgagccgtccgcctcacgcgagtagtcgccgcagatgccgcggaggacagcgacacccgatcgcgaccgatacgcgagctgggcgctgagaacgagacgacgacttggcggacaccatgagagacgagaggcggaggacgacgcggaccggggctgccgcgacgcgatcggagcggcgagcgcgacggagtctgcgtcgccggatggccgcctgcgagcacggcgggagcaggcagagcgagtcgagagcggatgacgacgggcgagtcagacggatccgacggtgaccgagagagcggtctgagacgcggagacgagctgcgagcggagagagcgtgtgaccgcaggatgagacacgagagttgacaggtgcctgagtcgactgaaggccagatgagaggcgttggcgga

SEQ ID NO: 624685 - DNA, 789 bp, Homo sapiens
cccgttctgtgcaatgtcctgtgcggttcctaagtagttattgtctagcgtccgcctctttccgcccgcttgttgtttttttgttttgaaactcccgtggtgcctacgtaggtgggcgcgacgggcccccgttttgttgtttgcgtcgtgcgtcgccctccttgtgttttatctatcggtgttgcgtctctcttctgtgtctagcatggggtctgtttaatggctctctccgttggctcacgcccgcattgtgtgttatctcccgccctagacgtgtcgctcttctctgtgtctcgcgcgcgcgccgttagttctcgccgcgctcgagagtgtaggtgttggtgtcgctcgcgtgggactcctcgggcgtgtcgcgcttcagctttcagtgtctttgcgctcctttattcgcgccgctgggtctcggggtgctcgcccgctttatctccgcgtgcatcgcacactctttgttccgtaggggcgccccctcttcttcgctccgcctcacgctgctgtatttgcgaggcactcgcccccccgtggtcgcgcgcgctatctgctagctccccggcgacaccggctctccctcttcctcaacgcctttactactttaccccagagtctgattctcttcttctctatgatctcgctgtatcaatgtacgctccttatcgcgccttatattacctcagctcggcacactgtgttcttcttccacctttttattagcactcacctctctacacactgctcccagcgcaccacacaccccacaattaaccaaacaaa

SEQ ID NO: 624686 - DNA, 220 bp, Homo sapiens
cgcgacagaacagacagacctgaagtcaagacaactgattctctgtgaagtccgtaaaaaaaaaaaaaagctacaacaagtaagccccgccccctcctcccatccctccaaattccaggaaaaaaatttggagtatgctgataaactcacggcaaggtctcatacactcactagaacagaagggaagagccaagcactcatatcggcgggggtataccgg

SEQ ID NO: 624687 - DNA, 535 bp, Homo sapiens
  misc_feature (55)..(55): n is a, c, g, or t
  misc_feature (85)..(85): n is a, c, g, or t
  misc_feature (100)..(100): n is a, c, g, or t
  misc_feature (103)..(103): n is a, c, g, or t
  misc_feature (119)..(119): n is a, c, g, or t
  misc_feature (137)..(137): n is a, c, g, or t
  misc_feature (140)..(140): n is a, c, g, or t
  misc_feature (203)..(203): n is a, c, g, or t
  misc_feature (233)..(233): n is a, c, g, or t
  misc_feature (243)..(243): n is a, c, g, or t
  misc_feature (265)..(265): n is a, c, g, or t
  misc_feature (267)..(267): n is a, c, g, or t
  misc_feature (280)..(280): n is a, c, g, or t
  misc_feature (286)..(286): n is a, c, g, or t
  misc_feature (295)..(295): n is a, c, g, or t
  misc_feature (298)..(298): n is a, c, g, or t
  misc_feature (321)..(321): n is a, c, g, or t
  misc_feature (323)..(323): n is a, c, g, or t
  misc_feature (330)..(330): n is a, c, g, or t
  misc_feature (364)..(364): n is a, c, g, or t
  misc_feature (382)..(382): n is a, c, g, or t
  misc_feature (393)..(393): n is a, c, g, or t
  misc_feature (413)..(413): n is a, c, g, or t
  misc_feature (427)..(427): n is a, c, g, or t
  misc_feature (447)..(447): n is a, c, g, or t
  misc_feature (450)..(450): n is a, c, g, or t
  misc_feature (504)..(504): n is a, c, g, or t
gaatacccacagcacacccccccaccaaaagagaaaacggggaggggagcctggnaggccagattctgacccccatggtccacanagggaaacccccaanagnggcctcggcccaccgnggcagagcgcgaggggcnggnaggcctggccacctcccattgcccgatcagcctgctttagggtgtaatctggcccctctccanaactgaaaactgtggatgggggtaaatttnaaaaaaaggngggggggggggtacaggggggngngcggggggtccanggggcnacgaaaaancanacctgattggggaaagggctatntntccaggnggggcagggcttggggcgggcaggggaccttggncccctgggggaaaactanaaaaaaaaaanaaaaagcaaaaaaaaaaaanaagggtgaggggcnaagtaaggagcaggggtttngtncccgtggctggaaggggcggggtaaggcccgggtagtggggggagggtggggangagaggaaaaaggggaaagggattgggatgg

SEQ ID NO: 624688 - DNA, 1461 bp, Homo sapiens
  misc_feature (357)..(357): n is a, c, g, or t
  misc_feature (1266)..(1266): n is a, c, g, or t
agcgggtgatgtcttgccgtgcgctgcctggctcccgtccggccccgatgggactctgcccgaggcgctcagacccctctgctccccatggagcccacatgtccaggcaagcggcaccacgcttgctagcatgctgctctggcccgagcgccccagcctcatggggtcttgtcgcctacctctttgggtcctgcgtgcgtccgtatgtgctcttcatggacctgggccttgatgcagcttcctcgcttgaaccagctgggactggtctgtcgctggccatagacactccctcatagtgcttggcgtctcgtttttggatgagactggtttatggtcgcattgcgtgatcccgatacntgtccgcgattaatagtggggatcagagatcacaggagggaaacgatgcgtgaagagcgtcatcttcgggtcgagatggggacttttgactcgaacacatcacctttgaaaggatttctggaaagaccagggtcccaagaaccaagaagatacctagaagagcgccccggtacgagttttcccatgtgctcgacgagggcctcttgggtgtataggttctccgcatggtgactttgagcaatgtgatctctatcgttgcgatgatctatactagagatcccatctcatcgacacgaccatagagtctgacgccacgagggaagggggtagctgacgaggcgaaaaccctggccctaatgaattgttgggatgccattgtctgtgccaagggaaagatttcggtacacccctacccatgggcccaggcttcatacacccaactgagtaccgtggcataggttgatccagcattggctcactggatgacttttactaagccccctggggacttcgaggaaaagttcccaggaacggtgggggtcttaaagaaagagccccgttgccttcctggaatatggcgccatccttgttcccttaatttgttccctcctaagctttagtttgtcgtccaatgggtagattgcagatttcacccctttgcatatgtcggggcctgtaagtgccgaccttggaggagtgtcggaagacacagcagtgttggtttagggaaatccacacagttgaaaaagacccgcttagtgatgttgttgagggggggcaaaacacttaaacgaatgcctttctattgtgcttcgccttggcgacaaccgttcggaatttaaaccgtttgtttcccccaggcccgccggttgggtttatcctccggggccaaaaaagtgggcgctgttngggtcccccttcagcagagggctgccgggcccctcggctctcaccactccatttggggggtcccactctacagggagaggcgggttgtacactctcttagcgcgccctccggtgtaggataccacatcggcgcatgtagggagaattgccgtggtgctgtggggccgctgttgtttaccggctcccaattctctg

SEQ ID NO: 624689 - DNA, 385 bp, Homo sapiens
agagacagaaggggggggtggtttttgtttttttcagatcaacagggtttatttacacagagttacatatttgctaatatgcacaggcctaaacacagcaacaaaggtaacatatctgtatctataaggacattttctccatagacttcagatgagatgtatcacttagcaaaatcatttttaaattgaaccagcacagtaaatacttaatataaaatgtcccttggattttgcttcccatgtaaatctattgtataataacacttgttctaatataaactataaaggtccaattgtttcacagagccagtttggcatgggatgcattccatttctgcagtatatagttggactaatatataaattaccccttctgtcgtcttct

SEQ ID NO: 624690 - DNA, 118 bp, Homo sapiens
cagtgtagtagttcagtcattcaggcaggggtggttgttcagcggggtccggcaggcaccacggttgcgggcaccagcatcaacatcaggttgttgttgcatttggttcaaacaacat

SEQ ID NO: 624691 - DNA, 452 bp, Homo sapiens
  misc_feature (39)..(39): n is a, c, g, or t
  misc_feature (61)..(61): n is a, c, g, or t
  misc_feature (140)..(140): n is a, c, g, or t
  misc_feature (144)..(144): n is a, c, g, or t
  misc_feature (168)..(168): n is a, c, g, or t
  misc_feature (296)..(296): n is a, c, g, or t
  misc_feature (310)..(310): n is a, c, g, or t
  misc_feature (346)..(346): n is a, c, g, or t
  misc_feature (353)..(354): n is a, c, g, or t
  misc_feature (356)..(359): n is a, c, g, or t
  misc_feature (361)..(361): n is a, c, g, or t
  misc_feature (374)..(374): n is a, c, g, or t
  misc_feature (377)..(377): n is a, c, g, or t
  misc_feature (380)..(380): n is a, c, g, or t
gcttcagagaaccagcctctttcacgccatgcccgcccncgcctcccttcttccctcttcnctttcccttcccagccctcccttccttcctctgccggcaaggcagggacctacagttgttgcctgcctccgggagggangganagggagggtgggtgggtgaggccncctcctcctcccagggaatgtgactctcccaggccccagaatagctcctggacccaagcccaaggcccagcctgggacaaggctccgagggtcggctggccggagctatttttacctcccgcctcccntgctggtccccccncctgacgtcttgctgcagagtctgacactggatccnccacccnnannnngnccctggtcccacnccngcncccgccctacctcagtgcagcctcatcatctgtggacactggagtctggaataaatgctgtttgtcacatca

SEQ ID NO: 624692 - DNA, 994 bp, Homo sapiens
gcgtgcaatgacattaatgaccacggagacaggtagcacactagccatcatcgctcctcgacgttactggaagagaggctgccgttcctggctggccgacgatgtcatgcagcctgcccgctatctggactgctaaggagaccgtggtctctggaggtcacagtcctaaatacatatgtagggctcagtgtgctatggcagtctggtgttcctctctcgaggaggaggtacccgaggaaagaactccatacagcctgtcgtgcctagactcagtcaacagcataaacagagcgcaatgggtgttggtctaagagatatgtcattcgagtcctcatactaatcaagtctgggcctcttcctgtccacggagaatgccacagtgaatgctggcctggcgaagcaggccctgggtggcccttgtgtggcgcctctctagtggtgaactcacatggtcatcgcagcatccatcaacaaggagtccagccgcgtcttcctcatggaccctgtcatcttcacctgtggcccacctggaggacaagaaccacttcaatgctaactgctccttctggaactactcggagcgttccatagctgggctactggtcgacccaaggctgcgcctggtggagtccaacaagacccataccacgtgttgcctgcagccacctcaccaacttcgctgtgctcatggctcaccgtgagatctagcagtggccgcatcaacgagctgcgtgctgtcggtcatcacctgggtgggccattgggaatctacccttggtctcgcttggccatctgcattttcaaccttcttggtatccttgcggggggcttgcagacccgaaccgcaacaacaattcaggagaaccttgtcattaaaccttttcctggcttgagcctgctcatcctggtcccgatcaacaagagtcagctttgacgcattgctgcccatactttgcgggccttgctaactatttactacctggctgccttctcg

SEQ ID NO: 624693 - DNA, 780 bp, Homo sapiens
gctacctcgcccaggctgccagaccggaatcgctccgcgtgtacctggatcctgctcctctggttgttgaaacccgggcgccgcctagagatgccggcttaccatctcttctctcatggatccttgataccaaactcattcggaaacatggcactgttgcctatcagaagtcaatttcaacaggacctgcccccatgatagacaaacgatacacgatattcgtggatgaatgccagtctattacttctagaggccaatgtcttcttctaaaaactatgaacattaggaatgaacgctgatacggaccttgagtatatataactctctacatttctgaatgtctgaagcaaactgcaagagttgcaattccaagaagccaacggtgagaaatgagaatgtatacgctgaggaatcatctaattttcccattacctggagaggcctggtttggccacttaacgcaatttatgccaaatctgcaaatctagcacggaagatgatagtgatgagagcctatgtagcaacagcgtcacaggctgagagactggactgagacttggtgagacagttttcgatcctcagaatgatagagccagcaagtggtggacttggctttgtgaagagacagttcatgaatcaatgagtctttcaggacctggtacagtgatgggagccctgggcagtctcccgtcttccagagccctgtggcagcattttccagcaagatgtacacgatcttttgcctttatttcgtaaagtttttataccgaagagagaagg

SEQ ID NO: 624694 - DNA, 454 bp, Homo sapiens
gtcgaccctttggcatgtagcctgcagtcgccgtcacaggttaccagccaaaggaattgttcattcctactgactgcttttgttttattccattttcagttctcattttgagctaaaattgatagttttaattaaatgagaaatgagagccatacttctactttacatagaatataagcttttgtgtattagagagtcaccatggttctttgttagacacaaaagccacagacgtgggaatttatgatttgttgcatcaatgacaagttttgagagtcactgccactcctttgccatagcattgctgacccagactgacctccattattaatgatgcctcagatgggagggctgaattcatagtccttaccagtcaactttgtcaacattaatttgaaccagaacaaatttaaatttaaaaggattcaacctcttttggcctatccccatttac

SEQ ID NO: 624695 - DNA, 102 bp, Homo sapiens
cgggagacagggtcacactcctacgctcgcgagactatcccaacagggggactggacgtaggctccctcccccccctaagcctactccatgatatccagcgc

SEQ ID NO: 624696 - DNA, 746 bp, Homo sapiens
gcggagttgtaacgctccactgactgatagagcgatcggtcgaccatggcgccccggagtggcccgcgggcctgacgccgtactggaggttgcgcctcgagtggcgccgcgctgcctcctgctgctcatccccttggtggccgcctcgcattgagccatcccggagctgcttgttctcagaagcacaaatgaaacctgtgacgagtgacctgaagaacgtctccgtgtctttggtgcaacgctaacaaggcttgtctggactacccagttcacaaagcgtctctgccaccggccttccctttgtaacttgcagcgtctgcacgctggggagtacatgttgggtgaactttgagtgctgctgatcatctaccatgtcggtactctgggggaaccctcctcctgggcattgccgatcttgcttgcttgcttagctgctcgcagggcaggacagagcgagccagtgaaggccggtagcaggcatgtcgaggagacagtgcccatcgctgtgattctgggacggagaggcggagtacttcgcacgcgaaggacacgtgagacacatcgcagggacgacttcggccgtgcctaaacacacgagcatgaggtgcaaacctctaagagacatcacacgacattatcagcgccagttcgtcttcactagcagattgaatcacatcccgttgattggcatagtgaatttgtgacaacctccagcactacaccatgtgccttccaatgcacagatc

SEQ ID NO: 624697 - DNA, 375 bp, Homo sapiens
gattttgctgacggtgactgtgggcctgtagctggtgcccaaacaacctcctgggactgcttgattctcacctttgtgaggagggtgatatgtcctctgattaaataatagtaaccagcaaaactccagctctatcttttattttattttatttcatttcatttttcaagactgagtcacccagactggagtgctgtggtgtgatctcagttcactgcaacctctgcctccagggttcaagtgattctccatcctcagctactcggaaggctgaggcaggagaattgcttgaacctgggaggccgaggttgcagtgagccaagatcacgccattgcactccagcttgggcaacaagaatgaaactccatctcaaa

SEQ ID NO: 624698 - DNA, 1251 bp, Homo sapiens
aaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagccagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtctttcaga

SEQ ID NO: 624699 - DNA, 910 bp, Homo sapiens
  misc_feature (121)..(121): n is a, c, g, or t
gggccggggccaccctgccccgccagcctggtgcttagagcctcttcaggcctcccacagcccagaggaggcaatttggttggcaccaggagccactgctttcccaggccatcggcagaantgggcaatagaaagactctctaggacctgtgtggacatgggggcaggcaggaaggagcggcgcctcagtgcttttatgttatcagcacattcacggccatgaacccagccttgttacagtaaaacactgcagccctaaaaaaaaaaaaaaaaaaaaaaaaaaaaaaaaaaaaaaagaaaaaaaaaaaaaaaaaaaaaaaaaaaaaaaaaaaaaaaaaaacaaaaaagaaaaaaaaaaaaaaaaaaagaagggcgggggcgcagaaacacacatccccggggagggaccacaatatgcagcccccccagttttttgttaatcaagagagcgcgtcgccccccaaagtgatggggtctatattaatccacgaacacacagggggcggcacagtgctcatatactacagcagccagttgcagagaggagaaacaccacttaggctgctgctcatcattctattagcggagcacaccctctcactcctggggtagaggggatcatcacactatattccggcggcacaacacaaacctccttgttcagcgaggcagcgaatatcagcctgccccaccccgcggtagcggtagaccaacaccatagagcatctccagccgccgcagtgctttcgtacgtgtgtgagagacacacacgagactacgtaataacatagtgcgcgcgcgtgtgaaaataaatgctctcgttcacgacaggcagttagctattcagtcagagcacttatttttactcccgggggggggctactcacttatcaactaaagaagaaggagt

SEQ ID NO: 624700 - DNA, 1158 bp, Homo sapiens
  misc_feature (49)..(49): n is a, c, g, or t
  misc_feature (243)..(243): n is a, c, g, or t
acccagacaagggtgcccacgaccctgaagccccagatggggtgttagngtgctaattagctcttttagttttaccatccatagcctgatggacggcagcatgttagcagctcggtcggcctctggccccattgtgtggggtggctgccctttgccagcgaaggcaaaaggccagtgtaacagcctttctaggtacccacactcggtgggtccccagctcttgtccagcatccaagaagaatnaggatatgctggcaattgaagagtgagcaagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagccagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtctttcaga

SEQ ID NO: 624701 - DNA, 643 bp, Homo sapiens
aaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaattgcttgaaccctggaggtggaggttgcagtgagccgagattgcaccattgcactccaccc

SEQ ID NO: 624702 - DNA, 763 bp, Homo sapiens
aaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacaggtatttattttctaagccttaattttttgctttcctgtatttaaggtattatttaaatgttacaaaattggccaattatatgtgtgcagaatgaatgtcggtaatcatgtacagtcatgtaacaccaccataatcaagctgcagaaggagccatagcttctcacactaaaaagtttcctccttcccctttgtacttgatcctttccccacagcctggtctgggcggtcactgatctactttctgtcactatacttcatgttaatgggaattatgtgctatgtaaacctttggtgttttatttctttcactttacgtggatgaagctaatattttgggagtcatccatgttgttatggtttttatattttgtccttttccctgatgtttccggtgat

SEQ ID NO: 624703 - DNA, 1306 bp, Homo sapiens
aaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaacatgcctagaacagatccagcacaatgcctgtaacccagtagatgtcagataaatgttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagccagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtctttcaga

SEQ ID NO: 624704 - DNA, 1238 bp, Homo sapiens
gtatacacatcactatggcatacacggtttccctcctcctagaagctaatcttattttttgtacttttctctttcttgctgttatacctataagttttgaattagagggtgagggggaggagggagtgcgtctgttcactttaagttactttaaaataactctgaacatgattatattatgccaaataagattaccaacagcaatcacagcagccaatcattgaagcatctcacagtatgttaactcacatttttttacaatgtcgcagtcaaacactttgtgcacaaactgctcatcaaagactcaacaagttgaccctgttcacaaacgttacatggtactcacagcatcagttttcaaggattttaaggtctgtatcaacaaaacatcaacaagtgttacccgaacaaagtcatcaagcatacatccttttggggtaaacgcattttaaagatcacaaatatccctattcatgggaggccaatcaggatcaagccatcggtaccttcagatgttatatagcacattcatttttcggcaaaccagcagttcccaccaggcatcaagggttcacactttggtattacagaacttttgtcattcattattcgtacaaaagttacatgttaaacccattgacacacaattcaacggacagtggagccattgactttcaaccatgattgtcctacaactatataatccccaatccttatcagacgacccacagcaaggatacctggccaagggcgccccaaagcatcttgaagcactgaatgcattcttggctgggttgacacattcctcagcatcaacccaaggcgtcactctcaaattcttggtcctagattgaaaaacccaagtctatttccaaatagcattacctaatttatacaagcaaggtcctttaaagcgccctacaaatccggaaacccagaaaatatactgctaaaagaagtgcttgtaccaaaaacaccagccgagccaggaacacggagaaacgcaagaagtgcgctcctaacactgggacatggcaatgccagaaagcaacggaaaagagaaccacaacgataagcagcagagacacaacgggcaactaaagggcgagaagctacaagtgagacacttgaaaacaaagaaacagcggaagaaacgaaacaaaaagacgaacacaaagacgcaacacaaaaacacgaaacagaaagaagcacaataaacacaaacacacaaacacacc

SEQ ID NO: 624705 - DNA, 206 bp, Homo sapiens
accagaccctgtgggcttcatgcctgctgatgggttttcttttctaaacatggaatgctcgccccagcaggtcctgggctgcttgagcagccagctgtttgagagcatgcacttctctgttctctcctccccctgcccagtgagttagcactgcagtcgcactgcccttgatgccagttctttccccaggccatagattgttacag

SEQ ID NO: 624706 - DNA, 626 bp, Homo sapiens
ggatgcggctattaccggtagttgttgttcacttatacagctttatatattatctgaaactttaaataaacataatcgggtgaaataaagctatttccactatggaacaccgatctcctatagtcctaagtagcagccagttatagttgtggtttggtgggggttcccccctcctccagggatgaggttgcccaggttggtctcgcaactcctgaagttacaggtttttttcaacatgaagcaacggtagagaaaacaaatagcatttcccggtaagtcaaaacagcagcaccagcaaaacaaagtgcaccctattaaaagccaaaaaatcacaattggagaaatacacacatttcacagaaacttaaacattcattaaaaacgttgctggccacgtacgagtttcaaccaagataatcacggcacgcacaaagggagtaaaaactaaggtaatcacctgcaaatacttgaaacgccaagtcaatgtgcactccctgttctacatttcaaacgctgaccttagctatagtcggtctccataggcacacacacaactagcaccgtctctctggcggatctacacgggctccaccaataccaaacacaatccactcagaatcaggagt

SEQ ID NO: 624707 - DNA, 104 bp, Homo sapiens
atcctctgtactaatgtgtactaatgtgtactaatgctgtactaaatgtgtactaatggtgtactaatgtgtactaatgtgtactcatggtgtgagggagatac

SEQ ID NO: 624708 - DNA, 679 bp, Homo sapiens
  misc_feature (134)..(134): n is a, c, g, or t
  misc_feature (172)..(172): n is a, c, g, or t
  misc_feature (319)..(319): n is a, c, g, or t
gcattcagaagggggacgagtggcatctacatgcctatgagtccgcagagcttgtaggtggccagtgctggcatgtgcccgcattggggctttgcacatccatatgtagttatgcatgggcttcgatcttcagnaggttctacttatgtcgaacggagtcttaggattccangctgcacgtcttcgtcattcactttacaggagttggcccttttcgtaaaccaaggggggggggaaaacaaaggcgtttggtcgacacccttgacacggacgccctgagctgacagagggcccgtgcaagcacagtcgttcacgcgangcacacgcgggctttttcgccacaaaaggggtttcacaaagggaaaacttggggccttttcgggcccaaattttttgggtagttagcgacggaataccctacaacaccggtccaaaaccacccctgtgagacagctggttggccccgggcgtttggccctaactggcaacggagccatttccagggctgggaccgaacttttgggcaggacgtgttgtagggacaccctttttcccccaaaaggcggcccaaaatgacacgtgctcaaatggatttgccccaacctatccacgcagccccccgaaaaacaagtcttcttccagagcacagcgcgcaaacagggggaggaatatatattca

SEQ ID NO: 624709 - DNA, 277 bp, Homo sapiens
cagtatcccccctggcttgctcaggtctcgtaaagcccaggacgcatgtgttgacatggcacttgtcagtggcatgtgattcaagcactcgatgggactctacctgggactgtcctcactcaccgtggctgcagagtctggtccatgcacgagggctttctctctctgcctcccatgggcacgcgctgggtgtaatgccggtgtggtgatgactctcctcatgctctcagcttcggctccttattgagtggcacattctttgtgctgctagcctgca

SEQ ID NO: 624710 - DNA, 115 bp, Homo sapiens
agcgtctgcgctcacctgcctccccagccagcgtgacctctcggctttcacttggtgcgagggagccatttggtggcgctgcttgtcttctttggttctgggggcgggcagaggg

SEQ ID NO: 624711 - DNA, 490 bp, Homo sapiens
  misc_feature (41)..(41): n is a, c, g, or t
  misc_feature (48)..(48): n is a, c, g, or t
  misc_feature (50)..(51): n is a, c, g, or t
attttttgttatgagtgtctggtgtggacaaggcgggctgntggcagnanncattcaattgttattatcaacaaaaaaaaagaaaaagaaaaaacaaaagaaaaaacgtgtgtgtgggcgcgcggccctgtggcgcgcccctgtggaggagagagagggtcttctcgagagacaccaattggcgatgtggggcgcgcggggggccccagagatagagggctatagagtgtgaaacccgtgtgggcgcccatatgaagcgcgggtgtctcaacaccataatggaagaaggagaggacaactgcgcggggggcccagagagacacactgaggggcgcgggggacatctctctctcaacacaaatataaaaaagagagcgccgcgcggggggggggcgcacaaacaccgccgagaggcgcggtctccgcggtgagagaccacacaatctctccccagagagacggggggacgaggtctccccggtagagaggg

SEQ ID NO: 624712 - DNA, 1010 bp, Homo sapiens
caaatgaatccaagcagccacagatactattaggagggaatatatcatggtcatccagcattgaccactacaagtacaatgcgaatctccactattctcatgcgtttattgatctgactgaagattttactagcagataatatggcctgtacgacattgaatgccaccagctagtacctgtccagttgaaatatgggaaaatctgggcatggtaacatctatctctcgtcagttgacgttatattcgtgaataaacctcacaaaatatgatggtggcttaggaccacgatcagcatggtgccagaccttgagatggagcatgagtagcacgatggcatcagttatactgccaggctgtgaacgatagaaaagattgccaaaagagtaccatctacttagtgagatctgggatgaagccgtgggtgccaggtcctacaagatgtcaagcgaataaggggcactagcgtactggggctatgtcgccgattttgtgggatgaacaaggaaccaactgaatgtaaccaacttccaattactcctttcatactggagactacagagtatggatggctatccacgaaggctctggctcatactaagagaacgacatctggaagacaccagccaggcctttgttacttggagaacgtcccttgtacctaatgcaagctgtgagagagtgccgcgtcgaagtgtataaagtctactgtcgaagctgacagacctaaatcataattagggatggccatggtatggcagccttacttgacatttacgaagatggaatcttggaccttggtagagctagctaagggacacaacaggcacggtttgtgcccacttcaatttacgcttaaaaataacgttgaaggcagcccgttctgtctaagaatacggcctagcgggccggcggacaaataaggtgtccctaaaaaaccctgggtgcgtataaccagcgctattagagtaaccggatccccacgtgtttacaatggcgcaccaccctgcct

SEQ ID NO: 624713 - DNA, 135 bp, Homo sapiens
tatggtcagcccggtgccttcacctgctatattggatagcagggcttgccagaactaccactgggcataaagtttttggtggcctgaagggagctgtggatatgaggcttgtctataccctcacagtaccaaacg

SEQ ID NO: 624714 - DNA, 87 bp, Homo sapiens
ctagaagattcagcaaagtacttttgtgctcttggggcccccagaatggccataggcttgaggtggtgggggattcataaactcact

SEQ ID NO: 624715 - DNA, 1537 bp, Homo sapiens
tgcggtggctcacgcctgtaatcccagtactttgggaggcctgaggcaggtggatcacaagatcaggagatcaagaccatccctggccaacacagtgaaaccccgtctccactaaaaatacaaaaaataagccgggcgtggtggcgggcgcctgtagtcccagccactcgggaggatgaggcaggagaatggcgtgaacccaggaggcagagcttgcagtgagccgagatggtgggcgacagagcgagactccatctcaaaaaaaaaaacaacaagaaaataatccccgggaacggatttccgggggaaattcctcccttaatcacggcaatattgggggcacagcagcattaagaccccccaaacaatcctgagaaacgttacgggggcgctcacttgtcaacggaacagggacacataagatttcccaacgcttatcctcagctccctttagtaaagtcccaagcttccttgggacactaggccaaaagggtcacgctcacttttagcatgagacgacacaatcccatggctttcttaatatatggcactggggccggaaagtgttcaacaccctgacgtgcacgagttaggttatttcccaaacactcaagcgggtgctcaccagggccgtcgatggacacaaagggcgcatgccccacatttagcgccccgcgtgtcttcaacaacacattcggcggatcagaccgacatcactaacgcagggagtcgcgtaaacctgtgataccatccaacacaactgtcaacatatcctcatatcctctcctctttcctcttctccttctctctctactccttccctctccttcgctccttgctgccagcacgacgctacgtaaacacggacagacgtagcaacgcagggccggatactcatcgaacgcaacaagagagacagaagcgagagccgaacagacagcatgtcgcgtacgaccgcacacgaacatacctgacgctgacaacgagaatgcagcaagcacgccacaccacggatgccgccgcacagacgacacagcatagccgaagcgagcagatagctacgcaggacgaaagcaacatgcagaccagacagacagagacaaaccgaaggacgaaagcgcggcgggcccggcaaccgaagcgaggccggagaagccagaccacgacagagagagaatgagagagcaaggggcgagagaaggagacagcgcgaggagagcaagacgaagagacgaacagagcagacagagagagaagcagcggagaggcagcacgcggagacggaccagcagaagagcacagcacagagcgcgaggcgacacgcagacgacaagagaagagagacagcgcagatggagaagacaagccagaccaaggaaagagagagcgagagaagcacgcaaacagcagcagacgaagagagcaagcgagcgagtcggaaacaggagcagacgcaaaccacaggaagacagacacacacaggagcacacgaacaccggaggagaagaagaaccgcgcgagcagccgaggaaagagg

SEQ ID NO: 624716 - DNA, 333 bp, Homo sapiens
gctgatggactctcaggtgcgctcgcagtattaagaggagggcatgccccagataacctccattatagcaaccagctcaggaagagtatttagcgctagcacacactaacgagtgtcaagatcagggtggattaataaatggaaagttacaaagtgttggacttacactttgtcttgttcagtcaactgacgggtatgctgggcacgtcatcattgagaactgtggctacaaactcgcctgctggaattgcagatattcagcggcgagatcgacttattgccattggaggtgtggtcctggtgtactatgaaaggcctgttgtgcttagttcg

SEQ ID NO: 624717 - DNA, 112 bp, Homo sapiens
atcccgcttctcgttgtcattcgcgcatcatgggtatatggttagtggtgtgggttagtaggcctagtatgaggagcgtatggagtggaagtgaaatcacataagggggtat

SEQ ID NO: 624718 - DNA, 353 bp, Homo sapiens
tgaagtttctttaaggcgccccaggcaatgaggcctagaagaggtcaaggtaagaaaggttaagcatgggatcactacaggtacttgaagtacctagagaaggaacccatccgggggtaggtggagtgggtatggctactcgtttggatagttctcagtaacagagaaagaaacatacgccaaagccagaaagcaatccaagccttacagtggtccaatacctcagggccagtgggctagaattttctttcccctcagcccataatcacttagagttcgccatacaacaaccagccggacaatcggaccagcatttccatggctatacacggtacgcattccttcattctgta

SEQ ID NO: 624719 - DNA, 811 bp, Homo sapiens
  misc_feature (687)..(687): n is a, c, g, or t
caggcatggtggctcatgcctgtaatcccagcactttgggaagccgaggcgggcggatcacgaggtcaggagatcgagaccatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcagtggctttttaaaaatttctgggcccttggtcctctcgtgggaatgggagttggggacattagagttggcctggattgggcaggtagggtagaagccgtggcattggggttccacacttggggtggggcgtgtctctcactcaggcggggagacaacccctttccccaagaaattgctgatgggactatattgctacgaattccacccattacaaggagactgtggaaggctctggaggcacgtggttggcataaggggctggttgcaggcgctgggcctgttccaatttcaacagttcggcaagatggatgacattactcagtgtggcctccggtgcgttccagcgtgtcttgcaggtggcaggtccagcggaaagtgatcggnatccccaaaagtttcactccttcgtcgaattccttcagaacattcaagggtgttgtgacttcacctttaagcccagaaggagatgaaggcagttaaatgccctgaaacaaacatggggagatat

SEQ ID NO: 624720 - DNA, 334 bp, Homo sapiens
ctcacaactgtccaacatcactctatggccgggcgcagtggtacttacctattagcagacaaggtctggctggtcttgaactcctgagcttaagtgatcctcccaccttgacctcccaaagtgctggaatcacaggtgcaagccattgctctgagcctatagggctttttatatacactttatcctgtaatcttcacagccactctgctgaccgtgaacggttactcctacctcataccctcaggaacccacggcacagacgttcagcgaatatgctcacgagctcatgcactggcagtgcctcaactccgtacccagagctgtcctcccacgg

SEQ ID NO: 624721 - DNA, 202 bp, Homo sapiens
tctatgggcctgctctgcgggaaatacgtgtaattgaactcgatggatgcataaaatttcaaaattaggcagttgaattaattgctgccaattcgtctattatgtcgattcgacaaatccatataggtacattcatttatgaacagcccactgctctatctcgaagatttagttgtcggtcaacgtttcgtcagtggcacct

SEQ ID NO: 624722 - DNA, 163 bp, Homo sapiens
  misc_feature (119)..(119): n is a, c, g, or t
tccacacgacgcttcagggctttcctctaaccttgagaagtgtggaggaaggaagtaaaagtcctctgcaaacagaaaatacacaaagttcttctccttagcctgctcatctcgcttcnagaaacaccacacacccacgccactactagtgcagaacccacat

SEQ ID NO: 624723 - DNA, 520 bp, Homo sapiens
acagttccgcgtatctgtgcatcgagctgtcccactcctgcgaccgatctcatggtctcatgtttgttcacatgctgctcgtatatcacgactatagcccagcactgagcatacgttacgaataaaagaggtgtacttggacatatggttccgcgtggttgcgaaacgctcacgatcatggcttcaacagggaatggacaagtaggtcactgctctatcacagtggatggcatcaggtacggagagcgtgtgcacgaaaacgcgccctatataatataccatcaaatctgcatgagagttactattcacgatgatcgcatgggaacgacctgcccccatggattcaatcatgctcgccactgggtccctcccacaatacatgggaattcaagatgagatttgggtgaggatgtagccaaaccatatcacatatatattaagtacttattaactcacccatattatgttgaaaagagagtgagagaaagagaaccaccacttgtatttacttcaaatgaca

SEQ ID NO: 624724 - DNA, 652 bp, Homo sapiens
gctgcttatatgtggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggcaccacagagaagtcatgtacacagccttcagagcactgggacgaagtgtggattatgtacaggttgtgattcagacactatgcttgacccagcctcatctgtggagatggtaaaagtttagaagaagatccctgttgagggtgggacattcgattaacagtcattctg

SEQ ID NO: 624725 - DNA, 314 bp, Homo sapiens
  misc_feature (99)..(99): n is a, c, g, or t
  misc_feature (234)..(234): n is a, c, g, or t
cgacgaacccacttcccagaataaaaactgtttggcttacacttctgaaacttaattgccttacagttctggagactgttgttcgagatcaaggagtgncacgggctggttcctcctgaggcctctctccttagcttgtagatgccgtcttctccctacgtcctcacatggtcgtccctctgtgcgtgtctgtgtcctaatctcctcttcttataaggacatcaggcatattgnattagggcccaacctaataacttcattttaatttaatcgtctcttttaaagaccgtatttccaaatacagtcacactcag

SEQ ID NO: 624726 - DNA, 428 bp, Homo sapiens
  misc_feature (405)..(405): n is a, c, g, or t
cagattaaccattatcaaatatgagagcacctcgaaattaatcagaatacattttgtcctgccattcattagtcatggtaatgagtaaaacctttcacctcatggaacctttttactcaggtataaaatagaggttatcccttattcttaagtaagtataggggccaactaataaatagtgagcataaaagacctttgtaagttaggaaatgctatgagtacaagtcattgttaggaccacccccttggaacagggaaggaaggtggttaaattttacatagttgctcttaggttttctatctcctgcttcttggtttgcataaaacaaactgggaaaatcactattgctttgtatccacttatctattcttgtagtcctacaaagttatggaacatataactgngtttggactcttttttaaggggt

SEQ ID NO: 624727 - DNA, 644 bp, Homo sapiens
cgtgaaaaatgtggagtcactccgtcgtcaaacactcccacggctttagcaacctaagctccatatacgtcttctaaatcctttgttgtcatttcaagtaacgtgcacagtatcttcattaagggtaaactccatctcaaaacaccacttttagggctcatccataagaagcaaattcccatacattcaacactgatcatgagattgtagcaattcggtcacatcttccacttcttatttctctggtgatttctagcacatctttagttaccacctccactgaagtctggaacccttcaaagttaaccatgaagtttagaatcaacttcttccaaactcccgttcatattgttattttggtcccctcccataaatcgcacatgttcttaatggcatctaaaatggtaaatcttttccagaaggttttcaatgtactttctccagatccatcagaggaatcactgtctacagcagctatagcccatgaaatgtatttcttaaatggtaagacttaaaagttgaaattactactccttgatccatggcatgcatcaggggtgtagcaggcatgaaaacaacattaacctccttgtatatcttcatcagagctctagagtgacttgatgcatcgtcaatgagcagta

SEQ ID NO: 624728 - DNA, 137 bp, Homo sapiens
  misc_feature (29)..(29): n is a, c, g, or t
cagcccatcaatgacatgtcctactttgngtgcctggacagtgtaatggagaactcaaaggtgctgggcgaggccatgaatggcatctccaaactctggcaggtttccgttcttggcattttgggagatgccagtca

SEQ ID NO: 624729 - DNA, 466 bp, Homo sapiens
  misc_feature (34)..(34): n is a, c, g, or t
  misc_feature (106)..(106): n is a, c, g, or t
aagaaagggcttaccttcagagtagatgccatcngaagccacaaaataaacactgttcaatatacagaacattaaatcctgtttgtgtaattaaaatgacagcagnagcatagcagttagccaagaagacatatctcacttgtttccagttgcataaagacacatccaactcattctggattatctctgttcctgctgggtttatttttatagctggcatcaaaaaagctctcatataatttccctggcattttacaaaagagttcaattgggtttcctaccttcccccaatacccgattcgatatacacagtgtgtatctaccacagatcatatatgattcaccttataataactttcctcaaagctgtcctcaaaagatacatgataaaagaatcgaaagagtctaaaactcaacagcaactatgcttttgtaataataaaatgtatatttaaggaaaaactgt

SEQ ID NO: 624730 - DNA, 1013 bp, Homo sapiens
gaagcgaccgagggactgggagtcgtcagtgagagtttcactctggtgcctaggctggagtgcaatggtgcgatcttggtctcatcacgaccttcgggctcccaggtgtacaagtgatggtcccatctcagatctccacgagatagctgggattacaaggatgacgcggcatgggaagaactgcaccgtgagggggcgtcctacagctaccacgagaaagaagaaggactagagcgggtcttcgggcatatgggacccaggatcattcagacatgagccggggatgcccgtggaaggacttcagactgctgtgtgctcttcccttgcatgccttgcccactgatcctgttgtcgaccccagatggtgtacctgtatgagcggtgaggccatcctgtgagttgcattctgcagcaggaagaaggagatagcgccggcgagatgaaggcctacggagaagcagtcggggcacccggcgcgaggagcagaaggagcttcagcgggcggtctcgcaggaccatgtgcggggcttcctggacgaaggagtcggctatcgtgagaccggccctcaagcctttcacagcaagggcctctcgggcaccagcccagatgatgtccaagctgtgccagtgtgggtcctccaagtgaaggactaggacaaacgtgctgcccaggttctggatcccgtcgctgacgcccgaagacaaagggcagcaagctggagaagcgtcccgcacggtggactgcccatgtaggagggccctgcgcatgtggactgacgccgtgacttgacacgctaacagctcgtggacgggtgggtcatcaccggagcgaggctacgtgtgtgcggaccggagctgagacgcaccctgggtggggtgggcttggggtggtacctcgatgtggaacgtcgaggcttgggcctgtggaatcacgagaagtcacgggacggtaggccgcagaaagaaagggaggggggcaaccgggacaacactcgggggcctatctgtataca

SEQ ID NO: 624731 - DNA, 121 bp, Homo sapiens
  misc_feature (114)..(114): n is a, c, g, or t
caggtctccaccctgttgtgcctctggtatgcgagctttgtcacgggctctccgtactgagcctcgcctgttctgattatgatgccactccatatttttgacttctcctggtgnactcttg

SEQ ID NO: 624732 - DNA, 1215 bp, Homo sapiens
tcggtggcggtccgctgccgatccgtggaggaacgcgccgccgagtccaccatcatgcctggggagttacaggaaaggcttcggctgtggtggtcatgcagatcgattacgtaccagtatatttgacgacgagattcggaccccgttcgaggtgctgaaggcagcagatggaacacagaagagagaacgaagctcggacggaggagacgggcggtttgggggggccccctgggtggcctcaagcacgtcggcacgcgtcaggggccaggcgggcacagaactcgaattcgcaacgacggcaggggcgaacaggttgcgtcagattggacgtcctcaggacagggacccgctgaggaataccccggctgtactccctcatgcgttgggggcagtgggttggaccacagacaagggagggaggagctgccagaccggacccggtgggcgcgcctttagagtgaccaacgcaagggaacataaggaacgcagcttgggtaaggaaagggaccgtggagtcgaggcaagcctttcaggggggttgaaacggggacaatagtaagtttgaataggaaggatccatgaaacaggtgcgaaaccaccgtcggtggaaccggagaggaattcggagagaaggccatgtttgcaagaaaaaagggggtgaaagggaagtccagaattttttcccagttggatcatgaccggatttattgggaccggaccttaattcgaaggtcgatgggatgagtacgttggggaagagggtccgaagtgtgtggcccgttggaacggtgggaatgggggccagaggtaagaatgggattttgggattcctcggtggaacaacggtggaatttggattagggccataagtgggaaagttgattagatctgggggtgaagataagagaaaagataaaaaatgtgttgtgaggtaaaggggagttttcaccaaactgtgtggggaacttggttacaagggacggaaatttataaccaaggagattcccccccaaaagtatgagtttcgggaaacacaaaagttttctttattacattccagcgggagaatgtgaggattcaacgcaacaagtgttgtgcctttgcgtggaaacaccctgtgaggtcgttacgtgaccgactctcattccaacagggcggcgacacacctgtgcatcaatatgggaacaacgtatagttgctacagtcgtataaaag

SEQ ID NO: 624733 - DNA, 222 bp, Homo sapiens
aaattaaccccccccaaagggaacaaaagcgggggctcccccccggggggggcccctctaaaaaaaggggatcccccgggaagcaggaaatcggcccgagcccaccacttttgataactaaaaaatattatattttaacggcagaatgggaaattccccgccccaaattaattaattccgaaaccaaaaaggcctttttccaaaaaaaccccgaaaaattga

SEQ ID NO: 624734 - DNA, 461 bp, Homo sapiens
gagtaaggcctcctggtgacgacctgcttgtgtacaactgggctcctggccaatggtgagccacctggatgagagcatcctgcccaatgtgagcccaccgatgcctaccacaccatcctcttcaccgaggacagggacatccgccaccaggagaaacacaccagcatcggtaatcaggccgaggatcaagatgtccagatgatgaatgaaaaccaaatcattaccaacgcgaaacggaagcagagcgttgttgacccagccttacgtcccaaaagctgcatcagggagaaggagacgagacgacggcgctgctgactggtgaaggagggagagctggttctcccactatggtgggctccgtcagcagccccactcagtgcctgctgtcctacacctcagtcccaggagctggaagcgaaacacagtgttgaggggagccgcttggaagaggggactcggga

SEQ ID NO: 624735 - DNA, 262 bp, Homo sapiens
atgccgatggtaattaaaaattcacattctgatcaatgtccataaatgtgggaacttgaaaccggaagtcagctgattgcagataaccatgaacttgctcatgccttgccagcagcaattcattagggggaagaatctcacagttgcatgaatggccacgagtggcaagacactgagccaatgataatagttcaaatcacaaccacatcacatgcaggcaatcacatagataacacacacctgcaagccagcaaaccatcca

SEQ ID NO: 624736 - DNA, 441 bp, Homo sapiens
  misc_feature (181)..(181): n is a, c, g, or t
  misc_feature (234)..(234): n is a, c, g, or t
  misc_feature (243)..(243): n is a, c, g, or t
  misc_feature (270)..(270): n is a, c, g, or t
  misc_feature (285)..(285): n is a, c, g, or t
  misc_feature (296)..(296): n is a, c, g, or t
  misc_feature (298)..(298): n is a, c, g, or t
  misc_feature (305)..(305): n is a, c, g, or t
  misc_feature (312)..(312): n is a, c, g, or t
  misc_feature (332)..(332): n is a, c, g, or t
  misc_feature (341)..(341): n is a, c, g, or t
  misc_feature (352)..(352): n is a, c, g, or t
  misc_feature (359)..(359): n is a, c, g, or t
  misc_feature (363)..(363): n is a, c, g, or t
  misc_feature (438)..(438): n is a, c, g, or t
ggtgccgggcgaacatggcggcggccaccggaccctcgttttggctggggaatgaaaccctgaaggtgccgctggcgctctttgccttgaaccggcagcgcctgtgtgagcggctgcggaagaaccctgctggtgcaggccggcgtccattcgtggtcgtgcagggcggggagggaagacnagcgcactgcaccgacaccggggtcgttttcgccaggaggttctttttttacntgtggcgtngggtggtacgtgagccaggcgtgcgantgggtggtaatcgantggttgaacancntgggaangttcgancccgtgttttgttgtcccanggcgttccntgccaagccanatgccancccntggagatgggataaagaagtcaatttccaaaaggaggcacccttcacacggaagaaagctaatgcccggtgtgancga

SEQ ID NO: 624737 - DNA, 701 bp, Homo sapiens
  misc_feature (3)..(3): n is a, c, g, or t
  misc_feature (41)..(41): n is a, c, g, or t
  misc_feature (108)..(108): n is a, c, g, or t
  misc_feature (116)..(116): n is a, c, g, or t
agnggagcccccgggctgtaggcaaaaaaattgaacggaancttatcgaaaagaaaggaacagaacagaatgtaagggaaggtaacggcacccaaaggaacgcactgnatcagaanggactggaatggaaaggactgtaatggaatctaatcaaatggaatggaatcgaatggaaaggcatagaatggaatacaatcaaatcaaatgtaatggaaacgcatggaatggaatcggatggaattgaatcagagtggaatggaatggagtggaatagaatggaattgaacggaaacgacttgaatgcaatggaatcgaatggaatggaattgaatggaatccaaaggaatggaatggaatagaatggaatgaaatggaatggaatggaatggaatcaaatggaatggagtagaatggaatggaatagaaaggagtgggcatgaaaggaatggactcgagtgaccagtaaccgataaccagacccgaactggccacacaatcttcgctctcaaccatcctgacttgcggaaggtcgccgcactcatgcctccataacccccagggtctctcacaaactctcactccctcccgcgctggctgcccactccactcgccattccccaatctccgctgctaaacggccctcacctatactccctggcccctccacaatcactcctagcccccccgctccaatctgctcc

SEQ ID NO: 624738 - DNA, 516 bp, Homo sapiens
acagcggtctatccataccggactaatctattgaaacatagaagcagtaatgttaatatgagtaacaagaagcctttctcctcgcacacgcttacatcagtaactaatcaatatactggataattaacaatacaataaaccaacaacaacactaagagcgtttattaacttatatatgttaaccacaacacagtgagtgcaccaatggacagattaaaacgaagtaaaacggaactctggcaaacacaagaccccgccgtgtttaccaaagaacatcacctctagacattactagctattacgaggcaatgctctgcccaagtgacacacagtttaacgcgccgcgagtattctagacgcgtgcacaaggtagcattaatcactttgttctccaaattaaggacttgtattgaatggccacacgagggttatactgtctcttacttccaatcagtgaaattgaccttcccgtgaagaggcgggaataaaaaaataagacgagaagaccctatggag

SEQ ID NO: 624739 - DNA, 652 bp, Homo sapiens
  misc_feature (11)..(11): n is a, c, g, or t
  misc_feature (109)..(109): n is a, c, g, or t
  misc_feature (153)..(153): n is a, c, g, or t
  misc_feature (248)..(248): n is a, c, g, or t
  misc_feature (254)..(254): n is a, c, g, or t
  misc_feature (267)..(267): n is a, c, g, or t
  misc_feature (272)..(272): n is a, c, g, or t
  misc_feature (325)..(325): n is a, c, g, or t
  misc_feature (329)..(329): n is a, c, g, or t
  misc_feature (349)..(349): n is a, c, g, or t
  misc_feature (365)..(365): n is a, c, g, or t
  misc_feature (367)..(367): n is a, c, g, or t
  misc_feature (492)..(492): n is a, c, g, or t
  misc_feature (496)..(496): n is a, c, g, or t
  misc_feature (498)..(498): n is a, c, g, or t
  misc_feature (501)..(501): n is a, c, g, or t
  misc_feature (645)..(645): n is a, c, g, or t
gcgttcccacncctatttgggcggattcttggcgccggaggaagaggcagggtcacactctctccacgtcaaaaacctgactgtggaaatggcggctcaaaaaataaanaaagggctggaacacctcgccaaaacaaaaaaatacctgaaaantggttttttaaaatggaagccaaattataacagtgccgcttctgaatatggaaaaacaactgttgcttttaaaaatgccaaacagtttgagcaancaaaanatgcctgcctganggaanctgttgcccatgaaaataatagggctctttttcatgctgccaaagcttatgancaanctggaatgatgttgaagganatgcagaaactaccanangccgttcagctaattgagaaggccagcatgatgtatctagaaaacggcaccccagacacagcagccatggctttggagcgagctggaaagcttatagaaaatgttgatccagagaaggctgtacngttntntcnacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggnaattgag

SEQ ID NO: 624740 - DNA, 110 bp, Homo sapiens
atctgctctgtcctctccctactgtatcctattaagcacagcctgcccaacattgtgacactctgtctcatactaaaaatacaaaaatgatgccaatgctgtctggctgc

SEQ ID NO: 624741 - DNA, 787 bp, Homo sapiens
ctgacttgtcccaacactgtcagtgaccttaatcacttgtgccaccttggtgtctgccaggtttcgttctcgtgtaatgtcacctttattctcttgataatggatagtatttgcaggggacatatcgtaggattatgccaatatccgtatttgctcgtcaagtcgttcatcctcagtcttagcatccatggatgaattctatctgaagccaaagcagccactatttaggtgtaatttccatctctgttagtcggcattctatgtacgaagagctttccgttgtcctgtcatttactccatatcagcatagacttgtaaaatcccacttgattcagcaggtcgtaatcagttactgtcattcgatatctgatcgctcatactgtcccagttcgtccagtgggagccctttcacggcaggttcctaggtcttcgtaacaagtcgccatcatgcttcgaacacttgctggccgaagttgttccaggcttctcttgtattcggcttggctcagctatctaccatcaggcattttccctagaagcactggtcctatcaggatacacactggtctgacatgctacaacacggggtacatgggggtcccactcgggacctggcactatctcctgggcccatctctgaacagtacgcggtggagcgccggcacccgcgcgctcaacggcacccctcccacctctatccgtctccccaagaccaaaagccatctcacgaactcggcactccctcaccccacacagtcgcaccccggtcgcgccccccccgcacacg

SEQ ID NO: 624742 - DNA, 456 bp, Homo sapiens
ctatttaaaggagggcagatgaatggaaagcaaagtagcaattgctttgcctctggctactgccagtcagtattcagaacttctgaaagacaatagcctttcatcctatagctttgaattaagggaaataatcaattcatctccctgtttaccatgttaataaaaaaagaaaggatccagaaggcaagttatcccccaaaagttatacagtttccccccaagtaattttcagtttacctccattatttttcagtgccagattatggatttctacattcctaatcagactctatttttgagcaacattgtctacatgtcttataaacctgcacactgtttcatatgtgtgtgaagttcagagagagatttcatcttctctttaggttttgctgcttagttaaagtcatgtgagacaactttgattgcgtttttattagttctgtttcacatttggcg

SEQ ID NO: 624743 - DNA, 967 bp, Homo sapiens
agatatactgtaaagaaactatgccatatatgagggccgtaaataatgtccataaacatgaggtgtgcaataaccagaatctgaacgttatatacatttttatcaattagaatggaacatattttcaaaggatttataactattcaatagttaaaatggacacactagatctatatatcaacataggaagctcttgaaaattaattcttagtaaaattggcaatttccattacatataaaatttgaaaatacaaaataataccatgaataatttgggagcatattgatatatagcaaatagcaaatgtattgaatatcgatgggaacgaatcagaataatcgttactctaggaaggattctgattgcctctgggatggtgtgcaaaaatgttttaatatctttagatttcttaatatttctcaagcaaatataacaaaatcttcccatcttttgtagtcccaaaattaggtatatgtacctttgttgaattattatctgatctttcttaaatttatattaacaaataaaaaatataaactaaaaaataatttagcactaaactaaaaaaaatttagacaacggtactaaactgatttatgaatgtctttattattccatcactaggaaacagcaggcttgctatttatgttctggttactctgatgggtcctgagaatggcagtatttctgcaattttcacccttttttccctttacctagtggaaatcttcgtttggcagtatcttacttggtctccctcaaggcttacagattctgcacaactggttgggcaccatgtctattattgcaccgcggaaggtaataaactgtaataacataatatataatacccagattgctcttgaccaaaacgaaacaataagcgtacgattcaaaaaaactgtagatacagtacatacgagtacgtactaaatatgctgccactcttcagaaaaaccacacaca

SEQ ID NO: 624744 - DNA, 243 bp, Homo sapiens
tcagagagatgctgaaactgtatggcagcatagaacagaggtgtgacaatcagaggaaagtatatgcatattattctaagaggtctgcctggtctgggaaaacaacattgtctcgaatctgcttggtcgaatcgatggttgtccactgatactatttaccatcaagatgtacaggttatgttatcaacttggtgatgcccatatggaaccagaacagtggttcgttttgggctaagtgtccca

SEQ ID NO: 624745 - DNA, 195 bp, Homo sapiens
gcgtacgggacatgactatacttattgcttctatgatgtggactatgaacaagaacgctaaaggttccaactacgtggagaaacaggataatgatggtggcacagaaattcctggatgctggtgcacagaactcaagcttagactgtagctagccggcaaaatcctttagaccagtgaacttctctagattcttc

SEQ ID NO: 624746 - DNA, 931 bp, Homo sapiens
tcagcaccggtagaccagtgggggcccaaggcgtcgttggcgcccactcggcgcaaaaagatgagtcgggcgagacgccggtgtcctgtcggcgggagccctagccgtagcactgcccccacctcccgttttgatagtcccgcaactccgggatgaagctgctgccgcgatcgaccgacagtgtaaggctggtgggagacgcagatggccccctgggggtatgccaccctaagggggcgaccacgcacggggctccgcctacgcggaggaaaaacggcctggtgtacgacccctgaggcggccctcacttcccacgaatccgcctgccgtgtcatgtggaacgggccgcaaagccaccttggcgccccaacaaaagtggtgggctatcagacattgtgcgctgacgcggagtaataatgtctgaagctcccggtcccagacgcctatcttatacataccacggcgctcactccaataaagcttgtttcaatattaaagataccctcttgttcttcagggactctcgcattagtgtcatcgccccaaggtgcaccacctgtatttagcacgcgcaccttgtaggtgggccaaaagggtgcttgctcgccgctcgtaaaatttgtacaaatgacgctgcgttgttgggggaatcaattcgcctccgggccataagttgttgcgaaacccccgggcgcaagcacaaacaagcgcgtcaccccgtctcttgtgtcaatacccccttgattggggagcacaaatgtttagcgcgagccctcggtggtgctcggagacagcataggcacattatgacttggcttctgcagacatgtgtcatggctatgcccccaaggccccctggtaggggagaaccccttttcgagacccacgcccccctggtggttgtacccggcccacttttaacccccccgcg

SEQ ID NO: 624747 - DNA, 151 bp, Homo sapiens
  misc_feature (44)..(44): n is a, c, g, or t
aagcagtggtatcaacccagagtgcccattacggccggggctantggtgtgaatgagtaggcaagatggaacagaaaactaacgcagtatggagcataagggagaagaaggagaagaaaacggagaaagaaggcacacgagaacacgcaac

SEQ ID NO: 624748 - DNA, 758 bp, Homo sapiens
  misc_feature (6)..(6): n is a, c, g, or t
  misc_feature (61)..(61): n is a, c, g, or t
  misc_feature (156)..(156): n is a, c, g, or t
  misc_feature (183)..(183): n is a, c, g, or t
  misc_feature (199)..(199): n is a, c, g, or t
  misc_feature (201)..(201): n is a, c, g, or t
  misc_feature (205)..(205): n is a, c, g, or t
  misc_feature (211)..(211): n is a, c, g, or t
  misc_feature (219)..(219): n is a, c, g, or t
  misc_feature (236)..(236): n is a, c, g, or t
  misc_feature (248)..(248): n is a, c, g, or t
  misc_feature (251)..(252): n is a, c, g, or t
  misc_feature (261)..(261): n is a, c, g, or t
  misc_feature (297)..(297): n is a, c, g, or t
  misc_feature (484)..(484): n is a, c, g, or t
  misc_feature (490)..(490): n is a, c, g, or t
  misc_feature (496)..(499): n is a, c, g, or t
  misc_feature (527)..(527): n is a, c, g, or t
  misc_feature (661)..(665): n is a, c, g, or t
  misc_feature (739)..(739): n is a, c, g, or t
aatatncattaattaatgttgccctaagttttatcagttaaaatttttttttaattttttnggaagaggctttaacatgagaaatacaatatatcccagtccattatctacatattcttcattttggccatgaggtcttccaagctttcaccagantcttccactgttaactcagtgacagantcttcttgcttttttngnattntgtatnccactgtnattccttcaggtatttntttttttttttntgnnatttttttnagttcctcttctgaaacctcagataccagctcaatnccccattcattatcttcatggattatctcttcctcttcttgtataacctcttgtttaggcagtgctgctacctttttcttatattcctcctgctgcttcctgcaatttctgtcatcacactgaggatttggcttcatggacatagtaggaaaaaaatcctgcattgcattgtatccttgtgttaaanctttcngttccnnnntttttcagaaacttttacacgttttgtnctaagatcccagcaaccacacccatagtggtaggaagactggctgcacaaacaccttctcgtttcagagtcttttcatcaatatttgcagcaactacaagtggtggagcacacgcaaaacaagcagattctccnnnnnttataagctgtatatgccctgaaactgcattttcactgaccccagattccatccatgtttgtccagttcattanagctgtattattgtcatcg

SEQ ID NO: 624749 - DNA, 351 bp, Homo sapiens
aggagctgctctagatgatcccgttggtccgatcactgtactatatgcctgtttttcaatctacctgagcaattgtggcatttttttaatctactttttttttttaagaggtgagggtcttgctatattgctcaggctgacatcaaactcctggactcaagcactctttctgcctcagcctcctcagtagctgggtattatggtatgtgtacatatttacttttagagacagggtctcgttctgttgtccaggctggactacagtggtataatcatggctcactgcagcctccaacacctgggctcaagcaatcctcccacctcagcctcctgagtagctagggactacag

SEQ ID NO: 624750 - DNA, 831 bp, Homo sapiens
gacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtactggtctatggaattcaaacaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattaccttttgatgtgcagaggaattacattgctatgggttgggaagttacttaccggggaacgactgtattggagtatatagggaaggtaaagaatcgcctgggactatcatatttctgtgcagaacattgatgcgttcgaaaggaccagaacgcatgataattgggtggagaagcccgtggtgcaaaggttcccacacggcaagaaagggaaccattgccaagggcttggcaactaaagcgttgga

SEQ ID NO: 624751 - DNA, 548 bp, Homo sapiens
  misc_feature (548)..(548): n is a, c, g, or t
ttgcgaggcttctctaccttagatgactgcttctgagccccttctcgcaagtctcggagaggtcatccatgtcctcccaccccaaactttccggaggcgagccgtagcccagggagcacccaggaaaattccctggtatctgcctcatcacccaaagccagaggtgggcagagtacggccgggtgagcccgggtgaagatggcctctcagacccgtgcagagatgacttctgatgagtgccagccagcagaggcccctcgtgggggacatcggaagcaaccacagagacccacacccgatcgggggagaaggacaggagctgggacaggccaagagctatctccctgggctgagagaagaccggggaaaaagggagtactgggagccaggaaggaagaagagggatgtccagtgctggtaaaggagaagtggggcctgaagaagttagtcctcagtcaggagcagaagaccatgtggtgggatgggattgactccatccctgagagtgtgcacctcaaaggtggggagcgaatttccaagaagtgtgn

SEQ ID NO: 624752 - DNA, 237 bp, Homo sapiens
gtatttagccggtttttgtttttttttcaaggcgggcccaagccccccgactatgcagggccccaagttatgctatgctatagattatgtgccctatcatatgattagcggcttttgttttacttttgtaagccggcttataaaaccccccctctgtttttgttttgggctcagctttttggatgcaaatcccctgagccgggggggccctaaaataaacaatcctcctgttttcca

SEQ ID NO: 624753 - DNA, 816 bp, Homo sapiens
cgccgtatgttgtgtttgttttttattgttgtcaagggagctgattgctacttgatttgttgatcatgctgtcctgtttgttttatcttttctggtcgtcgtcatagtgtttctcttcttcttatataatgctttctttctctatgtgtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtactggtctatggaattcaaacaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattaccttttgatgtgcagaggaattacattgctatgggttgggaagttacttaccggggaacgactgtattggagtatatagggaaggtaaagaatcgcctgggactatcatatttctgtgcagaacattgatgcgttcgaaaggaccagaacgcatgataattgggtggagaagcccgtggtgcaaaggttcccacacggcaagaaagggaaccattgccaagggcttggcaactaaagcgttgga

SEQ ID NO: 624754 - DNA, 209 bp, Homo sapiens
ttcttcgtaagtacatcttaaagctgtcaagatggttagcagaccttggaagaaaaactaaccatcagcattacctcgttgcgaaatgccaccattatcaatcataaagaggtattgatcattctaaagaacgcttgtaccgcttgttggaagcagatgttaatattaaactagtgaagcaactaagagaaatgtaagctcattgacta

SEQ ID NO: 624755 - DNA, 406 bp, Homo sapiens
  misc_feature (38)..(38): n is a, c, g, or t
  misc_feature (130)..(130): n is a, c, g, or t
ataattatgggtaaccaggagttcacaaatgtgaatancatgaataaattaaatgcttggatgaggaacagaatatatacattagtttcaaaattcctctctaaaaatacttattaaaaagtggccaggnctggtggcttacacctgtaatcctagcactgtgggaggctgaggcagacagatcacttgaggtcaggagttggagaccagcctggccaacatagtgaaaccccatctctactaaaaatacaaaaattagccgggcatggtgatggatgcctgtaatcccagctacccaggaggctgaggcaggagaatcgcttgaacctgggaggcggaggttgcagtgagctgagatcacgccaatgcactccagtttggcaacagagtgagactccatcgcaaa

SEQ ID NO: 624756 - DNA, 317 bp, Homo sapiens
  misc_feature (315)..(315): n is a, c, g, or t
cttaaaatctcaagttcgctttgtggcccctctcttggggtagaaattccttcactggaatagacatgattttacatttgaggctatgaatttcatttctgaccctcatcccaattactccatcttactcatttccaggcaattattcccatggacataaatctgacctttggtgacagtcacccaggataacgcactatacactcattggtgcagtgggctggcagtgccaggatgaggagtaacatggagtgagttaaagaaagcctgccagacaccacatgccaccaactgctgtgaatggtgttcacacanct

SEQ ID NO: 624757 - DNA, 804 bp, Homo sapiens
  misc_feature (744)..(744): n is a, c, g, or t
gtgtttaacaaggagggatgttcaggacaaaccagaaagtccaagcatgtcatgaacatggtgtaagtcatgataagatttatatatatatatacacacacacacacacaccccaaaagcttttatataatcaagttgtcatattattattaagttgtggttgcttagggaagaaagagctaatttttaaaaaatcaaggttattacatccatgtatcttcctgtgtatgcttttaaagtccttgtaacattgagttacagggctttaactcctgtgtctgaaaaatcacaaacactgatgacaatcaaagcctcatcttaaggccccgtagaagatgccaatcaaaataaagtgcattcctgaggcactaggcaagaaattaaagctattcaactcctcaaggcccaggactattgcggaagaggtgggcgcgtaagattgtaagggccgattttgaaagatccagtaagttcagtttctctatgaactaatcattcaagtcaaaggcacagtgatgcaaaatcagtatatggacccctgtgtctgattagcaaggttttcttgaagcattaaccaaatccttcataaaggttataaaaggcttatggaagttatattttataactcaagattaaatcttatagtggtttacaaaattgtgaaaatcaagtgtgattggttcaggctgttaaatagggcttcttgtttagaaagttaagtcacctctctcaaagagtgaaggnttgcgcttttttggaaatccttgaatttatcactgtggattaaataaatgactttacgag

SEQ ID NO: 624758 - DNA, 333 bp, Homo sapiens
  misc_feature (284)..(284): n is a, c, g, or t
  misc_feature (331)..(331): n is a, c, g, or t
tcatcaggagagagaactggagttattctcagagcagtgagaagcactggaaagtagtttttttgtttttctgtttttgagacagagtctagctctgtcacccaggcagactggagtggtgcaatcttgggtcaatggaaacttttgcttcccaggttcaagcgattctcctgccttagcttcctgagtagctgggactacaggcacgtgccaccatgcccagctgatttttgtacttttagtagaaacggggtttcactaatgttggctggtcttgaactccntgacatcaagtgatccgcccaccttcggcctcccagaagtactgggnat

SEQ ID NO: 624759 - DNA, 122 bp, Homo sapiens
tagaggatccccgtaacccctatcggtacacttcctacgtgcacaacatatgacgcactctcccctgtaagcctctacacaacatcatttatgtcaccaatgaccatgagactaagccagga

SEQ ID NO: 624760 - DNA, 309 bp, Homo sapiens
gtatgaaatgtgtatgatagttctagggcagtgagatgagtagtaaatgtataatgagcctagggtgagtgagtgtcaattagtgcgatgagtaggggaagggagcctactaggatgtagcacataggacgtatgtgcctgcgtacaggcatactggcaggttgcctcatcgggtgatgatagccaaggtggggatcagtgtggttccgaacaacatctcaaatatgcatcagttctgtggctgtgaatgttatcattcaggcgatttgtagggagcattaatatacagaggtcagcgtttttttctgt

SEQ ID NO: 624761 - DNA, 289 bp, Homo sapiens
  misc_feature (49)..(49): n is a, c, g, or t
ggggttggggtgggctggtctgggctggcacacttggagagaagctttncctatggaggtgacatggcacggaccatgtgtgtgtgcttgggggtgtaaatttgtgtagatggttgtgtttggagggcccaagctgttcacatacaccgggtggaaggatgctgtgtgcacgtaggtggtgtttacactgggttgggttcattagaaactgtgttgcacgtgagcacacaaaaaaaattctgaaggtgtttgagacccttttcagtgtctggacctgaacaggaagtgc

SEQ ID NO: 624762 - DNA, 490 bp, Homo sapiens
  misc_feature (16)..(16): n is a, c, g, or t
  misc_feature (75)..(75): n is a, c, g, or t
  misc_feature (77)..(77): n is a, c, g, or t
  misc_feature (80)..(80): n is a, c, g, or t
  misc_feature (84)..(84): n is a, c, g, or t
  misc_feature (87)..(87): n is a, c, g, or t
  misc_feature (107)..(107): n is a, c, g, or t
  misc_feature (131)..(131): n is a, c, g, or t
  misc_feature (140)..(140): n is a, c, g, or t
  misc_feature (160)..(160): n is a, c, g, or t
  misc_feature (214)..(214): n is a, c, g, or t
  misc_feature (224)..(224): n is a, c, g, or t
  misc_feature (236)..(236): n is a, c, g, or t
  misc_feature (239)..(239): n is a, c, g, or t
  misc_feature (248)..(248): n is a, c, g, or t
  misc_feature (264)..(265): n is a, c, g, or t
  misc_feature (277)..(277): n is a, c, g, or t
  misc_feature (331)..(336): n is a, c, g, or t
  misc_feature (347)..(347): n is a, c, g, or t
  misc_feature (354)..(354): n is a, c, g, or t
  misc_feature (389)..(389): n is a, c, g, or t
  misc_feature (405)..(405): n is a, c, g, or t
  misc_feature (436)..(436): n is a, c, g, or t
  misc_feature (438)..(447): n is a, c, g, or t
  misc_feature (449)..(451): n is a, c, g, or t
  misc_feature (455)..(455): n is a, c, g, or t
  misc_feature (463)..(464): n is a, c, g, or t
  misc_feature (466)..(466): n is a, c, g, or t
  misc_feature (470)..(473): n is a, c, g, or t
  misc_feature (485)..(486): n is a, c, g, or t
  misc_feature (488)..(489): n is a, c, g, or t
aggtgagttggttaancgcactgcagtccgcggggcgctacgttgctttcacacatacctgctgctgtggcccananctngaangancctttagtcataggacggcnaaggggagaatactgtgtgaagtntggaattanagtgggtcttggtgtcacangtgagggtgccggtgaagacaggctggccccagctttgcaccatctaggctganggcctttggnccactcctaggngtnaggcctggntccattagctcctggnnctctggtctggnccactccctccttaaccaagcaggtccaaggtcaagaatggcacaagatcagcnnnnnnggggctttttntcctctncaacctggtcccctggtcagctacagtggcaaaangcaacttggtaaattnctgctttctccagtcttaagggcactggctntnnnnnnnnnntnnnttgntttggggnntntgcnnnngttttttttttnntnnt

SEQ ID NO: 624763 - DNA, 206 bp, Homo sapiens
  misc_feature (105)..(105): n is a, c, g, or t
ccctacatcttccttacaactgcaactaagcttttacccaatcagtagagcaaagctgcttttgaaaaggttactcttgggccgggcgcggtggctcacacctgntaatcccagcactttgggaggccgaggcgggtggatcacgaggtcaggagatcgagaccaacctggctaacatggtgaaaccccgcctctactaaaaatac

SEQ ID NO: 624764 - DNA, 686 bp, Homo sapiens
ggtttctcgccaccggcggcgggatgggccgcaactcaccggagcaccgccgtcggtgccctccccgtccccctccgcggcggcatggcccccaggatatggcctcgctgccgatccccgacgagctgctcgctgaaatcttcgttcgcctgcccaccccaaccgacctcgtccgcgcctccgccgcctgcgtctccttccgccgcgtcgtcgccgaccgctccttcctcaggcagttccgcaagctccacgccccgcccctcctcggcttcctcggtccgcataccggcttcgaccccgcggagcggcctcacccctccgcatctgcggccaccgccgtcgccctcgccgccgacttctccttctcgttccttccggcccccgaccccgctcaccgctgggttgtctgggacgtccgcgacggccgggtcctcctccgcggaatgcccctggaaaattctcatggagtcgttttcacagagacggtggtgtgcgaccctttgcaccggaggtacctcatgcttccctcaatccctgacgaccttgcagctagcgtggaggggctacgcccacgttcatgcgagattttccttgttcccgaaggcggcgatgagtcaacaactgctgaagagacgtcattcagagtgatctgggtggggcactatgaagataagctcatcaccgta

SEQ ID NO: 624765 - DNA, 332 bp, Homo sapiens
gtgctttcgtaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattagtcatttaaagatcattttgaaatctttgacctttatattttaatgaataaaatattagtagttattagtataaaataatttatgtcttttggacttagcatccagtatttcttttttaataaagaaaataattattctcttgc

SEQ ID NO: 624766 - DNA, 446 bp, Homo sapiens
  misc_feature (4)..(4): n is a, c, g, or t
  misc_feature (64)..(64): n is a, c, g, or t
  misc_feature (129)..(129): n is a, c, g, or t
  misc_feature (149)..(149): n is a, c, g, or t
  misc_feature (171)..(171): n is a, c, g, or t
  misc_feature (179)..(179): n is a, c, g, or t
  misc_feature (193)..(193): n is a, c, g, or t
  misc_feature (200)..(200): n is a, c, g, or t
  misc_feature (212)..(212): n is a, c, g, or t
  misc_feature (217)..(219): n is a, c, g, or t
  misc_feature (224)..(224): n is a, c, g, or t
  misc_feature (229)..(229): n is a, c, g, or t
  misc_feature (237)..(239): n is a, c, g, or t
  misc_feature (246)..(247): n is a, c, g, or t
  misc_feature (250)..(250): n is a, c, g, or t
  misc_feature (262)..(262): n is a, c, g, or t
  misc_feature (265)..(265): n is a, c, g, or t
  misc_feature (268)..(268): n is a, c, g, or t
  misc_feature (273)..(273): n is a, c, g, or t
  misc_feature (275)..(275): n is a, c, g, or t
  misc_feature (278)..(278): n is a, c, g, or t
  misc_feature (283)..(283): n is a, c, g, or t
  misc_feature (287)..(288): n is a, c, g, or t
  misc_feature (290)..(290): n is a, c, g, or t
  misc_feature (299)..(299): n is a, c, g, or t
  misc_feature (303)..(303): n is a, c, g, or t
  misc_feature (322)..(322): n is a, c, g, or t
  misc_feature (326)..(326): n is a, c, g, or t
  misc_feature (328)..(328): n is a, c, g, or t
  misc_feature (331)..(332): n is a, c, g, or t
  misc_feature (335)..(335): n is a, c, g, or t
  misc_feature (337)..(341): n is a, c, g, or t
  misc_feature (346)..(346): n is a, c, g, or t
  misc_feature (348)..(348): n is a, c, g, or t
  misc_feature (356)..(356): n is a, c, g, or t
  misc_feature (358)..(358): n is a, c, g, or t
  misc_feature (366)..(366): n is a, c, g, or t
  misc_feature (371)..(371): n is a, c, g, or t
  misc_feature (373)..(373): n is a, c, g, or t
  misc_feature (383)..(383): n is a, c, g, or t
  misc_feature (414)..(414): n is a, c, g, or t
tttntagtatgtcactgatcacttctactagtatagacaaataaatttataaacattattttgnatgtaactaattagcataattttatttaagagttagactgtgttgtcaatactgacatttttggnaatatatagtatagtttaanaataaagcttctgaaccaaaanaaaaaaantgaaccctattccnaccttanaagcaagcaggngaccnnnggcgngccancccattcnnncccgggnngcncgtccctgcggnggnggngtccngnccngtccncccnncntcgcgggcntccnctgccggtcggctgggtcngtgngnggnnggntnnnnnggggngntgtggggngntttggggnggggntngcgggggggnggggggggggggcggtcgggggggtggtggngcgtgtgggcgggggggttgggggtgtggggg

SEQ ID NO: 624767 - DNA, 289 bp, Homo sapiens
cgtcgacgtaaaatgaaggtgtgtgtgtgagagtgtctgtgtgttatgtgtggatgtgttgtgctgtgctttctgtgctgtgctgtgccgtctgtgctgtgctgtgctgtctgtgctgtgctgtgctgtctgtgctgtctgtgctttgctgtctgtgttgtgctgtgctgtctgtgctgtgctgtgctgtctgtgctgtctgtgctgacgagcgttctccggcgtgtgagcgggtaagtgtgtggcaatgtgtacccactgtcgcgcgggctcgagttgaggtcgacgc

SEQ ID NO: 624768 - DNA, 569 bp, Homo sapiens
  misc_feature (281)..(281): n is a, c, g, or t
tcgcgaaacgtattatccgatacaggttttgttttattttttcctgagatggagtttcgctcttgttgccagtgtgagtgcaatgacacgatctgggctcacctgaacctctgcctcccagattcaaacgactctcctgcctcagcctcctgagtagctgggattacaggcatgcgcaaccatgcctggctggtttttggtatttaagtggagatgggttttcgcagttttgtgcagggtggtctcgatctcctgacctcgggtgatccgcccacctcggnctcccaaggtgctgggattgcaggcgtgagccaccgtgcctggcctctattctattttttaaacaattccaaagtcctgcataggttcaaggggagggaaatgggttaccatctcttaagggaacacagcatggttctgcagaagcttatgggtctggaaatatggcggtggctgttactgggaaatatagcgggttaataatagtctctttctctgaatgcagtggttgggacctagaatatgagctttgttatcttttacagatatggctaaattgtctctgaaat

SEQ ID NO: 624769 - DNA, 546 bp, Homo sapiens
caccgggggagcgccccatatgcatgcaacaaatgtggaaaggccttcacccagagctcacacttatttgggcgccagagaacccccaatagggcaaagcgaaagaagaaacagcctccctcatagctctcaagccagttgaagaaaccttgccttttcagcttgaccctgcaatataacatgcacaggcctgcttgtgaatcagggctgaatgtgaaagggaagtattgagtgaggccattccccaaaccaaagggcaactgaggaggctgccccgcccataatgaataaataaaaaaatgagtggggggtttttaccctcctttggaaaaaaaatttccccttcccctgaaattgtttgttcccccccttagtcccttaaaagtgggattaataaaatctgaaaatgttatataatacctttaaaaagcccggtaattaataatttgccctgatattacatccccagtccccccgtatttatgtgtatgaattaaggattaaaaaataatgtggataaataaactattgatctatgtctgtgta

SEQ ID NO: 624770 - DNA, 275 bp, Homo sapiens
tattgggtcgcggtcgaggcgttcgacgagagcggagtctcgcggcgcacgcggccggtacggatccgctaatatgctcctccctggaagagaggggagtcattgggctagcccagccagcccccggtgaacccggccagcttcagccctttgcggatcggcgcgcagccctgcatgcgcttccagacgaagtcgttccgataattcgccgcctggagcaggatcgagccctggtcgatgccgatatggtcggtgtcgtaccagcccttggccgg

SEQ ID NO: 624771 - DNA, 161 bp, Homo sapiens
  misc_feature (3)..(3): n is a, c, g, or t
  misc_feature (34)..(34): n is a, c, g, or t
cgngatcccccacagaaagggcatacagtcttantttaatgcaattacgaatagattgcaccataataaaacatttatcagtttttttatgccaaaaccattccttttgaattagaacagcacaaaatattctaataattgctgctggaaagcattttgct

SEQ ID NO: 624772 - DNA, 385 bp, Homo sapiens
tacgtcgcggaatattttcactatgacaaccccagtcaaatgaacccaccttcaatcaggggtgtaaactgactaagaggtgtttgtgacacaacgtcctttctcctaaggactaagatactaaggtttaaaaacagtaaaggggctgggcgcggtgtctcacgcctataatcccagcactttgggaggtcgaggcgggcggatcacctgaggtccagagtttgagaccagcctgaccaacaaggtgaaacgccatctctattaaaaatacaaaattagctgggcgtggtggcgcatgcctgcaatcccagatactcgggaggctgaggcaggagaatcgctagaacccgtgaggcatagggtgcagagagctgagattgcacca

SEQ ID NO: 624773 - DNA, 201 bp, Homo sapiens
cattcgagctcggcacccatcttccctctctcacggttcataaataaaataactataaagataaaaagctacatacttccctcacaattggcccacaaggaaattccctgtgggccccaaagatctttaccctaaaacagttctgttgaatttctccctagcaattgtacatttatagcttatctttttttttggcggggg

SEQ ID NO: 624774 - DNA, 700 bp, Homo sapiens
  misc_feature (5)..(5): n is a, c, g, or t
  misc_feature (24)..(24): n is a, c, g, or t
  misc_feature (69)..(69): n is a, c, g, or t
  misc_feature (114)..(114): n is a, c, g, or t
  misc_feature (592)..(592): n is a, c, g, or t
  misc_feature (596)..(596): n is a, c, g, or t
tcccnactttggccctactaaccngaggctgaaaagaaatggctcactgaagcattttagattttgaanctttccagatttggggatggctaaacccagtacgtgatgtgacanaatatttcagaatcaaaaaatgtcagaaatccaaaacactttttgtcctaagtcttatgcataagaaatactcaatctgtgtgaactataggcatcaagctctacagcagatctctagaacctccccaccttgcataactgaaactgcacacccatgaacaacttctgattctccccactcccagctcctgggcaaccagcagtctcttctcatattcactctggaatccacttacatgaggtccctagagtagtcgaacccatggaatcattgagtagaatgtccaatgaaagaaaatatttgcaaaacttctctccaaatttgtctcatatccatcaaacacatatggtccatgaggaccagatttccagcagttcattcccaccctttccaccagtcagtgctgcatttgcaaatgtccacatgtatttctggaagatccacatggtcctcacctgccctctgcagaaggagagnaaancttaaagaacccacgacagggaacatgcttctgctccaagccaccagctcttgcctgtcaccttcactcgtttctagatcattccctgcactctgctctatctt

SEQ ID NO: 624775 - DNA, 1060 bp, Homo sapiens
gcggcggcgagcgtggatggagaacgtacctgcccgagctgatggcggagagtgactccctgtgacccctccttcatcagtcactggccctgcggcctggtgataccaagaaataggaatagtttcaaagaaggagaagggacaggatgaagaaatacgtacatcgatgtggtgattaataagaacatgaagctgggacgatgagaaagctgttgactttcccggtaaaacagttgccctaagatgtcaacttgtggtggtggatataccttttggagtccaacgtggccatatactctgaaagcctgatttacatagaagaaaccattgtactaggaaatgtccatactctgtgtggcagatggttccatgaggagacaaggcccaagggaagacagcagttgcaggagaataagtggatgaagcgaatgtgacttaccatctcaaatgactgatctccaatgtacgtcatttgaagtgtttgccccaccatgctgaagcttaatgccaggactcgcgacgaatgcgtcttgggagaggaaacttcataagagagtaccatcaatcgcctagattataattgactgagatctaggtgcaagctgcagctccacggagtttaacatatcctgaatgcgtggtccaggaaaatatgcatatgttccatgtgcttcgagtgaaaggccaccgttgcgtacatgaggtgtaccagccccagtcaatataccatggaagggagaggaagtgacatgcccggccagtggagttgtagtctctaggaaactcccactcccagaggtagtctgtccaccgagggccagtgagtcggggaaccaggacttctcactccagagcagatggtcccccaacttggtcggggctccacgggcccgaacagaacttgggaaactgccttgtgatggatgcgcgcttttgaccaggttttctttataaggttgcccacccaggggggttcttaatcgacgaccaggggctatttcacggcaagggatccaacgcctcgagagggctacaccactgtgtggtgtaacaccattgt

SEQ ID NO: 624776 - DNA, 844 bp, Homo sapiens
gtgaatcccccggcctgaaggatttcgcgccgaagaagcggggggacaaaaatctttttgatttatcatgggatcactaacactggtagcagtaaaattacttttttgttgaccgctgtgttatacataccttcattatgataggatgttttgtcgaacttctttccacgcctctgggggtcatagattagtctttttaagatgcttgatacagcttagagatatcatatatagggagaagactcacgtgtttttataaaatgagagcacctttagaaaattaattatattagttcacaataccaccttgagcatatctctttttttattattgcagacacaaatttgtagaatgtactatattatggtttatttatcagatgggtctacttgttattgctacacatattttattattttttccataggggacatttttctcaatcataacacagatattaattcattaattttgataggtgtgtttatttcttagagtttcacctagttgcacctttcttgtatttagatagctcttttgaggctgatattattctttatgatctgcttatttagcctttagtatagattatatagaaccactatctctctatatggatgaagtgtctaacaatatcatttattattatttgtcaacaaagctagagctactcaacccatatagcaataaatgtggatggtggttatatttttttccgaatattatttatctatctctaccactttattactttgattggacacctctgtgataatttttgtgtgggtcatcgttcaatataacatttattttctccccgcatagttatcttagcttcttttg

SEQ ID NO: 624777 - DNA, 247 bp, Homo sapiens
cattttattttggaaataaaagtatatgttgcaggtaagtctttaggtggtttatcaccagccggcgggactattacaagcagattaattctaaattatactcctactaattctctgcatatagttactaaacaatacgcagaaaatgttttacgtactaaggttactaaagctactaactatataagtggcactttaccacaggagagactcccagcttttggcggagacgtcacttctagcacag

SEQ ID NO: 624778 - DNA, 839 bp, Homo sapiens
taagcaaggaagcgacgggagcttctgaaggaacgtctgaagagagtatcacatgagcgcccctgctgccaccagaggacgcgttcggaagggaagcagcagggaatggaaaatactgaggactcaggctagcacaactaagccgacacaggaacctcagtcctacctacactggaaggagcgcatctcacggtgggaagagtatctgccgtgacagaacgcggggtctgcatgtttgtggatccagcggagagtggcgagactttcttctccgtgtccctctcacctaatgtcaacttgtcattgaagtgtaaagaattgaaaccttgctgacgacaagaacttgagccactatggatgtttactcctcgcacttaagtaggtttgagtcgtgtcccgcatttccgctcccactttactcaccttagtggtgaaaggagaggtagtagcatcttttctacaacgttaaaattgcagaagtagcttatcatgtaaaaaacaacaacaacaacaataacaataaatcgctaagtgtaaatcagttattcgtacccccgtaccaaggatatcagcctgtttttctcccgtttttcgttcctgggaataatcgtgggcttcattcccaaatttctgacagcctctttcctcttctcatgcattgagcttccctgttacgcacgcatgcgtgtgcaggactggctgtgtgcgttggactcggcatccacgtggaagcatgatgttcccattagttactgttggagaaactcaaaccttcaagccctaggtgtagccattttgtcaagtcatcaactgtatttacgtactggcataacagcgaa

SEQ ID NO: 624779 - DNA, 396 bp, Homo sapiens
  misc_feature (44)..(44): n is a, c, g, or t
  misc_feature (48)..(48): n is a, c, g, or t
  misc_feature (98)..(98): n is a, c, g, or t
gtgactctagaggaccctacgtaatatgtaacgatagataagcnctgnaataaaaataatgttttatttccttaagtctttttgttcttttatatatnatttatttaatttttgagatagcatctcactctgctgcccaggctggagtgcagcggtgccatctaggctcactgcaacctctgcctccccggtccaatcaattctcctgcctcagtctcccgagtagccaagactacaggcatgagccaccttgcccggctaatctttgcatttttagtagtaggggtttctccatgctggtcaggctggtcccaaactcctgacctcaggtgatccgcctgtctcggcctcccaaagtgctgggattacaggcgtgagctgccgtgcctggccttg

SEQ ID NO: 624780 - DNA, 203 bp, Homo sapiens
actggcctctgtatctcatggaggaattttaattctgaccagtaatcatctctcctgtcagaggaactacaagaaacaagcaatttggtctgacattgtgcttaatggaatagtggaggatattaccatatccagctggctggatcacgtagctgatactttcaggaagttgcgctgtgagccaggagggcagataaggggca

SEQ ID NO: 624781 - DNA, 1014 bp, Homo sapiens
  misc_feature (251)..(251): n is a, c, g, or t
tcattaatccattgatggatcaatgggttaatgggattcatcatagtgaggggaacgtgtgtctttaatattaggaggatgagactacctcgggccttaactatgtcgtccgatttcctcatcatgtgatgtcctgttgactacactatgtagaacatctactagcatgtttcccgagcgagtcatgataggtccttgagtccaggtatggtcaccatctgtacctttggtacttacgtcagagcctccgntagatctaaagacccatgatgaggaccacgatagagtcgcgggcacgaccatgctattcttcggattcctatctttcatttcgctatccaatgtcttggatctccctacaagacgagttggacttccattaaaatacacgtcaatatcgtccaagatagcgcgttggacctagtccctatgcttggcaaagtcgactgaacggcataaccttcgaacgattattcgggaaggtagtctagcccgatttggaacctagagagagggtctactagtgatttttcgcaagacacatccgttaatttggacagcacacactgatgggcaggacgggctagctttttgaattattgggcaagttgtcagttaatttggcacttgacttggtacaaccccagattggaagctcattaccccaagctccccaaggcaacaaccacgataagaagacactctaattccgaacaaattaacttaaacagaaggtggttaccacggttcttaaggacacccatttctggcaaaccccagactttccagagcacccaggagggccctccgttagggcaaggggtcccttcggggctttctcaagactggggctttccttgcgaagaacatctccataatgcttgaattgcctcttccaattgatgctggtccaaattttcaaaaactgccaattaggaacaccatgcagtcatcactctggtaacttctacccaggttgattgcttcccaaggcacccagaaccataagtgaac

SEQ ID NO: 624782 - DNA, 533 bp, Homo sapiens
gatcccctgcctgctgtcgctactgcctcagctgttaccttcgtctactgatgcaagttctgcaggacctcctgatcatattgattcctgagttactggggttcaaaggtttcgagatactctaaaaataccctacaagctgtaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgagatcctaatgtcacagaacagcacttcttaacccagctccaggagctcggaatattatctttaactcctgcccggatggtctttggagaaagaattgcttctcatgatgacaggttgctactacacttagcggacaaaactggtggcataattgtgacaaatgataatttcagagaatttgtgaatgagtcagtctcttggagag

SEQ ID NO: 624783 - DNA, 316 bp, Homo sapiens
agtgaaactctacctccaaaaaaaagaaaagaaaaataactgaggaagacagttttcacagtgggtcaggtgagccctagaattattgaatatcgtcctttaacctatagctatgactctaggttaaagctcctcctcagcttgctccagtcaagagtatctatgtatttgagccatttcctgaaaccagactctagtgtttctgatcaggaccagctcagtctttaagtttctgaagtttgtttgctattttataattatattcgtgaatactgtgcattgaagaaataataaatctattgttgctttaaaaaaa

SEQ ID NO: 624784 - DNA, 259 bp, Homo sapiens
cccgccacctcatacggacggcactagagactaaagtcagtgtcagaatgtaatggtagctggacaaagaacagcaaggacctaaaaaaaaaaaaaaatcaaaacagtatccgggggatagaacgatcaccgcagcaatgagaccagtggagacggagcagaaggcctgcaaggaaagaggcaagaggcaaacaattaatatttcctgggaaaatcagcactgaaatggtccatgaatttcttggcgtacttggggtct

SEQ ID NO: 624785 - DNA, 128 bp, Homo sapiens
  misc_feature (46)..(46): n is a, c, g, or t
ggtcgacggggtgatctaaaacactcatttacagccgggtcttttnctaaattggactttgggttaatcgtgtgaccgcggtggctggcacggaaattggaccaacgcctggggggtagtagtatagc

SEQ ID NO: 624786 - DNA, 106 bp, Homo sapiens
gacatatggaactccaaggaactgttccacttgcttccatgaggtacccacctgtatggcctgggacctgcccagaagcctggccatgggtggaacatgggcacag

SEQ ID NO: 624787 - DNA, 262 bp, Homo sapiens
ggccccgccctccccgcgtttgcgccaggcctggggtccccgggagagcaagactttccctcgggcatagggacgtggggtgcaagccccaacctcagtggcagcagcttgggccctggtccagtcccactcgggggtgggggtggcggcggcccaacccgtcactcgggggggaatgcggaggggcgctccttcccttttatttaattgccgtgtaccaaattttgtttttatatagaataaacttttttttgaccgcgga

SEQ ID NO: 624788 - DNA, 509 bp, Homo sapiens
tagcagttacgtgcgttgttgtttacaccaaataagtaaattagctgggcacggtgatggatgtttgtaacccagctattcagaaggctgaggcgggaggactgcttgaacccaggaggtggaggttgcagtgagccaagatcgtgccactgcattccagcctgggccacagattgagactcagtctcaaaaaaacaaacaaacaaaaaacgtagctgaagcatcatctcctctgagaattcttcccaggcttccccagactgagttaggtgtccctctctattagtatcctgataggaaacaagtaacactcttaattaggtcaaagagtgtaatgaagcaggtatttacaatggtatgggaagggttacgggaatccagcaaggaatagtgcagcacctagggactagcaatgataggaagttgcaccatatttggcccagcaagggcaaagggagagagtagtagtgggagtccagagagacactggttgttgcttctcatttata

SEQ ID NO: 624789 - DNA, 662 bp, Homo sapiens
  misc_feature (193)..(193): n is a, c, g, or t
ggccgcctagcacttccgatggacaggaaatgtctgaccccaagtgcatttgtgctattcctgatcacagagattggaaggagctcaaactggtgctgacccatggtgggtgtaggttggtttctcttgttgccttggtttttgagcctttttctgttttccaactttgggcttcccgtctccagtgtaaaanaaagcagtaacccacaaggcagaaaccatattattttatgctcctcttgtcttggagagcgggcaacactttatggtgcagtaatctttttggctgtcccttgtctggaattaatgttcaccctcacgcagcagtctgccacttgggtggctggcattttgggttgggcagtctgggtttgtgcctggccaagccagctgaggggaagttcgctgccacgtttggttgtggacacattctgtgtaaggtgcttaccccttgctcagtagaggcatcccctgcaaatatggcgaggtggctttctttgcccttttgggttcctattgagcataaacttagcagtgaggaggcaggaccttgatggtccatatcccccgaggagcttagctgactttttacccagttggtgctgaagatggacaaattgataaccccctggaatctctggttagaccccagttgtgtcata

SEQ ID NO: 624790 - DNA, 484 bp, Homo sapiens
atcctgggtgacgccagtatctcctcagacactggcaggcgccctgaaaagagtaggatgtgaccctgcagtagctcgaggagtcgttcctccagaataaggccttccttactggtcctcacatctcattagctgacctcgtagccatcacggagctgctgcatcccgtgggtgcgtggctgccaaggtcttcgagaggccgaccaagctggccacatggcggcagcgcgtgcaggtggccagttgggtggaggacctcttccaggaaggcccaatgaggtcatactgccggccaaggacttcccacctgcagaatcccaccataaagcaaaagctgatgccctgggtgctggccatgatccggttgagctgggaaacctcacccttgcaccgtcctcagcagtccacaagcattttcatttctactggcccatggacgccagtgcccagcaaagcaggaatggcttgcctaagacttgcccaa

SEQ ID NO: 624791 - DNA, 838 bp, Homo sapiens
aagcagggtatcaacgcagagtggcattacggccggctgcccctcatttacataaatattatactagcatttaccatctcacttctaggaatactagtatatcgctcacacctcatatgctccctactatgcctagaaggaataatactatcgcgtgttcattatagctagctctcataagccctcatgcagccacgtccctcttagccaatattgtgcctatggccatactagtcttgtgccgcctgcgaagcacgcggtgggcctagccctagtagtctcaatctccaagcacatatggcctagactacgtagcataagctagagcctatcgtccaatgctaagaactaagtcgtcccagacagattatatgtactaccgagtggaccaatgactttccaaaagaacatcgataatgtggaagtcaagagaagcacccaaagcctaatgtatatagcatcatccctctactatttgttaacacgtatctaacaagcgtaaaaattaacaatgacagtttgagcataaaaaagccaaccgattctcccgaaaatcaatcggccgtttaccagctactcgctagcctattcgtcccccttgtaaatactacttaagtcttacacacgacatagagggacggcgaacaaacaactttttgggagcaggccctaaaaaaggttgagaacacatggtgggggggcgacgccaacgaggagcaccaggcagagctggccaagagagaccggccgcaagcgggcggtcacccgaaaaagccgggggccgcgtttacacaaccatggtcggggctgggttcaagcggcacggtcaatcccgggg

SEQ ID NO: 624792 - DNA, 315 bp, Homo sapiens
  misc_feature (70)..(70): n is a, c, g, or t
cccccccaaggggccgggtgttgggttccccccctcggggggggggggttccttttttcggccccccccnccaggggaaacccccgggggtgggtttttttttcccgggttttttttccaaaaaaaaggggttcccccccccccccggtttttggaaagggaaagggggggttttttttttttggggggggggaattcccccccttggggggggcccccttttttttttcccccccccccctcccgggggtttggggggttttccccttttggggaaagggcccaaaaaaaacccccggggggggggttttttta

SEQ ID NO: 624793 - DNA, 1043 bp, Homo sapiens
ggtctccggtccgggcctccaagatgacaaagaaaagaaggaacaaatggtcgtgccacaaagggccgtgggcacgtgcagtcctatacgctgcatgtaactgtgcccgatgacgtgcccaatggacaaggccgttaagaaacttctgtcattcgaaacatagtggaggccgcaagagagtcaaggggactatttctgaagcgagcgtctttcgaatgcctatggtgcgatcccaagactgtatgtgaaagactacattacttgtggtgagtctgtgcacattcacagcacaaaggtagctcagcgaatcggaatctcgatgaaaggcccgcaattggaaccgaaacatctcccaccccggatttttatgagcctgcggtctgcatcggacccaaacggtcccacacaaccaaaaacgcgccggtgtaaatcgcagcgagagatcccataacaaggaacgtgacagaccaggggcgtaatgtcctcctgaacgaacacaaacgtaccccctgcacggatgttgaaacccaccatcaagcatccacagcacaacggccacgagaagaaacacgagttagggacaaccaccgacccacagcaacactgcaagtacaaacacccaacagcgaagtgtgaacgagaggagcacacacagtgctaacggacacacccagtacgaacaggtcgaagtacacagcgaaacaactccctgaccgcagcacacaggatgatagtcagcactcaccaacacataaaaaaacgcagcggcgacaaacaacggataacgtgccaagaagcacaccaagaatggagagcactgcaacaagcaatcaaggatactaatacacggcgagaccaaggaacacacgaaatgaaaataaccccacagccgggcgacaacaacacagaccggcactaacagatcacaacaacgcaggcagacacacacagagaccgagatgccataacgaccaacacactcctacaaccacacaaacacacaagcgacggcacgaaggcaacaccacgtaccgagctaccaa

SEQ ID NO: 624794 - DNA, 928 bp, Homo sapiens
  misc_feature (928)..(928): n is a, c, g, or t
gatacaagcagatacagaatagagtcacaaacacacgatgagcaaataatgcacatatggtgtcaaatcgaaccttctcatggattcgtggcgtgggccaactaatggtgtttacattatataattcctgctgtggcgagtaaagcacacgtttttgtttctcctaaaaggtttccccctgtgtatcctattatggatacgggttggtcaatacatgatccgtttaaattttctctccttttttcaggatatagcagtatatgctattactgaaatgaattgccttggctgaaatgtaactcatttgaatgcttgaatgatgagcattttagtactgttacacagggcttatgagtcaatcaactgtgatgaagacttgaggacaacatattgcttagagttggccctattgaatctgtgcctaaagtgatttttgcagtaaactggtatccgtgtggggtccaccatacttaataccagcaggtaaatccaggaacttgttttcatatctatgagttctagacaactcttttggaagtgacccagcaaactttgatgtcatgccataaagaattccgattgaaatgcagcgagaggttgacagagcattccagtgagcacgacattacaaacttaatttattgggacctatttttgttggcagaccttctaccagttgcttccaaatgccttgtttaaactgatccacggagatcgcggaaactgcttgagtatgacaccatggcttcttggactgctgtacaacattaccggttgtacacgaacactccaattggtggactcaatgtaccacggctgttcagtccgctgaaggacactgcccgaatgtgtggggacgtttacaaagttccttaaccacacacagaattgtggcccgcgaatatcattcgcgcgccaaattactctn

SEQ ID NO: 624795 - DNA, 209 bp, Homo sapiens
agccaggactggtctgctgacctcgtgatggtgtaagccagatgatctcctgacctcgttgatctgcccaccttgtgcctcccaaagtgctgggattacgggtgtgagccaccaggcccggccctaaatgatgccaattttaattttaaatcctgaataatcttatattccttctttcttttttggagactgaatcgtgcttggtcgcc

SEQ ID NO: 624796 - DNA, 448 bp, Homo sapiens
cctctcgctatgaagaaaatatactcagtgatgtgctagagattgtctgggagactactttagattccatgccaagggaaggctctctggcagggggtctacaaaggtaagccacccttccccatcccatcctggtctgacaaggaggggttgagaaaaacaagcagaacttctctgtgtaatatgcaaaaagcatttttcaatgcttgtggggatgggaaataatcttagggagattcttttcctgtgaactgatttctttttcttagaatgaatcactatagttcaaaattccagaaaaattataatcttacgagatcttataagaacccatctccagctcttcttaaattttgaattttccttcagacattgtttctgttgtgtaatgcttctatcttatttccttttttgccttctcctctgatatcccattagaaatagagtc

SEQ ID NO: 624797 - DNA, 293 bp, Homo sapiens
tacaggatttatctactacgaaaaggcaacatgtatttcctctccccattatacaggccctgtggggctcctgaggttcagtagctagggatgtatccctactattccttcaagtgcctgttgcatattgaaaggaaggagaaataccacagcagattcctttgatcgaggtttaagttggagatggagcttcccttatgagccatatacaactacagacttctaaaaactgtgccctcagccactatcgaatgccagccatcttctggttctaaaacggggagtggtctaga

SEQ ID NO: 624798 - DNA, 121 bp, Homo sapiens
tctctagcaggatccccttcatttaggcaatttcactatgttcattaaaagtattctagcgatttagtccagcattatgtataaaccatcatcacagcttgctataaatcaatagcgaggt

SEQ ID NO: 624799 - DNA, 241 bp, Homo sapiens
agtgaacggtgtgagaccatcagataggcaaagaccccgtacgtttactgatgaaagtgttctctcgttctcataagagagagagaggtgcatatagaaaatatgcaataaattgaagcgagtgtacaaagtattgtagaaggaatattgtactcagtctttatgattagattaagtggccgtcggtaaaaaagattagtggagagagaaggttaatggttgatattgctagggagccact

SEQ ID NO: 624800 - DNA, 246 bp, Homo sapiens
aatagaacaccctgaaagggcccgagtgtcaacagtccctttggagcagctcatccatctctcaagtgggggtcctccggcagccagcttcctctgtggtcgccaggtgggtccagagtgggcccagctcctttagaagtcaggcaggccatgcagagggaagaaagaggcgaagctctcaagctcctcccggagagcctgcacggcctgcctggtacttatcccctgccagtctctccttgaact

SEQ ID NO: 624801 - DNA, 250 bp, Homo sapiens
aacagatctgactcacatgcagttcctcagcgcaacaagcgaaacgatacccattaggtctgactgcctgcggggtcgggctgactatagccctattcgtcttcttgacataacacctataaattgatgtgcaacgtccgatatgatatcactgaattcttttcccagcacggcaatattattatttttcacatctctttcctgcaggcattcctgggggatagatactatagaatagccgctctgagag

SEQ ID NO: 624802 - DNA, 1533 bp, Homo sapiens
agcggctgctcccggctccctcgggcttaggccatggtgagctatcggcggatgcctggggacggtaggacgagcgaggcgtcgagccggacggatgtctgaaatgtcgggtgacggagagcaccattggaccgtgtctcctggttgagtattctcaagaaactgaagaattagtgcgactcagatactggaagaatctgctcctagtgtagtccggtgcggtctattgtgagactagggactgtctatacccagtacagctcctagtctatcgagtgatcaaggcagcttcagtcaaggacatacactgacaggttcacatgatgcgaggctggccgtgacacaactacttgatccacacgcctgaaccatctcgctacacacggaacaccttctgatatgtagcactaactgtgtgcaagcacgtacatgcacgaaccggacgcgggtgtccgatgagacctcgacatatgatagcattgcacagacactggctgcacccatggtggacaacgtgtaagcttggctcactgctcaaaggccaagctgggttcaggaagccaccagagtgtgtactagcaattctgctaagatacaagaggcactatcggaggttccagcacaacacaacctaggctctaattcaataagacacctaccacgtgggcacaatcacgcctgggccgttatgacaacgacaaccaggataccgtcagtaccactgaaatgctggtactacctaattccagccagtccttctactaccgaacactattctgtctatagatctaaagcctttgctccaagtgctcttttgagcggtgccacattgggcccttactggggttatcgaaataacgtgctcccacctcggatattgtgtcaccatatctacgtttttgaccttatggccctccccataggaatttacggtcgttgatcgaacacgttgacttcatacgtaacagggtccaccgcatccgtggcgaccctctaattctaggaaacgtggctggcgaggcaatttactggtcgatggttggctccacatgggtatacgacgatggtaattaacagttggtgaagaggcgcgaacctcataagttatgggtatacacttagggtggttacggagtaccggagtccatacatagagtcgcttggatgctgaacacacgagtttcaccgagttttacactaaacaccccgtagtcgaacgaggccctaccctcgcagagcattcacgctcatgtcagatagtgccccacgttcacctgcatcacgatgggcctagcaggaacatcacctagcgaacactcggggcacggctcccgacgcgacatgggcaaccgcgccgcgaacccaagggccagcagggcacagcaccggacacaaagatattcgcgtcacaacgcagaggacccacgcataccaacacacaacgaaccaacaccgccaacacacacacgaaacacacgacgacagacacaaccaacacaacaatcagcagacaagcgaaacagcacccaacaa

SEQ ID NO: 624803 - DNA, 786 bp, Homo sapiens
ggtactattatacatggtcgaaaccactaacgcgtgttcttcgacatagccgacgacggcgacccccgttgggccgcgtctccttctgatggctgtattagcaagacgaaggtcgccagagaccacggccgaaacattttcggtgctcctgagcactgcgaggagaaatggagttctgcgctatagtttatggcttcctgctattgctctgtcaagttaatctccagggctctatagtgtggtcaccggtgtgggtgcacgtatcatgcgtccagtaatggccacatgagtgggcttgagttccaatgcctaattgggggcacgcacaattgtggacacgcactcgacgcatagcatatcgacttcactcatcagggcatttgccgcgaggttcactcgcgcctgtacatgtggtgcgcagttgagcaaaaaagtggtcctagggaagctcgcgaagacaaacgagagaccatggttagcccacgagttcttttgaacaattccctgccaaccgttgtcaccaaaacgttagcaattggagagttggcctatggcgaacctcggagccaaacgacccaattgggtgggggtgctcgcatagggtccacaagagcccatgggaggagcccgcacaaagggccaagtgacaggcttacttgagcctagcagaacgcgaccaccatacacgaggcagagacccgcctggtgacatgagagggatgccgcaaaccagtaccccttggcagcccaacaaagaaagaccacccggccggacaggaacaaggc

SEQ ID NO: 624804 - DNA, 197 bp, Homo sapiens
gtacatactttgtctgatgacagacaggctttattagtcaaattagccagcagtttttcagtttatatcccttatagtcctctgtcttcaagaaaagtagaacggactaaaggtcttttaaaaacacacctcaccaagctcagccaccaacttaaaaagaactggacaatacttttaccactttcccttctcagaag

SEQ ID NO: 624805 - DNA, 582 bp, Homo sapiens
cttgcggcacacacttttcaaagaagacatacaggcaccaataagcatattcctcaaaaagtacaatatcactgatcattagagaaatgcaaatcataaccacaatgagatactatctcataccagtcagaatggctattatcaaaaagccaaaaaaataacagatgctggcaagatcgcggagaaaaggaacatttatacactgctggctgggagtataaattagttcaaccattgcggaaagcagtatggcaattcctcaaagagctaaaagcagaactaccatcacttcaacaatcctattactgggtatataccccgcagggaaataaatcattctaccataagacacatgcatgtgagtgttcattacagcactattcacaacagcaaagacatggaatcaacctaaatgttcatcagtgacagactggcataagaaaatgtggtacatatataccacggaatactatgcagccataaaaaaagagatcatgtcttttgcaggaacatggatagacctggaggctattatctttagcaaactaacgcaggaacagaaaatcaaattctcacttatga

SEQ ID NO: 624806 - DNA, 166 bp, Homo sapiens
atcttcacggtcactatttatactaaaagagtatacacgctcatcactcgatggagatccttcgaaatagtctcagcatatctacaaactgccagtatcaggcggcggcttcaaatccaaagtgatgtttggatgtccagtgaaactattaattggccttatcgag

SEQ ID NO: 624807 - DNA, 1727 bp, Homo sapiens
  misc_feature (1325)..(1325): n is a, c, g, or t
gccggcggcgggagcgcgcttcgtaagacaccgaggacgaggaatctggtgcttcgggctccgaacagtcggcggcttccccgtttgcggggaggcgggagcttgctggcgggtagcgccggtaggcgtgtggctatgctggcatctcgtgcccttctacgagctggcgggaggccgcaagcggggcccgtttcagtcatgacgagcgtggctgtgatgtacgcgcgcgcggcgcccacagtagatgccttgtagggagatcggagtagttgctgaagcagtgtacatgatgtgcctattgaaagggtgaatggcttgggctcctcggtgagttagtgcacacatgtgccaagcataggtacctcgggcaatgcgtggagatgagacgtgtgcaacataacccgttgcaaagcatggcacaaagaacattgcgcgaccaaggtagcgccacgacttgcacatattgcgaaaagaaaccttttcactgggactggacgttgtcttaaagtattcgtttgccaaatccatacaaatgtgagcggcaagcacctgtgccgacagcaaggtgacaatcaccgcgcctcagtagggatcgccgacactagaggtcggacctaagtttgggagcctccgaggaacgaattggatgggcccaaagaactccgagggggcaactgggccacccaaggcggattggaaggcagctcaagaaacgactcctagattcgagcatgacaccaacgcctagctggtgcgctttgacccatacagccggcgccccgcggttacaagggcgatttttgctgggccactgggactttggacttcggttaacctactttggacgctttcgccacactgcgccgccggcggctaactaaatttgcgcgcggccgtatttggcagcgggagcgctggcctctcacaacttcttggggcatccgcgcgattggaattcactttgtggcccgtacccgccgaataaagtagacttagactaccgggagggcggaggcaagatgaaggcaccaaatgtatagtccccccccaatgtggagtgccttgtactcttgctgctgcacacacgccccctagctgtggacatatgagacaccgaaaggtgccgttccccccactgagagcaaacaccgcatttgtagtgccaaacagcttattcctgtggggtcaccccaacactgcacatatagcagtggtcaccccctcttatcacccagttaccccgcggaacacgtggtcagggttgaaccccccggtgggactttgttcacattgttcggtctctacatacacacatctggttagtnacagaggcgccaatactcagtatctgtgaccgaaaaccctaaatcttctctactacaccgtgcgacagaagaggagcttacttcgcagagcatcggccgaatgtggtgctggccaatgttccgtatctgtgcacagcgcctgttaatccgcgacaccatatgtaccctgagtataatcaagctaccacgccaccacatctttgtaactaatccacatcacgactgacatgcaagacgaaaacactctaccaccctagaggcaagcaaataccccacgatacaaactatctgtcgatgcgatccccctctaccgaacagtgcctcacaggcaggccacatagatatctccactggtactgtcgccaaacgcagagactgcactagatactaacactcgataga

SEQ ID NO: 624808 - DNA, 221 bp, Homo sapiens
cctgcaagagagatggcagcaggtggcatgaatgagcctcgtgcctgatggagcatcattgctgctcattctgcctcttcaggaaagagggtgctcctgcacagctacacagagttattttgtattaaactttgagggagagcctttgtccggctggatccctgctggtgaatgtgccattctaggtctcgggtccccatcatcatcccagtgtcctgcct

SEQ ID NO: 624809 - DNA, 107 bp, Homo sapiens
gcctcaaccagtatttctttccttttgttactgaagggtgttttatggactaggaagcctttttatgaattgaaatagtttaaataaaatggggctatggtgtttta

SEQ ID NO: 624810 - DNA, 88 bp, Homo sapiens
tatgagacactagcattccacaggaaacactatgggagaaactgttctcccacaaaaataatctcttcttcccttctgtcgtcttctc

SEQ ID NO: 624811 - DNA, 816 bp, Homo sapiens
gagagtactgagaagcgtcggggagcgcagcccaacagccatggcgttggaaggaggaatgaagtgtgtcaagtttttgctctacgttctcctgctggccttctgcgcctgtgcagtgggattgatcgccattggtgtagcggttcaggttgtcttgaagcaggccattacccatgagactactgctggctcgctgttgcctgtggtcatcattgcagtgggtgccttcctcttcctggtggcctttgtgggctgctgtggggcctgcaaggaagaactactgtctcatgattacatttgccatcttcctgtctcttatcatgcttgtggaggtggctgtggcattgctggctatgtgtttagagaccaggtgaagtcagagtttaataaaagcttccagcagcagatgcagaattaccttaaagacaacaaaacagccactattttggacaaattgcagaaagaaaataactgctgtggagcttctaactacacagactgggaaaacatccccggcatggccaaggacagagtccccgattcttgctgcatcaacataactgtgggctgtgggaatgatttcaaggaatccactatccatacccagggctgcgtggagactatagcaatatggctaaggaagaacatactgctggtggctgcagcggccctgggcattgcttttgtggaggtcttgggaattatcttctcctgctgtctggtgaagagtattcgaagtggctatgaagtaatgtaggggtggggggcgtttggtcttttcatggagtggattctccaggtttttcaattaaacgg

SEQ ID NO: 624812 - DNA, 1016 bp, Homo sapiens
agtacatgaaaacgcattggctctcggagttagtcaggcagcgacttgccttcggcttgttctctgctgactaagatctcctatagagagctagaacaatgccgaaaagaaaggctgtggaggtcagggtgatatgagggaggcagtcacaaccagccagatctgccaggttgtctgatatgcttgtgtacagggtacatccagagtgtaaaagctctaaaaagaccatcaaaagtctcaaggaactatgaagagaatagaagtgaatatgaatgtgcaaggaaaatttcagatacaggtgctccaaagcacgcttagtctgcaaatcctaagcaaaaagcaggcggttgaacgacagattacaaactgcaataagtgcgtagaaaatggagaagccgaaaaattaacagaggcagccaggcttctgtaaacacacagacagtttgtggagcgctccacacagaaggcacatatgagaggatgtccacagaacgggggcggaccacaagcacaggacagcacgggaagattagaaattacatcacaaatgcatgacggaagatccagaccggacagcatgacgcagatcactcgagggagcaacagggggacagctggcgggaagaagaccatggatcgcacaaggcgaacaaggactggacacacgacggatagaactgtcagagtgcgaaaggcgaagaatgcacagcgaaaaccagatcgcaacacaaggtgagacggaaaggcacgggaacaaagcgaacccaacggcgcacgctacacggaagcaacccaagacgacccgaccgcaacaagaatcgacggccagcacgacgaacacacaggggaacagaagagcaccccagagacgacaaacgcgacacaggtaaggcggaccaccagagacaaagagcacgaggacacacagcaaaaccagcagacagacgcaatatacacacagcacacacaaccaagaaagaaatccaacacagacacgacagacaaccaccaacacg

SEQ ID NO: 624813 - DNA, 941 bp, Homo sapiens
gaaaacaccaaatggcggatgacgccggtgcagcggggtgggcccggaggccctggtggccctgtggatggggaaccgcggtggcttcctgcggaggtttcggcagtggcattcggtggccgtgtggtcagcgtgcctgtgagactgtgggcctggtggcctgagtgccgctggacgctcgctggatgtgcaatgggccggagcgattaagggaagtggattgccctgtcaaccaaaggtttggggcccgctttgggtcaaaggaaccattgaaagatcacagtcccttgggagggagaatctagtctctttcgtcccttgcccagattaacggacactcacgagattcaattggatttccttcgcttggagggccattctctccaaggggacttgacggcttttccgaacgacattatgcacagttgcaaggaagcgagaccgcgtgaccggtgccagcgtcacccagtggttcagaggcgattctgttaggctatcgggggaactaccaactgtgccagcgatcgggtcatggggtggttacagttgctcccaaagtgagggtgagccacacgcaccatcacgtgcggagccaatcagtccgtgcgccgaaggctactccagtcggtccgccgttgctgcagaagagactacctgagggtgaaaccaagcactcagcgcaaggcccgcagcacttgttacccttgcaatggttgaacacggcccgcatgcagggctcatgtgcctggttacgccctacattccctttgacaacccaagggggacaacttgggcattcaactaccagcaacttgtgccctaaggaacgctgctcaatgatgggctggcaatcggatgaactgctaccaccttcaggcaccgagggcttgcacttgccacccttggggaaactttcggccaagggccacctttggatgcca

SEQ ID NO: 624814 - DNA, 1077 bp, Homo sapiens
aggagacagacagtgcgcactccaccctccagctcgacggcagaccggcccggccgacagaccgccgagactgacagccctggcgcgtccggtccccacctccgaccacctgccagcgcatccaggccccagccgctccccgctctgccggcaccgcgccctcctgctcctgccgcagtgccaaccatgacctgccgccagtatgggcccctgtccggcgatcgccttcgatggtcctcctcgccctctgcagcctggctggccgtctggccagaactgccagtgggccgtgccggtgccctggacgcagccggctgccgcgactgcccggcagggcgtgagacctcgatgctaggacggctgcaggatgctgccgacgatcatgcgccaagacaactgaggcgcaactgtgcaccgagcgcgagcacatgcgaaccgcacacaagggcctctatcatgcgcacaacggcaccccggaccaaccgcaacgatcggccgtgtgcaccgaccaaaagcatgggtagctcccctggcacatctacgcaagggcaacaggaggtacacggccagcggcaccacgaaccaaacccagacgacacgactgccaagtaccacgtggcacagatgcccagaaacgagggccggagggacctcgactgcccccatgcacacaccgacaacggagaacgaacacgcgcaagacaccagacccacatacactagggcacacgtaacccggacagcgcgcgccacccgcaagccccagggcaacaatagcaagcaaacggaaactgcagagcagccatggaccacaggccccacacgggcacccaaccccccgtgggagctcgggcacacgccccaccgcacggacctacaccagcagacggggcacaagcaaaaacgacaacagggggccccaaaaagcccaacccccacggcacgacacacagcccgcacatggacagggctgcacgagacagcccaacgaagaagcgaaccgcgcccacggacaccccagccacccagagcgccaagtatgacaccaacccaagacacgagcccacccacaataca

SEQ ID NO: 624815 - DNA, 507 bp, Homo sapiens
ctgctgctactactaccgtgtgggcgtgtctggcagaagggaagacatgactgtagtggcttctcagagcctgtatgaacggccttactttattcagtgaaagtgtctattagactaagaggtatttagtttcctgaatcatggcatgttgagtaaagtgtcatttgccagtcctgggtggggcaaatcctccagcctgatgtgtagggaagggaggggggctgaataatccctgaggagtagtagaatagccgatggaacacttgagaagttatttccttgaggatagatttccacgatggaaaggaaatgagaggttctgagaggtgggctagtggcttgtactatagcataaactggctttgctggtgtgttggcgattagggctggttggaaacttccctcaataaatccagcgtgatccgggtgcgggaccggaaagcaggcacatattgggggtgactatccggtggcaccgcgagcatacagtcatggaggtcaggtgtg

SEQ ID NO: 624816 - DNA, 916 bp, Homo sapiens
  misc_feature (299)..(299): n is a, c, g, or t
agtaaacctgacgatttcatttatatcaatactttccagaaggtaatcaaacgggtttcctccccctcttgcaccccccctgcttaaagacccaccgtcgtgtcctcctccgcccgcttctcctataagttgccgccacaatctttgcactaaacagaaaccttgttggaaagcaccacaatattgggccccacttaatatcctctcccttgggacaccccaatcttaaccacgcaatcaactttttaatcctttccgcggccgccaattgatagtgtccttacactccccctaatctnaggtattctcttacataaaagttctacagagggggtttcagacaacaaatttctttgcccaatcccctcccccgattagcccaacccccggtgttcctattccccttagagtataaaaaaggcttcttcaaccccccggaaactaaaaaatattggggccagacaactaaagataataaagccctcggcccgaccagttttaaaagtcatagacaacccctttttccacccttctaggaaaatgtacatgcgctgttctttcacgtgcgctatcttcaaaatatagccttgaacagccctatccaccttccaccccctgaacccatcgtccttcattaatagccccaatcagttcttgcccgtcaaacacacaaatacattccacttcccacacatttttcttacaccggtactataaaaaacatgtgtagttagaacacccctctactggactcatcctccctcttcataagccaccggtggcataaccccctttcttggcaatatcttgagaccccaaagtttactaaaaccatcacaggtttttccaaatttgggaaaatcaccggaaacattcaggggtgaaaacaaaatccccactgaggggcccacataac

SEQ ID NO: 624817 - DNA, 473 bp, Homo sapiens
agttgtagaggtgacacgtggagagcgatgagaagcggtcagcatatagtgagcatcataacctctgcagatctcccccgtatcttcctatgcaaaaagcgaaacgaccgatagtgtgcccagcgatgaagagagtgccgaggagcgccacagtggcggaagaggaatattgaaggcgaacagtacctcagcaacatggggactcgaggctcctaacctagctgcccggcatggagtcttcgtcactatccaataaactggagctcgaggtcaccattcaaagaggagagcaatccggtagccttacaacagctcctgtcccccttttcaggatctccccctttcttttctccatgtaccctgcatgcagcagcagtcgggcagaccgaaagaccctgggtcagcgtcagtccatgaaaacatcggcatatcacccaggcccgcgtctggagctgttagagcctctgactctc

SEQ ID NO: 624818 - DNA, 201 bp, Homo sapiens
aagggaatctgttatgagtatagtctcatttttgtaacgatgtaaaagttctagagatctgattcacaacaatattcaggtattcaatatttaaaacaattgacattgtacacttaaacaatgtctaagactgggccatggtgcagtgagctgcaggcctatatatccctaggactgttgtggaagtctgagagcagggag

SEQ ID NO: 624819 - DNA, 143 bp, Homo sapiens
atgctcctctggcttgcctgagcgatgacataaatgacccagatatgaatgcgttcagggtggtcagacatgcagagaggtggagtattgtgatcataaaactgaggtacaatgtttcctaaataaaccatcagcatctctga

SEQ ID NO: 624820 - DNA, 540 bp, Homo sapiens
atcagctcggcaccgttaacttagaagttgtggttctttattcctcccctgattgccaattctcatggtatcgtggttgggtggtggagagctgcgtgtcatcatgcgtggtggaactgcccacagttgggcgggcggagcctctctactcgaaggtgaccacgttcagattctgagacgggaagtggagggtgaataggtcacggtggcctttgaaattagagaatgaagttctccttttgtgctgtctagtcagccacgtcgggcttctgtcctctcgggtcccagcttcgtcatcttcatcatctacagatgcccggctatgtccgtgagtgtactcagtgttccgcatcttcatctccatcctctgcatcaccaacacgcttatcctgtcctgcctcgctacttccgccccagcgtaccttcctctactacgtctaaacgtcagtggtcagcctgcgggctccccattttcctcattagcattcccgttagcaggggcgtctcttccatttactgcctacttccacaactcctaaa

SEQ ID NO: 624821 - DNA, 379 bp, Homo sapiens
gtcgttcctgaggtatccccacttgggaggcgaggcgagcggatcacttgaggtcaggagtttcgagaccagcctggctaccatggtgaaaccccatctctactaaaaatacaataacttagccaggtgtggtggcgggtgcctataatcccagctacttgggaggctaaggcaggagaattgcttgaacccaggagggggaggctacagtgagccgagatcatgccactgcactgtagcctgggtgacagagactccctctcaaaaaaaaaaaaattaattagaattaaaaaagccaggctcgtgatccacctgcctctgcctcctaaagtgctgggattacaggcctgagccactgtgcctggccagttttattttt

SEQ ID NO: 624822 - DNA, 361 bp, Homo sapiens
cgcaatggaggacactagcctcactttctggccttcaggtaatgaggtatagaagagagaacacaatcactgcttgaggttatagaaataattctgttctcagaggataagtaggtttcagctaagattaggaagtccacggaaatgttctgagcacaatgaacagtataaagcagcttgaggaagtgaggagaggatcacagattgggtctgaatagtagatgatactgtaaaatttgcgatgatgagtctgggtgaaaaccaatatccagtaaggtccactgctaacagtggtgactgaagcaagcaagaattagatacacaggtcggacagtcctcatggatctgagatgggttcttt

SEQ ID NO: 624823 - DNA, 102 bp, Homo sapiens
tcccagtctggcgaaaactgggccttgcagaccccttagcatttttttccctttatttccttccctgactttctacttctttggggagccccttgtgttatt

SEQ ID NO: 624824 - DNA, 702 bp, Homo sapiens
  misc_feature (469)..(469): n is a, c, g, or t
  misc_feature (702)..(702): n is a, c, g, or t
tctccaaaagtgtttctcagctgttacataagtggtttttttaattgtcatgtatttatttaaagcgataccggttttcccccctaaataataccaatacaagcagtattcatatcgtgttggctctgtggcaggcactattggaagcacttgccgtaaattaactttacatgttttaagtcatttacccttgaaccacctctgtattcagtaggcgctattgttagtgctgttttgcagatgaagtgcagttagcccacatctattgccactgttagttgagtaaataaattcactcctagaaatcttaatttctccttctgtagtgtttccttggatttagaatcaatttcatagactgttgttaactcacttgtccagggtcacactgctcataggtgactgtcaactccagagctcatcaattacaggtgtctctctattgaccaaatgcatggccgtaaagctntattttaaaaagagatctatttcactacaagatgagagttggttgaagaaaatactgagttactggacctggtggtacagaaatatggcacaaacctgaaactagtgcatgcgcattggaagtttggaaacgtacagaataccgtgtatggtgtctggcattgcaaatttttaggatgggctcggtgggtgccaaggctttttcaagtggccagaacagacgtgctggccgcn

SEQ ID NO: 624825 - DNA, 89 bp, Homo sapiens
gctgtctgaagatagatcgccatcatgaacgacaccttaactatccgcactagaaagacatgacgaaccgactagtcagaggaaacaaa

SEQ ID NO: 624826 - DNA, 309 bp, Homo sapiens
tcagaagggtgtctgggtacctctgagactcagaagtgaaagagggctattcctagttttattgctacagccattatgcttcttcatgctagagtattgatagatagtattggttatggttcattgtccggagagtatcttgtagacgaggatcgctacttacgacaggattactggactgcggttgcttgcgtgacggacataccttgatggcagcttctgtggacaccgacgggataattaatttaaggttacgaacctgaatacaacgctacgcctgtatatttctacggcctcctctggaaagtg

SEQ ID NO: 624827 - DNA, 153 bp, Homo sapiens
attaagcgtatggcttgttctttgacctctcgtaggtcaaacactctgcactggaaggactggggtgttcccagactgctggcaaaacactctgatgggggctgttgacaaaagtgctctggttgtgggggcaggctgccacaggagaatgtc

SEQ ID NO: 624828 - DNA, 1125 bp, Homo sapiens
cagctattccatagttacaccttggctgctatcctatgaatgaaaaacaacgcgccggaatctagagtcgacactccctatggagtgcattgacaaatgatgagcaggtggtaatatattggagatatctagagtcggaaagtgagtcactagagatgggtgcattctgggagcaactgtggatatgtaatcaaagatcattagatccgttctagctcaaatctcccctaacagaccagtgagtattattcattgaacttaactgtctcacagatgaaaaactgaagcaggtcagaaactatatcaaggaacatagccctcgccaacggcctgcaagcagaggcctggaagagaagcaactttcagttgtgcaagcaccagtggagtgagcggtgccagtgccagcgccagcagcagcagtgccagcatgaagcgatccaagcagcggaagttacagcagaaggccttccgcaagaggcagctgaacggagcagaggcaggcccggcaggagaggctcagtgggctcttccttaacgaagaggtgctgtccttgaaagtgactgaggaagaccatgaagcagatgtcgatgtacgatgtcactacagggtgcatttatcaacgatcttagtgagcattagaatactccatccttatgggtatacatgcatcttgacaacaatttggttagggctgtgctgatgtaccattaataattaaagacaggcggactagggcaggtgcacccaaaactggagctcaggatcactggcaaacagttgtacggacagctaaatagagcccggccccagacataggcaccaaaacaacagggggcgcacatggatatacacacgctgggaatgagacaacaacaagtgagaccgaaagagggaagcagcaagagaggccacaacacagggggaaacggcgaccaacagcaacgcaacaggcaagaacgcacgaggagcgaagagaagaaagagaagacaagagaaaaaaacaaaaagaaagaaagagaacgccaggagagtacctacccacacacaacagcaggaaagcacaagacgaagacagacagcaacagcaccacgacacagataagacgacaaactcaacagaggag

SEQ ID NO: 624829 - DNA, 1014 bp, Homo sapiens
gtgcttctcgtacggttgtgtgcctgctttaagcgagctcgtaccccgtacaactgcgcagtccactggcatcaaacacaatgcctcctcgatatatcattggctttgtgttgccactggtctctctcaaggtcggttgctaggggtttaaacctgccaaagctgggggcgtaaacgcccccgctgtctttgttacgacacttccacggggggttggataacgtccctgtggcgacgggcaattacggtggtgtgtctcccagttacatggccactcccatctgggaaattagcccctctggaccctgggggacaattgggacgctagtatgatgcgacggcacgcccaatgcgttgatattgatcgaggatttgtgggtacctctcgctatgctgaagtgccctttctccctggctaccgctctggattggtaccggtctgcgtccatacatcgctgtcttgcccatgtacagctgtatgatcaccagactgaggaaccttgcatgaggcctgacgtcaggagctgctctctgacatgggagaccccaaaggtggtacatggctggcagagtggctaccagcacaagcggatgccatctgctggatgtctaagacgtgaccgtgacccaccttgccgcctacccttcagagcctaggggtcctggactgcctggggaccattgccatacatgcttctccactgctagtcacccatggctccccgcttgctagggttgctcgggtcatgccagtgtctcccgtaccaccgcaccctcagcatgcatctagcttccgatggcgccatcaccatcgacttcgactgcccactcaggcgttctgcccgttgtgggtgttgagctcaccgcgccaccaacaggcactcatgggaagaggctatccttctgagatgggggcggctggtagacacctattgctgttcttctagccctcgtgggcggggcattagggcacaaatccccaggcaggctttgataattctcaggtatagggca

SEQ ID NO: 624830 - DNA, 236 bp, Homo sapiens
ggagagaatgggatgacctctgaagatccttccagcccaggagttctcttgaggtctaactgccatccctcctgctgtaaaataagtccattacctctagctctgtactctcttcagatgccacctcaggttgcacaggaaggctagagccctctgtagtcactagaactggagccagaggaggaggaggacgacgacgacaatgatgaagaggaggaggagctatttggacgacg

SEQ ID NO: 624831 - DNA, 727 bp, Homo sapiens
tgtctaatgctctacctaagattcccagtgctttactgaaaataactgttacttacatgtggaattcaaagaacttaaactcatagaagtagtaagtagaatggtggtaataggggctgagggagggaaaaaataaggctatgttagtcaaggggtacaaagtttcacttaaataagatgaatagctactagaagtctaatgtacaataatttgaaagtagttaatactatattatatacttgaaatttgtcaagagggtagattttaagtgttcacacacacacacacacacacacacagagacagagagagaaaagatggagaagatggtaactatgtgaggtgataaatacgttaattagcttgattggggtgattatttcacaatgcacatacataacaaatcatcaggtattacaccttatatatatataatatacataattttgtgtcaaaaaagtaatgaattattcttacgagtaataacataggtgactatcacagatgtaacattgaccaaaagaagccagatatattgtataattctattcttttttaaaaaaaataattttgggaatacatagtaggtatatatctttatgaggtacattagatattggggtataggcatactatgcataataatcacattagggtaagtggggtatccatcacctcaaagcatttatcatttcttttggtacaaacaaatcattataattatat

SEQ ID NO: 624832 - DNA, 211 bp, Homo sapiens
  misc_feature (149)..(149): n is a, c, g, or t
ctagtgtctcgatcgtgaagtggggtgatgggtacatggaagttcattacattattttccactttggtatatttcagggttggggttttttcatcacaaaaagtttggtgttggttttatggtttgggggtttttttagttagcatctngctctatcacccaggctggagtgcagtagtgcaaacatggctcactgcagccctgacctccg

SEQ ID NO: 624833 - DNA, 996 bp, Homo sapiens
gctgcaggtgcgtcttctggggggggatgcgacttgacgcggggctcaaggagctgtgggggagacagctcttttgtggccctcggcattttccccccgttctttggagcccgccggggacacaccctttcggggggggtatccccctttatgatgttcgcaccaagactgtttggtcgccggggtctttatgctcgggagtctcccccctgttctcgggcattccgggggcaccacccacggttggtagcgttaatcgtatagggaatgttgggtacacccttttagcccgggagtcagacggtcaccctggcaccacgagggatcacacaccagtgtccgtgcctttttcagcccttgctagatacccaagtggagaccttctgtgtgtgattatgcatgagactgtactggtaagacttgtatcctgccatccacctgaaggaggacttgctggctcactctttcacggagccctgcccttcctccctgtggatggtcgcgcgcttgtggaaaacccggtcacggtaatgatagtggcacggaggcacgtccaatgcccacggcagatagtgggtgggtacctggtgaaacccagacccttgaagctgaagacacgtcccggcttaatcctcatactgaattgagaacctgttttcccatttggtttgctttcctccgattgatcccaacccttcacctattttacagtaaacctgcccatttcctaattcggtttttacaactgctagtgcccacaccttttgaattggtgcctcttgcataacttatcacacactcactcaacgctgtatttcccctaattctgagcccactcatatatgacccacgactcaactccacctggatggacgagaagtcacccctgctgtgggggttggggaccactccctgcatcacacctttccactgagagctgattcttttgactcaattcaacttctgttctacccaaatctcaaaaggaaaaaaaaa

SEQ ID NO: 624834 - DNA, 803 bp, Homo sapiens
tagatgctctacttcacttcctactctgaatggaagcagctcgagcgtcttcaccacgaacatatgtctgctgtcaagcgtgttctctccagcctacagaactgtgaatcaaatacaccctttctgtttatgaatggaaatgaaaatggacaaaagagcaaaggcttatttcaaaacctttgaccctcaaatacaagaggccctctttgcgcctcggagagcggtactatgcacccgttttcctatgtggacggtcaaactgtcagcccacatgcctgactccatatacatggggctttctgcatgccgacagcgatgtcatctcactcaaaggctgggatcacacgtgtatcctctatgcacgccgcggaatcacgccacggaactagctcgttgtgacacctaaggcctggctagggcccccaacattctaaaggccttcactttggggtacttcctttggctcgccccccctgactagcttgacaaaaataaccgccaaattatggggcggcaaacccccacgggacgttaaagcactccgggcgcccccccctttattctccatcctgtgtttttgagacccaaccctgcctattactagatacccgtccctctttttccttttagaaaagataagacttttttgattcttcacgccttaaggatctaatttctgggaagctttcttttatcaaggggtactgcttgccccaaccccccggacatcccagacctctggccttttcttggtgaatattggtttagctccatcctcggtggtacattctttttttcctctg

SEQ ID NO: 624835 - DNA, 252 bp, Homo sapiens
  misc_feature (57)..(57): n is a, c, g, or t
  misc_feature (63)..(63): n is a, c, g, or t
cccgggggaaaatttatttttgggcccttaaactgtgttgcaacccccaattttttntttttntggattttccttgccctcaaaaaccctggggggataaactgttccagttggagcccactacccctggtgggcctcaatgtaaattcagttgaaatttgcaattttatcagcaatttaatggattgaattcagatcatcatttgtctttttaaccggcccccccccaataaatttattttgcagttttga

SEQ ID NO: 624836 - DNA, 117 bp, Homo sapiens
ggcgtgcatgtatgattcctacttacccagttactaagtccctccattgcttctcctatatctttgggtgaagctgcttggtctacggtgggtgacaagccatgcctacttaattct

SEQ ID NO: 624837 - DNA, 215 bp, Homo sapiens
ttctgagacctgcatgctattgctgcccccggtgttgtcaaaccacaggttctgtttttcttgcttcatgatggctggggtagctgcggtgttgcgctggttggagctgacgaatccactggtgcccaagaggcccaggcgggcggaagggacgttccgagaggggatctggtactggcgcggattccgtctgcccatgccaccgctcacagagc

SEQ ID NO: 624838 - DNA, 156 bp, Homo sapiens
aaaatccattatacactatacatatacatcggcgtagatctgactttcttcccacaacacttgctcggctatccggaatgccccgacgttactcggagtaccccgagagcaggctgtggaacctacgcggtgcaggtatagggacctaccggtgca

SEQ ID NO: 624839 - DNA, 1369 bp, Homo sapiens
gccaaggaaacgtaaccaatcaagtgacgcaagcaaaaaataccaaagaagactatgaaaactaaaatcaaacggcaaatggacgtgacgacaccttgctttgaagtggcaaatgccagaatgacattgctgactaaccattacgcacacacggacacataccacggaagatttggaaaaaccatgaaacgacccagatctaccttcactgcagacccgaacacaccaagacgtactaaaactgacataccaacacactctgagtgtggccagctacgcaaggttaacaataccaacacgaacgacctactgacacaacgacatacacacggacacaagcacgattactaacttgtcgctctccctggacttcacgaggaaccccaaccagccttcacgcgccacgcctggacacgggccacgccagcgcagatggcccctaaaagatgcaccacaacgtactacgacagggcacaacacgctactgcaaccacagcaccaacagacggccaaagaacgccactcacccatttacacctgccgcagcacacccccccaacaatctcaaaagcctcggaatacactgggctatctaggcaagcaaacatctccaagaccacgttggcactcaacgcaacaaatcattacacaggatttcccgtcaccattttaacaacacgaactcattcacctggaggcacaattcacatggtacgggccaggccctctcggcagggaattcccagatgaacacaatttctaccaacctggcacagtgggcaccacggtctacacagcgagtccaaaaaaagcacggtgagcttcaccacacacctacacaaatagacaaggacatctacggcacaggcacaggcacacggcaggtgccaaagaggggctatcactttccccattcaagtacccaatttatcctttccacagcacacttattggcaggcgccaaacaatcaaaagaaaacgcaaggaagtacaggagcgttacaaggaacgcaaccagccttacacacaggacgcaaaatcccagcacgatcacgcagcgcgcacatgttacacccgccgagaggatataaccagggaaacctgctgtcaccaggatagcagggggatcagaacacagcccccacagggcaaacactccccaacacacacttggacacaggacccgcaacacatacgcaaagccaccaacccgtcccaccgcgtgcaccagccctcaccgtggcaccaaatcccccccggagcacacaggagcgaaacacgagccacgcctaacgaacacacaacgacagggacaaacctacaagcacccagcgtccaagacaaacagcaaagagcagccacacagcag

SEQ ID NO: 624840 - DNA, 1843 bp, Homo sapiens
  misc_feature (1045)..(1045): n is a, c, g, or t
  misc_feature (1104)..(1104): n is a, c, g, or t
  misc_feature (1171)..(1171): n is a, c, g, or t
  misc_feature (1189)..(1189): n is a, c, g, or t
  misc_feature (1224)..(1224): n is a, c, g, or t
  misc_feature (1324)..(1325): n is a, c, g, or t
  misc_feature (1334)..(1335): n is a, c, g, or t
actatgtggcctcctgcatgtgcaggctggttaacaattcctggccagttgcttttttgatgcacttgttagatcactaaggtcacatatattagcactcccctctatttccagatgatgtggaatgggaccttctcctgcagagctcccaggatgaacctccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctctgttccaggccttgagggatgctatttaactgtctgtgctcctgggcctttgggggcaaggtcaggggagaagaacggtgggcgccatggtcggtgatggtgagaacatggctgcttaggaattcagagggctttgctcccttgtctcattttatacaacccttcgggagctcactggggacaggctgcttttccctatttggagataaggaaaccaaggcaaagagagatagggcacaggcagtatgacaagattgttttgtcaggagggatccatcaagccttgtgcatgagttccacatggcacagcgtgcacagtaaacactcaatgttaatttttcaacgttccagtggagcttgctgaggaactctgttgggcacaggtgcccagaggattcatggagcagccagtcctggggaatgtgagtgggtagcgagctgcctgctgctggggcaggtgatgtgtcaaagcagcaactgctaggggtttgccttcctcccctcatgtgcattctggcaggcaaagggggtttcttcctttcctccttgtcctcctggtgtatagtggggtctgggggatctggagaccacccttttngttcccaggcagccacggtatgacagtgggccataccatgcagtttaaaatgtatcttngagtgaaatttggtggtttccttattcttttttctctcttcactgtccttccaaactcacttttctngtgtcccgaccgcatttngtgaatcatccttactccctttaagttctcgcttnggatttcaccaggtgggctagatggtgccatttcacttccactgtttgatgcggctggtaatgttgactcacctgttacgtgttatttcactggtttctnngattttacnntctttctcatcagtgacctgggctttgatgaaattagctttcattaagtcctatttttttttaaatttgcatccttacctctttctttctctgtgaatgccatcatgtgtgtggtcttatgtacccttcatccatctgaagtcctggctgaatgattgtttctattagcagaaagaaaacaggtccatcctaatgtatctgggaagagataaaccctctcgtatgtggtgggattcctgacggggacattttgcagcagaattcttcatcatgtccagattgggctgggggagggttcatgaaccttagtccttgtacatctaacatggcttggtgtgggcgggaggggggacggaaatgacggcatcttacaaccctggttattaacggaacaagacaggtttgaaaccaggtgttatgtggcaccaagggcgtctaaaaaaaaggggccaaaatggcggtttttctctcttttcggtgtttctacttccactatacgcaaaaaact

SEQ ID NO: 624841 - DNA, 660 bp, Homo sapiens
ggaatccgcacggggggcacctttttactggggttcttaccaggctaagccaaactccactcttgtttagcagaagccataaaggttggtttaaaaaggattcttgacctaagcctttttttagaaaggttgatagattaggtagaacttcagaacatcagatcagtctcaaatgggttttttgggaatttatatttgacaataattatactataccaaacctatttgcagttcttaggtttggtgggtaaaacaattttttaaagcaagaagttatagaaaatgttttcatttaatggaaggctgggcgatggtcagcatcaacccctatgggatgcatttcccagtggccttctcatcttgggcctggaacccttggttcagggcttaggggagaaacagggcacatggcaacagccacacaggcattgtctttaacacagagccacgtgtccccaaaccagaataggcatggcccttgcccaggttgggatctaaatgagaccacaggggcggtggcttccttctagtagagctatctaggtttggctggaaagcttccgcccctgctttataggcccacaccctaggtcctccccagggttcgatccctggattcagcctttgttcagcccaataaccttggggggaggacccaac

SEQ ID NO: 624842 - DNA, 302 bp, Homo sapiens
tacatcgagctcgcacccttctgctcatcactagcgcatgaatgtcatatgtcataaagttccaataacagtgcttggcacatagtaggtgctaaataaattactccctgaactggcgtggtggttcacacctgtagtcctagaactttgggaagttgaggcaggcggatcacttgaggtcaggagctcgtgaccagcctgggcaacgtggtgaaatcctgtctctactaaaaatacaaaacctagctgggcgtggtggcgcttgcctgtggtcccagttactcgggaggctgaagcaggag

SEQ ID NO: 624843 - DNA, 749 bp, Homo sapiens
agcgggcaggagcccggacgcgggcaagatggcggccgcggcggtgcggcccgtgacctggaccactgggctgggacccacgaccccaccaccacgcctggaggacgcgtgagcgtgcgcctcggccttggaacggggagtttcccagcgcgagccccgcccttccccgcccgggaggcgcctcggggcggggtcactgtgccgggaggccccgccttccgcccgaatagcgccggtgcaccccgcaggccctgcccgtgggtccacgaggccggatccccgggttcctaggctgggactgcttctcagaaccactctgtcgtttttaagcagggtcacacactctagctcactgggtccattttaatttctattaaacattttgtgggttttggcaaatgatgtagctaggagatccaagggtgtcgggtcaaaggatgttatgcgactcataaggcatctccgacaaacttgtctggagcacctgtttatgtaccaaggcacttgtcctggaattgctgaggaagacaggacgtgacagtaaaaagacttggtcccggcaggaaacgggcaaggaaagccttgcactgggatagggctaacacagtgctacccaggaggggacgcccgcatcggatgtcgggggtccagcaaaagcttccttagggaccactaggttgagacgagaaggatgacgtatgggattagccaggaaaggggaacagggcagtgggaactggacgcaaaga

SEQ ID NO: 624844 - DNA, 1046 bp, Homo sapiens
  misc_feature (27)..(27): n is a, c, g, or t
  misc_feature (148)..(148): n is a, c, g, or t
  misc_feature (212)..(212): n is a, c, g, or t
  misc_feature (311)..(311): n is a, c, g, or t
  misc_feature (317)..(317): n is a, c, g, or t
  misc_feature (333)..(333): n is a, c, g, or t
  misc_feature (353)..(353): n is a, c, g, or t
  misc_feature (357)..(357): n is a, c, g, or t
  misc_feature (361)..(361): n is a, c, g, or t
  misc_feature (370)..(370): n is a, c, g, or t
  misc_feature (372)..(372): n is a, c, g, or t
  misc_feature (395)..(395): n is a, c, g, or t
  misc_feature (400)..(400): n is a, c, g, or t
  misc_feature (406)..(406): n is a, c, g, or t
  misc_feature (408)..(408): n is a, c, g, or t
  misc_feature (425)..(425): n is a, c, g, or t
  misc_feature (439)..(439): n is a, c, g, or t
  misc_feature (455)..(455): n is a, c, g, or t
  misc_feature (458)..(458): n is a, c, g, or t
  misc_feature (466)..(466): n is a, c, g, or t
  misc_feature (468)..(468): n is a, c, g, or t
  misc_feature (472)..(472): n is a, c, g, or t
  misc_feature (481)..(481): n is a, c, g, or t
  misc_feature (483)..(483): n is a, c, g, or t
  misc_feature (491)..(491): n is a, c, g, or t
  misc_feature (512)..(512): n is a, c, g, or t
  misc_feature (516)..(516): n is a, c, g, or t
  misc_feature (519)..(519): n is a, c, g, or t
  misc_feature (521)..(521): n is a, c, g, or t
  misc_feature (527)..(527): n is a, c, g, or t
  misc_feature (533)..(533): n is a, c, g, or t
  misc_feature (535)..(535): n is a, c, g, or t
  misc_feature (582)..(582): n is a, c, g, or t
  misc_feature (586)..(586): n is a, c, g, or t
  misc_feature (590)..(590): n is a, c, g, or t
  misc_feature (603)..(603): n is a, c, g, or t
  misc_feature (645)..(645): n is a, c, g, or t
  misc_feature (938)..(938): n is a, c, g, or t
  misc_feature (968)..(968): n is a, c, g, or t
  misc_feature (971)..(971): n is a, c, g, or t
  misc_feature (979)..(979): n is a, c, g, or t
  misc_feature (993)..(993): n is a, c, g, or t
gggagcgcctctcctccgcgtccctcnccccagccccctgcccgccccactttgggaccctccagccgctttccccacaaatgagatctttgcaatgagcaaacgaaagtgtcgcggatttcggggcgcccagcaggagcgagcgcancgccagccgcaagtccgcagccgtgtcccgcgccccacgccggcctccccggcggcagcgacgnacgagcgccacaccggcgggacagcagcagatgcgggccgagagccggtcaggggcgcagaggcggaggggatcggcgcggcggggagctcaccgcganctggangctgcgtccgcgggcncaccaggagctcaggcagcnagcnatcnaacgctctntngcaggcggtggacgctgctgaanctctngctctnanctcaccgctccgccgtncgttggaccaagcncagcattttacaaacncanctcctttntncaanggtcctcanancgcccctncgttaccccctgcagggcgcngcanacnangcgctnaccttncnctcgctcccctcgctggggaaggacacactcgctggcgttaccggcnggcntggnaagtaggactaangacccgaactgcaaccctccacaccagatagcacagaccacnccaaggctgctcaatctgctcaaatctaaaatatctcccctgccaggacctcggtgccgtggagactgcggggaactgctctgcccacacctgctctggcccctagacggaagcacctggagccaaccacggaactccagatcccagctgtgtgactgaatccacgccagcctctctgagccaaagctgcttgcagaaggggggagatcccagttcgaagactcccgcgcagagcctgtggccctctctgccaggcctcagggtgcctgagacactcacctctctgcctcgcnttgggggctgaggctggggctggctgccanctncagttctnggagcgctggggtngctgggccacaggcacagcagctcacctcaggactgggtctctggctgctggg

SEQ ID NO: 624845 - DNA, 469 bp, Homo sapiens
  misc_feature (27)..(27): n is a, c, g, or t
  misc_feature (148)..(148): n is a, c, g, or t
  misc_feature (212)..(212): n is a, c, g, or t
  misc_feature (311)..(311): n is a, c, g, or t
  misc_feature (317)..(317): n is a, c, g, or t
  misc_feature (335)..(335): n is a, c, g, or t
  misc_feature (337)..(338): n is a, c, g, or t
  misc_feature (341)..(341): n is a, c, g, or t
  misc_feature (343)..(346): n is a, c, g, or t
  misc_feature (350)..(350): n is a, c, g, or t
  misc_feature (354)..(354): n is a, c, g, or t
  misc_feature (360)..(360): n is a, c, g, or t
  misc_feature (363)..(363): n is a, c, g, or t
  misc_feature (372)..(372): n is a, c, g, or t
  misc_feature (394)..(395): n is a, c, g, or t
  misc_feature (400)..(400): n is a, c, g, or t
  misc_feature (424)..(424): n is a, c, g, or t
gggagcgcctctcctccgcgtccctcnccccagccccctgcccgccccactttgggaccctccagccgctttccccacaaatgagatctttgcaatgagcaaacgaaagtgtcgcggatttcggggcgcccagcaggagcgagcgcancgccagccgcaagtccgcagccgtgtcccgcgccccacgccggcctccccggcggcagcgacgnacgagcgccacaccggcgggacagcagcagatgcgggccgagagccggtcaggggcgcagaggcggaggggatcggcgcggcggggagctcaccgcganctggangctgcgtccgcgggggcncnncgncnnnncggncggncggatngancggtgtgtnggacggggtggacggtggtganntgacnacgacgatgggggttgttggtgangactgggtggtgggggactacttggacgggggggaggggggggga

SEQ ID NO: 624846 - DNA, 467 bp, Homo sapiens
caagtattcaaccccgcccagtattttaaaccaagtgattctaagatttggttggggatcaataggaaagcatatgcacccacccaagatgcaaatgttttgcaaatgatatgcccaaaattttaagtaggaaagtcccccaaacacttctgctttcacttaagtgtctggcccccaacactgtaggaccaagcatgttcttgttactgtgatattttaaaaacccccagtactccctttttccaaatgatcctagtaattccctagaaatatctttctcttccctgttatttaccaatttttcccagtatttttacacggaaaaaattgtattgaaaccacttagtatccagttgataagaggaatttggtataattatggtgggtgattattttttacacggaaggggccaaagctttactactgtggaaagccaactgttttaataaaagatttccatccccca

SEQ ID NO: 624847 - DNA, 420 bp, Homo sapiens
actactttcaatgtgagttagacaactgattcaaatgatccatattaaagaatctacttacatcctttagagtgataatgtttggatgctgtccataacgaagaagaatttcaatttcttctgttgggtctctcttgcttttatcaataatctaaaaggcaaatgtttatcacaaaacctcatcaactatacagttataaacattaattgtttatagctacagaccttgggtattacctcatgtaaatagtgtataaataagccatttatcagtcagttttattcaactacctggccagattgtttaatcagaaagccagtcttgatatagatggcaaggctgtaaattctaactcatgagtcgcattcccaccatgcctctccaatctaagtttgtaagtttgtagtaagtttaggact

SEQ ID NO: 624848 - DNA, 604 bp, Homo sapiens
agttctgtaaggagacggagtctcagtctgtcacccaggctggagtgcagtggcacaatctcagctgactgcaccctctgcctcctgtgtacaaggcgattctcctggctcagcctgccaagtagctaggattacaggtgtgccttaccacaaccagctattattgtctttagagtagggtcagggttcagcatgctggtcaggctgtactggaactcctgacctcaagtgatccgcccaccttggcctcccaaagtgctgggattacagacctgagccaccgcgtccagccgttagtcaattcttattccttataatgctgtgtattgttttgacctcataagtcagaaggtagtgatcttaacatgtatttcagtacttatgatgtctgctggtggcaagtagaagtcgtggcatttttcttaacagggaattgtttagaattgggcatgtagtataaatgtacttattatttggttcctggttgtatgggtaacaatatattactaattaattattatgattgtacatgaggctttacggtatgtggtatgcaatataactgacacagatcaatagttaatgtcacacagtgacaccagag

SEQ ID NO: 624849 - DNA, 113 bp, Homo sapiens
aaaacattatgatgatgacagaaccactatcacacataaacaaaaatagagcaaccaagcgtgtccacatctccatgaattcagtgatatgaaatacaatgttgttactgtta

SEQ ID NO: 624850 - DNA, 549 bp, Homo sapiens
gggagatgtatgatgttattatacaagcatgagttcttctatagggtgatagattggtccaacttgggtgtgaggagtacagttatatgtaagggattgtttaggtagtgggtgttgagcttgaacgctttcttaattggtggctgcttttaggcctactatgggtgttaaattttttactctctctacaaggttctttcctagtgtccaaagagctgttcctcttaggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagactggtgtgctcttttagctgttcttaggtagctcgtctggtttcgggggtcttagctttggctctccttgcaaagttatttctagttaattcattatgcagaaggtataggggttcagtccttgctatattatgcttggttataatttttcatctttcccctgcgaacct

SEQ ID NO: 624851 - DNA, 840 bp, Homo sapiens
  misc_feature (536)..(536): n is a, c, g, or t
tctcatgtaatgacaataattatatgggtcttatataaattaaatatataacattatatattagtctgcatacttgggatagtgtgcatattcattatggtatcataatttccaaaacagaaacaatgtgatatcttaataagtatctatttaatggagtttgcactaggctttaatttcatggtgtacattaattgaactaaaccgataaatttatggccattaatctgtaattcatcatacatttttcatgcctgatataatttagtcatccatgtgtcttgttgatgtatcctaattcattccagtcagtccaaatgtactgtcttccataggttatccttcccttcaagtgaactgaaacccccacagtgtttgcactacacaccactaacccctttccagcaagatgatcatttagtgatatctctagcatagaatctccccttagaacccctagtagattgagtgatgggctagtgccttcccaggggaccatagagcattccgagattgggaccttccagtcgtaactnggcagaaagacggtttcctttagaaagaccagcaacttggaagactcaggtggctttaaacagaaatggccttgagaccagtgcgtctcaacatgaccacccacgttggcgaatttgttgtcctcgtttggccactcggactcccagttggaaccctaaaagcctggggcccagccggagagcactgggggtcccacacccactggttgacagcctcgaccgtggagatcctacccccatccacaggggagcgggttggaccatggccaccacccccaccgaacattcatcaccccactgtgcg

SEQ ID NO: 624852 - DNA, 696 bp, Homo sapiens
tctatgactcatacctgatttaagcgcgatctgggagatcatggctaggatggtatacaagttcgagcgtttgctcacggcctggacgacccacttgatcgaggtcatttctatcaaatccatgccctgtgaccatctcatgttcattgctatgattctcatagactctatcactgattccgtggtcatcatagtcacagtgcagctgtaggagcaaacctcagtgctgacgcattaccagtctagactatgtaacagtatcagcaccttacttgccttaccagattacaacggccgcatggatctggacgtcgacatatccacatacatgagcatggtcatgacgtaaatcattatgctggcaaagattactgaggtcacaatctcaaaaactgagtattaaacacgatgatgcagtgtgactatatagttacagggtgatgagactctgcgatcatgtgattgtagacgtaattgcttcagaaagtgcgacaatatgctcattagtactaatgcataacgagctgcctgatcaccaaacccatgagatcatgcgtcacgctgtgccgcattggggcccctttggaccattcataagagctacttttacatggctaggtctataagaactgagtttaacccattacacgttttcaattaacggttgcctatcagtggctacctgcccttatggag

SEQ ID NO: 624853 - DNA, 135 bp, Homo sapiens
cccccctcctatcatgcacaagaaaaaggcaaaatcctcaatagaaaaaatggggccaacagacttaaacatagtttacaagacggatatcccagtggtcacagaaacacacaaatcacgagaaaatgcgcaata

SEQ ID NO: 624854 - DNA, 280 bp, Homo sapiens
ttttcccgtgggggggggtggtcttttggttttttttaggggccccttctcctttccttgggggggagggggctttccccactttttttggggggggggggacccctttttgaaaggggggaaagggggggggtttttttttgggggggcgggcccaatttaatttttggggggggggccccccggggggggcccccccccctttttggggcttttttttttttttttggcccccccccccccggccccattcccatttagggggcttttccccctttga

SEQ ID NO: 624855 - DNA, 807 bp, Homo sapiens
cagtcctttggccccagcagaggtgctttaccgtggtcctggccccggactgaggtgttgcgacccggcgcgctgttgccgtcgctggggtggggccgggccccggaggaagccgctttcccggctggggtgggcgggccagggaccgggagcaggtctggtcctcgctgggccgtgttcgatggcctcctgtcgcggtctggggctgggaggtacagtggtctggtcggcgggtaatgagggtcgccccccaggctccaggaggtgcggggcaagggtggggtgcggcttgtacgtcagcgctggtacccgtgtgcgtgcatcggatcgggtgtgtagctgcgaggcccgtgtgggccggcggtgacgttcggcatgtcgaatgtagtggacttgcctcctggatgcacgaagcagtgcccatgcatcatgccccagggtccgtcccccgcctgcccctctagtgaacggaacggggacttgtgttagtgtcctcacgcctggttcgtacaggctggcggttgtcctgggggtttccagcgaggaatgtgttggggagcgctcctgggtgtggctgctgggtaggaggggaaggcagggtcagcagcccctggggcgaccgtaaagtgggtggcccttcaaattcaaggtactggaacaagggggctgggccctcctgcccaccattgcccgtcatttggcttgcaggcctcccgggactggcgagctggctccttggtgccctgtcctttggaccagggccgccctgaggggctggcacagctaccttctccactgtggtcccat

SEQ ID NO: 624856 - DNA, 618 bp, Homo sapiens
  misc_feature (567)..(567): n is a, c, g, or t
cgccgagcgtcagggagggtaaaatgtagtgctgccaactgtctgctcccacggtaggcagccagcccagttcaacggagaatacctgaattaaaagcatccccagagcaaatgccggaaacgagatccccgacaccgcaatggtcatactcaatcgatccggccaacggttacgccagactgcggcgataattcccgccgccataccaaatataactcgccagaccatactggttatggtcagccacagcgttggcataaagcggctggcaatctcatcggcaaccggacgacgcgacaccatcgacaggccaaaatccccctgacagcattgctgatataggccagaactggtgatacagcggctgatcaaccccagctgctgacgcaccagttctataacctgcgcatcagcttcgggcccggcaatcaatcgcgccggatcgccgggcagcatatggacaaataaaaacaccagcaccgagacgataaacagcgtcggaatcaaccccagtaagcgtttgataacgtaattaagcattccactccctgcgttgcttattgcanatccgcgtcttcaaagcttgagccggtgtctggcatgatccaatccacggg

SEQ ID NO: 624857 - DNA, 726 bp, Homo sapiens
  misc_feature (4)..(4): n is a, c, g, or t
  misc_feature (9)..(10): n is a, c, g, or t
  misc_feature (14)..(14): n is a, c, g, or t
  misc_feature (56)..(57): n is a, c, g, or t
  misc_feature (82)..(82): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (99)..(99): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (140)..(140): n is a, c, g, or t
  misc_feature (156)..(156): n is a, c, g, or t
  misc_feature (158)..(158): n is a, c, g, or t
  misc_feature (161)..(162): n is a, c, g, or t
  misc_feature (165)..(165): n is a, c, g, or t
  misc_feature (177)..(177): n is a, c, g, or t
  misc_feature (179)..(179): n is a, c, g, or t
  misc_feature (216)..(216): n is a, c, g, or t
  misc_feature (256)..(256): n is a, c, g, or t
  misc_feature (274)..(274): n is a, c, g, or t
  misc_feature (284)..(284): n is a, c, g, or t
  misc_feature (364)..(364): n is a, c, g, or t
  misc_feature (366)..(366): n is a, c, g, or t
  misc_feature (377)..(377): n is a, c, g, or t
  misc_feature (407)..(407): n is a, c, g, or t
  misc_feature (412)..(412): n is a, c, g, or t
  misc_feature (420)..(420): n is a, c, g, or t
  misc_feature (510)..(510): n is a, c, g, or t
  misc_feature (525)..(525): n is a, c, g, or t
  misc_feature (527)..(528): n is a, c, g, or t
  misc_feature (541)..(542): n is a, c, g, or t
  misc_feature (547)..(547): n is a, c, g, or t
  misc_feature (549)..(550): n is a, c, g, or t
  misc_feature (559)..(559): n is a, c, g, or t
  misc_feature (565)..(566): n is a, c, g, or t
  misc_feature (591)..(591): n is a, c, g, or t
  misc_feature (613)..(613): n is a, c, g, or t
  misc_feature (674)..(674): n is a, c, g, or t
  misc_feature (696)..(697): n is a, c, g, or t
  misc_feature (699)..(700): n is a, c, g, or t
  misc_feature (705)..(705): n is a, c, g, or t
  misc_feature (712)..(712): n is a, c, g, or t
  misc_feature (717)..(717): n is a, c, g, or t
tcgngatcnngggnaattttgactaggaaagaaaattttaggcatacagatatctnnagaaaagtactaccttattttcccntnangnggaaaataatntgaaaaacaanttattanatntanctggacaacgagagganctaagtaactcccaantntanngcngcattacaagananaacatccctcaccacagtgtaagatttaagggcaacntgcccaaggatgcatgttatatcaaacacagcaagattgntgctgccctgccaagtanttccaatccntacccaggtcctactgaaatacgggtggtcccagttagttttattgaaataaatctttaaagaaaaagataaagcatttnanaagacaagtcnaaatgcatcaggaaccacatatccaacatngactntatcctcnaatgagttatgtttgcctcgcactaataacttttatttcactcagagcagtaatcttccatacataagtatattccctgccaataattcncagaaaaaaaatccnanntgattagtaaagnnaaatntnngaattaacnggcccnntaaatttgttttaaatattttgaanatttaaaaagtgtttaaagttngtaattcctagtaggaaaacattatctgaatgaataccctaatggcaaacccactgtaaantgcttcagctgcatttgggggnnanntcganaattccnggcancccgggggg

SEQ ID NO: 624858 - DNA, 364 bp, Homo sapiens
  misc_feature (272)..(272): n is a, c, g, or t
  misc_feature (294)..(294): n is a, c, g, or t
  misc_feature (310)..(310): n is a, c, g, or t
  misc_feature (332)..(332): n is a, c, g, or t
  misc_feature (335)..(335): n is a, c, g, or t
  misc_feature (359)..(359): n is a, c, g, or t
attcggaacgagggaccagcctggccaacatggtgaaaccccatctctacacaaatacaaacattagttgggcctggtggcaggtactgtagtcccggctactcgggatgctgaggctggagaatcacttggacatgggaggtggaggttgcagtgagccaagattgcactactgcactctagtagcctggacgagagggcaagactccatctcagggaaaaaaaaaaaatatatatatatatatatacatatatatatatgtatgtatatntatatgtatgtttgtgtgtatntatatatgtatgtgtntatatatgtatgtgtgtgtgtntgntgtgtgtgtgtgtatatatatatntatat

SEQ ID NO: 624859 - DNA, 401 bp, Homo sapiens
atcatagctgactcttgaggataaacagcgggcaggatgccacctcatattctgaatggaaagaacataggggctgaataaatcttcagccaggtgcttgccgaccaacttagaggaacaggggagcgcacatattgttcatgctattcgcatgcaagctaccagacgctttgaagagatgtaccatgctatatcaagcaaagaaaatgccaattctcagccaaatgatgaagaagcctcctctgatgcctactgctttgagctgctctctatggatttagcactgagtggctctaacggtggccgtaaatatctggatcaacatttaacacatgcttaagcactattatattcaaatgacatgcttgctatgcaaaatcataagctcagaacctgtattg

SEQ ID NO: 624860 - DNA, 822 bp, Homo sapiens
atcgcttgggcctgggaggtggaggttgcagtgagctgagatcatgccactacactccagcctgggcaacagagtgagactctgtctcaaacagaaaaaaaaaaaagaagaagaaaggctgaatagtaatagagctaagcattcagctcaaggaaatggaaaaatagaaaaaccttgaaacgaataaaagaagcaataaagagaagaatagaaataagtgaacatagaaattcagaaacatcagaatcaagaagtgggttctttgaaaaggccaactagaaatcgatacacttccaatgaaatggacaaaacacaaggaagagaaacacagatagtagtaggaatgaaagggaggtacactgtagatcctggtcgattgaagacattgaagatccggtctggtgaaataaatagaagattattttggagaaaagaaattatacccaaaatatattaacaaattatagatgaacgaaatttatagaatacaagagaagaaagttggacacgaggaagaaatagaaaacctgaatattctcataacgatttgggaaaagctaattagtaattaggaagccttcgctacaaagaaaatccaaacccgacatgacttcactggctagtttctaccaaaaatcttacgaaaaagataactgccaatcctaattatccacggtggcagagaatagaaacaaggttataacctccaattgtgttttaagaggctatcatgaatctgggtaccaaagctcagtgaagaccatacaagacagaaaatttgcaggccagtttgaaaatatagatgcaaaagtcctaaacaaa

SEQ ID NO: 624861 - DNA, 993 bp, Homo sapiens
gcctgaaatctgcgcaggagttcccttggcggatgtctctcgacctcacctttcgagacgcagaaactcgagcctgatgtacagcggtcctagcattagctctcgccatggctctcaggcgatgctgacgtgcagaacgcagatcaagcatatgatggcttgcaattgaacaagaagccaactgagaaatcggaagaaaagtgggatgctaaaggcagaagaagagttgcaacatagatgaaaggtccggcttgtgttgacctaaagactagagattatggacactattgatgagaagaagagagaaatcggattgagcatggagaagaaaattcagatgtagcaaatggagagtggaatcaacgtgattactctaacagtcctcagggagcaacgagatgagctttatgcagcagaactactaaatgatagtcaaatggagagctcagcaaggtggtgacacagatacaagccaggtcatgcaaggtgcgtgctggatggactggttctccaggttttggtatccagttgctggagccccgaagtgattgtcgtccggagtgacccaagatttccctctggtcacggctgctgtggagaaggcaattcctatgtacaagatcgtgaacaaaaaacgatgttgatgtcaaattgagcaggagtcctacctgtcctgaagaacatagctggtggcagttgagatctatcatgggatcgtcaaataaaggtttccaaacacctggaaaaggcggctggatctcattagcccaggagatgatgcgagaagtcgggggagctagttgtgcaatgccaccagggagtttggcatacgccttcaggaggcggagtcgtcacagcctcctggtgcaattggaactttcgctttgaaacaaccatttcctcctcactccactgccagtggtgattctaaacagccttctagcgcgcactgtaagtgggtctgaccgccccctctacgaacccgtccctggg

SEQ ID NO: 624862 - DNA, 244 bp, Homo sapiens
tgtcagactgcaggccgtcaggactaccagctccgaaatcaccaccaaggacttaacaggagaagaaggacgttgtggaagaggccgacaatggaacgacgacgcccctcctaacgggaatgctactcaggaacatgtggcgcagtgatctgacaattgaggtagactaagacataggaagaaggtcgggaaggaagaggaggaggcagacagaaggttatggtaaggaaggttgctcatggcg

SEQ ID NO: 624863 - DNA, 879 bp, Homo sapiens
gaacacactccggctgcagcagcggcatcagctagagagctacaagcagcagaaaaaagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtgggctaacaagcacgtgtgctgttgtgccgggagaccccctgtgggagatccttatatctggggtgctgctggcgcgtgggaatgtggctagctgcgtggggctggggcagcagcgggtcctgccggaggggctgtacgcccaggacaaggtggtgcgcaacgaggagcagctgctggcctgctggaggaggtggagttggatgagcggttggtgcaggtgctgcgcaagcaggcggggctgctgctggaagggggtcccttcagtggctttggggaggtgctgttccgggagagcgtgccactgcacaccctgtgaccgatacctgtatcaccgcaactgatgcctccatgaccggacctggctatcggcctcgcgctgagagctatgaggctgccaatacggcgacagacatttccaatgctgggacgaactccatcacaggaccagtggactccactgatgaagcaacccggtacccccgcggttcatactgagcacactggggaacccgccaggtgaaggcttccaccagttgcggcgcacgggacaaccaaggggtgacaagagatgggtccatcagaaagatcaacagacggcataagagcgagacgccacatacagcacccgcagagcaacaaaaccgtgcgcatctgac

SEQ ID NO: 624864 - DNA, 1796 bp, Homo sapiens
gcagtgtaggttacggtcggatggctggcggcggcggcgagccctggggtgcgagtcgcggacgggaacaggaaaagccatccgtgcgagcccctgcgtgtgctgtgtgtgtgctagcctactgttctgcgctccgatggtgaagcctgtgcgcggagaggcagcggggtgttttcccctctgtccgtttcggcgcccccgacacttcctttcagtttcgtgcgccgcctcggctcggaaagttggcggtttgacggagcagatggcgaggcagccggtgccccgtggccgtgttgcccgcatgctgcctgcggggggaccgtttctgaggttttgggccggctggctaggggacgaactccgttgcatgagggactgtcgcggaatgccagccgggatgccctagtgaggagactccgtgagaagaagtcgtcacagacgtgacttgatgcggtgcgcacaccaggaaatagacggtgcagaacaacgtaggtaaattgggaccttttgcagggtatatcaaaaaaggccaatagtatgcaccagaggggcaccgacatcgagggacaagggacgtgactcatttgaacgcacgagaggccgtttgcaacaggcaccggcagcaagaggcaccagaatggataccatgagaggcggcacatggacagcgacaaaccacgtgggacatgaacggggcaggcggaaacagtagagggccccgtcaccagtaatgggatagtgcaaattccgagaggatgagggaccacacagtgggtgcacggtgtatgcatcggcccaggtgcgggaggacgagcacggaaaggacaagcagcatatgacacagcgcgcgccggacattcacacggagtagccggtgagctactagacgagtgatagagcagatacacagctaatagcggtagccaaaggggcctacgccgtgatagccggaacctttcagtgaaccatccgtcgcactgagcgagcagacacgacaaaccgtgtgaatgcagccgtgtatccaacaacacctcgtacgtttagacaccctgactagcgagagcaccggagggcggaccagcgaataccacacgagcagagaaggcatagggagaagagccaaaggagcaggcagtatggaccgcacacccgtgcgtgacgatgcacagagccaccgggtcacacaaagaaagagaggacacaagcaccaccggtgaccacgtagccaaatcacacaaggtagaacacgatgacacgagaccctgggtgtggagggaaacacggcacagccctatgaaaacgccacaaacatgtgagtcgcatgaccaagcatgagacacgagaggagtgggcacacgaacacacgacggcgcatgagccgtgaacaagaacagacaggcacagagacgattgataatggcacgacccgagcagaatcactacccaagagaggaaacgggggagctataggggacaccaccacagacaaacaggcacagtgaaaggaccccgaaacctccagaaaataacgcaatagtagacacaacgacacaaacccaacacaagagacctcgacacaagagcacaaagaacgacaagaacagtgcaggacagcaacacagaatcaaacagaggaacacaaaataacacagacaaaaccacaaagacacaaacacgaccacagcgagacagaacacaaaaaacaacacaacaacacaccaagatcagcacagcaagagaaaagaaaagcagaccacgcacaagaaacagacacgaacacaaattcaacacacagg

SEQ ID NO: 624865 - DNA, 209 bp, Homo sapiens
  misc_feature (40)..(40): n is a, c, g, or t
aagaaatactgattttatttcaaaaaaaccgaggcatagnttctgactgctattctgcaggcttttggaactttaggaaacagtccaggagggctccagtcagacccaggaatgacaccagccacacttgtaactagcagagataacctctttgatcttcagcgattttaaaagttcttcatcctaatttctgtgcccttttcaaggta

SEQ ID NO: 624866 - DNA, 342 bp, Homo sapiens
ttttttttcccttctttttcccggtgccctttatttttcatccattggctcctaactggggggaggcccccccttttggtttttcccaaactggcttctggtttggggttccttggccccctccggccccttttcccccctggattccaaggcccaggaaggggggggagcttttttttccacccgggggttttttggtggctacttccaccggctttttaaggagccgttttttcccccggcccttaaagttattgaaattgaattttgttaaggccttaaggaaggaaaaggttaagggaaaacttgaagttggaaaggaggaggttaaaagggcccgga

SEQ ID NO: 624867 - DNA, 620 bp, Homo sapiens
  misc_feature (7)..(7): n is a, c, g, or t
taagtcntcatttgatgcctaaatactcagttagtctttgaattcgaatcttcgagtcaatcttatcacttgatgctctccgtacagatcaagtgtatcagcatcatggacaagtctgcttctaacggtcgacaaagttgcgcagattgtagatctgcacactaaggtagacgccgtttatgtgttagcatttcctacatcagttctaacattctactcactccgacagccagtaatgcacgttgcaacatatctaagatggaacacatgatcacatggtgtcaggtcctatggtgataatgagatatatgtgatgtctctagcatagacttggtagctagcttaatgcgcttgatatggcctatgctggattatggcaacaaggcaagcattggactcggtaggttgtgccagctgagctcagatggctattagcggtctcgaggctcacacttgtccctcgagtgtcatgtaagccttctgggcagtgaacatgatcttagattagacagtgttgaaaattggtaagctatcatcaagagctgagcggagagattgtgcgattcaatacaagcacattatttaaccaaagtaggcacataaagtcaatatgggtttac

SEQ ID NO: 624868 - DNA, 486 bp, Homo sapiens
tcctatcggaaccaatgagctccggttctgaagatggcttgagggtgttgcccggtagggtagtgtctgcagggcaccttgtgcatctcccctctcctccatcagctgggagtgtgggcagcactggagtggggcctgtgacatggaccctggggtgagaggctggttctttgggtatgaatgtcagtttttgtttacaatttctcaccacccacaccaaagtcctaccactgcctgtacctatagcagagagatcgtggtgtgtgtgctactcgcatgtgttggcggtaccaatgcacggaggttggataaatggggtaggaacgagagagtagcctgggaatggtggtcctcagggctgtggctgccccgtcacgttcttgtccttcgtgggagtggattggtacatgggctgctgctgctcctccatgtcctcattatcctcctctgtccctgagccccggtccacctcggggtacacgacca

SEQ ID NO: 624869 - DNA, 234 bp, Homo sapiens
agtatcacgcgtgttcttaagagggagtgtattaagcgggtagtagatgttgacctgtgatcacgcatggactgcaatccatgggtacagctgtctttggttatgagggctggcttgctaggttaccagcataccttagacagtgccagatcaaagctgacaaggactaacttagcagtgggctacaggactggggacttccagctacacactaatgtccatgatgggtaccga

SEQ ID NO: 624870 - DNA, 230 bp, Homo sapiens
ctgtcaatcattggctaagggctgctcttgggcaacataaattcccaggtgcttctagctctccgtgcattcagagaaagtggattccaatattctgaggctgttgggagtgaaagcacatgggaaactggtgtgcacaaaatcatcaagggagctgaggggatgtgggagggcactgacagcatctgctgctcaggttcattgtaaaacattgtgacaatatggaaaaa

SEQ ID NO: 624871 - DNA, 184 bp, Homo sapiens
cgacttatgtacatcggtcctttcccagactagatgggacggcatatgcctgactgcgaggtgatcgatgacagggaagatgttaccagatattaaatccatggagtagtgcagacacgacagatatctggaacgcgattgacgccgacaaatcgggacaatcagccagaaaaaccagcgtctc

SEQ ID NO: 624872 - DNA, 135 bp, Homo sapiens
cctacaggatcctttgtatccggggagagagtcagcctctggttagactgcagtaacactatatctgacaactgactgaagttcactcaggtcacaccacaagctgaggcccagtggagacaaccaatgtttcag

SEQ ID NO: 624873 - DNA, 215 bp, Homo sapiens
cgactgactcctggctatgtgatccttccacctctgcctcccaaggtgctgagattacaggcgtgagccacatgtccagccagctcccccccccccccctcgccgtctttagggattactatatataagactatgtcatctgcaaaaagataattttacttcttcccttccaatttggatgctttttttttcttgactaattgctttggctagga

SEQ ID NO: 624874 - DNA, 845 bp, Homo sapiens
gtgatacaccagccctctcggaggggtttcggaccgaagggaagaagctgcgccgtgtcgtccgcctccctgcgcgccgcgcggcacttctcctgtggctctccccgaactctcccgcgacctctgcgcgccctcaggccgcttccccgcctgggctcgggacaacttctggggtggggtgcaacagaaagtttgcggctcctgccgccggtctctccgctcttggcctaggaggctcgccgccgtgcccgtcgtatcggccttgcccgggaccgcgtccgtgccccgagaccgctaccatgaacaagcatttacatcggcaacctcaacgagagcgtgacccccgcggacttggagaaagtgtttgcggagcacaagatctcctacagcggccagttcttgcgtcaaaatccggctacgccttcgtggaacatgccctggacgaccactgggcgatgaaggccatcgaaacatttctccgggacaagtaagaatcacacaggaaacacgcttacgacgatgacacactacggagcccaaaacacacacaggagccggagcacatccaaatccgaaaggattacagcaccagctccgatgggaagctacgtgggacaaaacagccggcaacaggaaaggcaacagaaccagaacctgtgagccaagtgaaaccacgagagctgaagacggcagtgagtgaatgtcaccctataacaacccgcgaccagaacaggccaagcgcatccagcagctgactggcaccaattggagaaccatgccagaaggacacctacatcccaaatgacaaatcacaccgcacagcaacggcccgaggagccgaaccg

SEQ ID NO: 624875 - DNA, 1112 bp, Homo sapiens
gacccgtcatctactctatcatcttatgtcaagggcacatcctaatcaatcagagctcacacgcatcgccacttgaatttatctacccgtggatgtaaggacctatacaataacacatgctttgtgctgttctagttctcgaagttctacaccatacaacaataagacctcatcgttaagaccatagagctgactatacacagtatgtcctcaccagaatcaacctgcaattcagtacatccttacctacgtagactggtccactttcagagcatagatatactcctcgcgtaaccaatctagaaccaattaggcagcctatcaactcatacttaaatactcgctcacttactaactcaataagtgggcgatagtagctaatatataaccggatgaattatgctcctcacttacaacatatccttgaaatccctacgagggttactcaacggtgctcgctctgaactatccaggcacgtgctttcattacgtcgccaattgaccaacacacaggtagaccgcccaatctattaaaatccatagtagcgcgagaatctcgtcccttccccataatttagtaagccgtctctctcacttcctcttcgagagaccttgatcctatctattaagccagaggctagtgagagggtcggacttcaagtcaagaaacgaagcaacgctaaaactcgatacgtatactctcttcaattacaccaacaatacggatcgaaaaaaatggccagctaatacacgacaacaccttaactatatactcagttactgaatatgagctatttatatcatcttagaatactactcgcatttctgatatcaaatttaaacatcccattatcacagacctatgaatatctcgggactgtaaccactggcattaatgactaaatgacattaaatccatatactcctccatgaccttaagagggctggcccacgaataaagggtatttgcccatggggccatttcgcaaaaattaggacggaaaatagtttcaaaagccacaaatatgcaattgcttattactttaatgtacttaggctaattatcactaataaaataccctcttccgataaaaaagaggtgtttaaccacc

SEQ ID NO: 624876 - DNA, 866 bp, Homo sapiens
gtctttcccaactgaggtcatccattgagcagaaagttctatggacttctgaacaatatagctgaagtacagggaattacatgctgaattcacactgtggacaagattttcatagaccacagtcacgtaagtcatccatacacagtggtggtaagtggaagtcacgtggatcttgcgagtcgtgtgcaatcgcatcgtccagttgtagatatccagaggtgaccaagcttggagattgagttcgtaaccgagaggaattctgctgctgcgcatgatgtgagccatttgcaggctactgatggcacatatcgtgacgaagctggttcccacgaggttgctgatggatggctaagcaggtatccagggtcccttttacaatcgcgaggtcttatacagcctagtttaccttaggggtcgtggtgtagtccagctaaactacactagggcatgtatgcattgccctattcgtgggcaggtgtcgcggggtcgcaattgcgaaacgaatgtactagtcatgttacagacattcccttcttcacagtggcttattggcacgcatactagcttccgaatttcgagatgaacgggaggggcatttggggaagctatcagagtaacgagcgattctagaaagcatttccagtgcaagcattaacttggacatgccccgcaattgttcccaagtcgaggaacatgggcctgatatggtgccatatttcgtgagaagtatgcgttataagagaacaagaactacaacttaaggtgacggccaatgggcgaagggcacaaaccttcaaacggttttacaataaaaacaagactcccataggccaagaagattagcctttgcatagtgcccagttaaa

SEQ ID NO: 624877 - DNA, 382 bp, Homo sapiens
  misc_feature (9)..(9): n is a, c, g, or t
  misc_feature (49)..(49): n is a, c, g, or t
  misc_feature (134)..(134): n is a, c, g, or t
  misc_feature (201)..(201): n is a, c, g, or t
  misc_feature (258)..(258): n is a, c, g, or t
  misc_feature (276)..(276): n is a, c, g, or t
  misc_feature (376)..(376): n is a, c, g, or t
aaaggatantgatgaactgatagtttatctagaataatgtttattttanattttattttattgagacagggtcttgctctatcacccaagctggagtgcagcggcatgatcatggctcactgcagcctcaaccncctgggttcaagccatcctccctacctcagccttctgaatagttgggactacagggtgcgccaccanacctggctaattttgagggggtagaggggaggtacagatgagatctcactgtgttgnccaggctggccttttgcncctggactcaagcagtcctgcctcagactcacaaagttctggaattacagatgtgagccactgtacccagcctgggcgacagagcaagactgtctcaaanaacaaa

SEQ ID NO: 624878 - DNA, 377 bp, Homo sapiens
ttattgggaggataatgggaggatcgtctgagccggagctcagacagctgagcaacagtgagactcgtctctattttttcctattataaaaaatttttcattaaaaaaaattactggtcttctcttgcgaacaatttaaatcaatggatagagaacatccaaaactaatttggatggccctcctgggagatcttttgggtccgaaacttgtcttagaacaaaattaggggctaaggtgcactggctcatgcctgtgatccccagcactttgggagggtcgtggagggtggatcacttgaggtcaggagttcaagaccagcctggtcaacatagtgaaaaccccatctctaactaaaaataccaaaaattagccagga

SEQ ID NO: 624879 - DNA, 181 bp, Homo sapiens
tggaatgatgagccttcgggcccccctttccccttttttggtcccccaactttgaaatgtgtttgaaggcttttgggctcctccctgtgggagtgtgggtgtggaggcagccagggctttacctgtgttacacgtgactttgaaaccagtttgaattaaaaggtgcacacctttaaaaatt

SEQ ID NO: 624880 - DNA, 134 bp, Homo sapiens
ggacgaggaaggaggcaactggctttggagaaaacagcgggcaattagaaaagcggttaccagcatgtcagcggacagctcacttctactaaaaagccccccaagaaagcgaatgagaaaacagagtcatcctc

SEQ ID NO: 624881 - DNA, 821 bp, Homo sapiens
  misc_feature (14)..(14): n is a, c, g, or t
  misc_feature (45)..(45): n is a, c, g, or t
  misc_feature (318)..(318): n is a, c, g, or t
  misc_feature (529)..(530): n is a, c, g, or t
  misc_feature (565)..(565): n is a, c, g, or t
  misc_feature (621)..(621): n is a, c, g, or t
aatgaaaggagggnaggaaagggaggggaggggagagggaggggnaggaaagaatggtctatatgcttctatctttgcttttgcccctgtggaggttttaagggccaaacagaaattgaagtgaattgttctactgcagtgtctgacaataaaactgttacaggtactctttggttattcattctcgttagaacgaggccccatttcatataccaccaggtgcaaacatataagacgcataacgaaagtatttcattcttatatgaaattaacaatattctgacaagttatatgcgaccggtcacactatttaggagnatagactgccaatctgccctagcacataacaaggccacccatcaaggtcccccgcacacgcctccaaagaccccctggagcactcaccatctcacgccaccctcccacaataccccgccccccccgaaatcccccgctccactcaccccccgccaccccaccccacccccctccccacccctccaccttcttccctattcatctctcggcnncaaaaaaaaattccaacccaactcctccctcatcntaacccaccctccccccaagttcgcccgccctccccatcacccacagcccacaccnaaatttcccaccctccaatccccctcctccccgcccccctctgtcgcactactcgcacaccaaaaccccccgacccccgaatccagaaccaccacacgacgctcaacccacgccaccaacgccattatcccccttactccccaccattgtctcgcccccccgattgctgtcctattttttttgctcaacctactccttct

SEQ ID NO: 624882 - DNA, 208 bp, Homo sapiens
ttctggctttggcatatttatggcagaatgtttggccttcagtgttttgaatgtggatggataggtggctgaagctacatttataaagtgtttgggactgttaaagtttcctagccacttggagaaagcagtgtgtttatttctggctttgttcttatttagcagccttagaatatttatttttccaaatttagtattcttctgatta

SEQ ID NO: 624883 - DNA, 176 bp, Homo sapiens
agtttggctggggaggggggcagttttaaaggcttccccttggtgttcctcaaaatgatatttcttactccgggggccaaggtaggggttagcttttgttctctttgtagtttaaaatggatctcctgccctgttcaagttcccaaatctttttgtgtatacccatatgtacatta

SEQ ID NO: 624884 - DNA, 609 bp, Homo sapiens
  misc_feature (517)..(517): n is a, c, g, or t
  misc_feature (539)..(539): n is a, c, g, or t
  misc_feature (567)..(567): n is a, c, g, or t
  misc_feature (585)..(585): n is a, c, g, or t
  misc_feature (603)..(603): n is a, c, g, or t
gactggttcaatgccctccgtgcagcccgtctgcagtacctaaaaatggccttccctgattagctatttaataactaacgtccttaattctttttcaggtaaataagggatttctttttggtttggttgtattgctggtggctagtgtgatttttttggggggtgttgaagagccttgttttcttatattaccagagttgggtttctggttccttctcatttgggtaggctctgtcagagggaaggtctagggctgaaggctgttgtttagattattttgtcccatgaggtgttctcttgatgtagtactctcccccttttcctatggatgtggcttcctgtgagccaaactgcagtgattgttgtccgtcttctgggtctagccactcagcaagtctaccaggctccaggctggtactgggggttgtctgcacagagtcctgtgatgtgaaccgcctataggtctctcagctgtggatcccagcacctgttctggtggaggtggcgggggatgcantggactctgtgagggttcttanctttggtccgtgctttgcttcttattantattaaattttggcccanttcctgcaggctaaccanaaacat

SEQ ID NO: 624885 - DNA, 102 bp, Homo sapiens
agaaaagacaaccaaccacccgaacaaagaacttgatatcactaatagggcgctagggttagagcgaacgaccgagcgcaggagttttgagcgaggaagcgg

SEQ ID NO: 624886 - DNA, 1004 bp, Homo sapiens
gagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcacttgctttcattttggaaacatgttattaaactatggtctctttcaaataaatagtagttttatatttcaacacaagttgctataaagcagtccttgatggggttttgattgcatcaggtggaaaagcctcaaatcttaagagggtttccaatcctaagatatacaattagggtggttggcctaatggcctgtgccttataacactctgaccaagcgaaattgaaggacactttttggcaaaatgcccagaatggttaccgattcatttcaagtgtgctccctgggccttttatgggcatgggtgggacaggatttggtcaattttctaaaattaggcttcattcaatatttatcatcctcctttccctctctgagaatgaactatgtataaaataagcttctgcctattgcatttatcttccaaaccaatctagtaggatggtctcattttaaaaacgaggggaaaagaccaggagtttatcagggagaaactgggcgaccattgtgcaccaaaaactccagaaggccagtatttccaagcaagttacatagattaacaaccccaatgtttgcctccaagaccgttgggctgggaaatcatccgggaatttaacccttcagaattgtgacggccttttctgggcaaagcatttacaggtcgttgttaaaagccgattcccgaacaccttcaactgacatgggatacatgcacccaataaggcgtggtcaaacttcttacaccttgcgcaccacgtgtttcgttcaagggccacgttctac

SEQ ID NO: 624887 - DNA, 180 bp, Homo sapiens
gtgaacagagacagaggaacaaacatccaattcaaagtctgtttatcagagcatcttgttttctgaaaatgcacagcggcactttcattcaaataacccttcatctgcagacctgcggaagggaggtggcctgtgtcccttccttctccctaacatagtttattttggcccttatccgag

SEQ ID NO: 624888 - DNA, 132 bp, Homo sapiens
ttggcaggctggtctcgaactcctgtactcaggtgatctgcaccttggtttcccaaagtgccagtttagttttttaaaacggctttaccagatcatgcgagaaaataaaattacgagggataattttgcgtg

SEQ ID NO: 624889 - DNA, 632 bp, Homo sapiens
  misc_feature (403)..(403): n is a, c, g, or t
tcctaattttactttaatataattagaaataaacctatacaaacaagcgactaaaacaatatttcccaaaaaatatggcacgggaagaattttacaacatatatttataaaatggaattcaattggtaacaaaaatttattataaagtctcggtttttctggattctctatcaaattaaaatccaatttattttatttcatagttttaaaaataggccaaattatctaaataagccaagaaaaatataatatctaagtaatcttcaagctagtagaacttttctcaccaaaattataacaaaatacagcgtttctcgagcccccatatttataaagagtggttacctttctccttttttgttggaagaagtgggagtgtgctcgcttcgtgccaacccgaggncgtgtagtgtgccaggtgcggtgccgttaactccgcgctctccacgtggcaaccttccggccttcccgggccttcaacgcgagatatcttccgggccttcagccttcccagagcacgccggggactcacagggccgcccaccaccacggcccgggctaaatctcggatatcttaagtaagaagacgggggttcaccaatcccgggccagggctgggtctttaacacctg

SEQ ID NO: 624890 - DNA, 929 bp, Homo sapiens
actcctgatctcatgatctacccgccttggcctcccaaagtgcttgattacagctgtgagccatgtgcccagcctatttgtcacatattttatctttccttatgttagcttattagctttatttctttattgtccttttttttttttggaaatgaagtctcgctcgtgtctcctaggcttcagggtaggtggcacagctctcaactcacgtgcagcctttgaccttccttaggcctcagggtgactcctttccaccttcagtagttggggactattaggcacattgccacttatgccgtggccaattattttattttttttatattttatactaaagaggaggtctggcttggtattcttaaggctgggtctgggaactcctggggcctcaagcaatcccccaaccaccccttcccaaagtcactgggtattataagctatgagccaccatgcctgggggtatctggtgtctttcccaattatatttatagagttacttggtctttaactaatttcaagtgactcgtgtaaatctttcatccaacttttacaacctgataactcctttcacactaagttgaaaaatgtccttcactctttaaacccataatcttgaggaaactaatggccgtgtgagaaacatgggccatatccttccaagaatacgtacatggtgatgtgaacatccttccatattgtcatattccgtggcacatttggtgccaataccttatgggatcctatcttaaatccctttatcaaggagtgtggcataatacttgcatacatatgagactggtactcacaatttacccagttacccagatacaactgtgctggaagccaataagggccccattctacaatattggtgagagcccctagtatacgtgaaaattaacccccctaagcaaggtgttgacgcacac

SEQ ID NO: 624891 - DNA, 128 bp, Homo sapiens
agcgaattggcaccaaagcagcagctgtattgccgcagttcttagctcacctcacgatgttcccttggtcaaagcgcactaatcgttccagttccgagcactcagcacacatggcagcgacaccagaa

SEQ ID NO: 624892 - DNA, 291 bp, Homo sapiens
acaatatgacagacacttcacaaagaagatatgtggacaacaactaagcagctgaaaagatgaccccacacagtgagtcaccacggactgccagtgaagggccccgacacacctgtaagattggctcaaaattcaaagcaccgacccacaccaagtgttgcacaaggcagcaccagcaggaactagcagcttgtcgccacggcagcatgcttggcacttgccaaaagtggtgatttgcttgctttcagcaaaactggttttgtccagttgtcactagcaacagttgacagc

SEQ ID NO: 624893 - DNA, 339 bp, Homo sapiens
cagagaatgtttttttacatgaatgaacagattaaaaatggaataatatggtcgggtgcggtgctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctcaaaaaa

SEQ ID NO: 624894 - DNA, 269 bp, Homo sapiens
gcttgtgctatttgagctcagatatgcaggtctgctctgggccacagagcctcacaaaacccgattgtgagttatagagcagcagtgccccgtcacagctgtgtgcagcccagcgtgcagctcgaggatgaccgagacctttattccgatggcaaaatcaaccagcgcagcattaggggcgctagtgcttgggcagctgtggctccacgccgtgatcatcccgagccacttatgggcagcattgcgagcatgggcatgtgcatttgctt

SEQ ID NO: 624895 - DNA, 995 bp, Homo sapiens
  misc_feature (928)..(928): n is a, c, g, or t
atttggcccaattaagttaggggacgaggggccgtcgccaaagggagaccgctcaattggcgcagagaaggcaaagtcgtcaaattcagtattcctgcagattcgtcaagacagtccggatgcaatcataatcgcggtttgccaacccagtggacattcttacgtatgttactggagaactaagtggattacccgagacaccgcgctgattggaagatggatgtaatctggagctctgctgagatgttcgctaccttacggctgaaaaacttggcattcatcccagcagctgccatggatggattttgggggaacatggtcgatctcaagtgtcggctgtgtggagtggtgctgaatgtggcaggtgtttctctccaggaattgaatccagacaagtgggaacggacaatgatagtgagatacttggaaggaagtgcataagatggctggcttgcaaagtgcctactgcaagtcatcaagcgtaaaaggatataccaactgggctattggattaagtgtggctgatcagtatagaatccatgttgaaaaaatctatcaaggattcatcccgtgtccacaatggtaaaggggatgtacggcatctgagaatgaagtcttccgtgagccttgccatgtatccttcaagtgcccggggattaaccagcgttactcatacccagaagaccaaaaggatgatgaggttgctcaggctcaagaaaagtgcagataccctgtgggacatccagaaggacgctaacaacgatcctgtgacctatgtgagctctgacggctgtagcaatttcaaaactagcaatgtgattaagctcgagcctcttagtcttgagtctatgtacatggataacagtgtcgcttgatcttcttctatatgtgatttggctacagattcaagccatgctggttaagctangccattaactcaccgtcgggttagaacatatagcacttttttgtttgcctttgttttcttgtcttgt

SEQ ID NO: 624896 - DNA, 153 bp, Homo sapiens
cacgaggtgatgtgaggtgatctaagatctacaagtcaggacagaattccgtgcacagtcagtctctcgttgctaggttcgtggcacagtcctctcgttgctagttcgtggcacagtccttccgctggcacagtccttcgctgtgcacagtcc

SEQ ID NO: 624897 - DNA, 107 bp, Homo sapiens
ctcgtctggtggcgggcgttcttgatgtttgacctgaccgcgcggggtccatggcctgaccacgtccgccccgaccgcgatgggcagccacgcatatccatcatgtc

SEQ ID NO: 624898 - DNA, 965 bp, Homo sapiens
  misc_feature (609)..(609): n is a, c, g, or t
gaaaaaaagcttgacattactgatctgacatgcaaattaaaaccacaatgagataccatctcacaccagtcagcatggtgattattaaacaagtcaagaaacaacagatgctggagaggatgtggagaacataggaatgcttttacactgttggtgggaatgtaaattacttcaaccactgtggaagacagtatggtgattcctcaaggatctagaaccagaaataccatttgacccagcaatcccattactgaatatataccccaaggaatatacaatcattctactataaagacacatgcacacacatgtctattgcagcactatttacaatagcaaagacatggaaccaacccaaatgcccgtcaatctacaggcatgagctgctatgcccagccaagtcgatttatctcaaaagtagctcagtatatacccaaaggaactataaatcaacttattctatctcataacagaaacatgcacacatatgttcatgtgccagcactatttacacatagccaaagtcactggcaaatcagccctaaatgcgcatcagtgatagtcctggaccaacgaccatgtggcaccatatacatccatggcaatacnttattgccaggcttaacacaggacatgaccatcattgtcctttgccaggggcacatgggatgaagcccagaagccatcgttcctcagccaacacttatgcacggacacagaaaaccaaaacacccacatgtctctccactcccttaacgttaggcgaagttggcacccagggacagcacccaccttgggcactaagggaagggggcaaccattgacccaacagcgcgaccttcccggcagataggcgcgcgtcacagggacagggaaacgcgtagggacagacatactcaactgcgataccaggggcctcaacgcccacgactgactcgcgtctcgaccacgcgccccgcaagcca

SEQ ID NO: 624899 - DNA, 281 bp, Homo sapiens
ctgtagctcatcatggtgacacccccgtctgctaggaatacaaaattagctgggtgtggtggcaggcgcctgtaattgcagctactccaggaacctgaggcaggagaatcgcttgaactggggaggtggaggatgcagtgagctgagatgtgccattgcactccagactgggccgtaagagcgaaactccgtctcaaagcacaaaaaagaaaagctacctttaccaaagacagttaaaatgatggaccaccaaggggacagtgtgcagcaggacaaacggg

SEQ ID NO: 624900 - DNA, 320 bp, Homo sapiens
  misc_feature (111)..(111): n is a, c, g, or t
  misc_feature (240)..(240): n is a, c, g, or t
  misc_feature (265)..(265): n is a, c, g, or t
  misc_feature (277)..(277): n is a, c, g, or t
  misc_feature (294)..(294): n is a, c, g, or t
tgggaggccaaggcaggtggaacacttgagaccaggagtttgagaccagcctggccaacataatgaaaccccgtctctactaagaatacaaaaattagccaggtgtggttntgggagcctgtaatcccagctactgagggaggccgagccaggagaatcgcttgaacttcggaggtggaggttgcagtgagctgagattacaccagtgctttccagcctggatgacagactgagactgtntcaaaacaaaagcaaaaacaaacanacaaaagatttntaaagagtccgccttgnctacagagtaaaggctgcacaacttt

SEQ ID NO: 624901 - DNA, 766 bp, Homo sapiens
taaaagcaaaccattgtttgtgtagtgttaagtacctttggtctatgggctcttggccagccctcccttttcccaatgaaagccaggtcaaatttaatcacgggatggacggcgtctcactcttttttattttttaactggaacgggttgttccacgggtggtaacagcaataagattggagatgacacactatggaaacttccgcttttggcctaaaacatacgccaagtgggaatagtattcaacaaaccttagaaagatttagttcaaaaggatggcctcctttctctaccggggacttttaacaaaactcaatgggcatctaaataggagttaattggtcttatagacccaggttctcactgtctaaaaaaatctcttgacttttaaaccttccaccgatgaggcagcgtaggaagataaacagactgactctcgtggactgtacttaaaagtactcatttttaacctgggtagggacggtgtgccatggggtacccggaccttatggagggtatggcttccttttaattgcatcaccttgttatctcaaagagactcggagcagtgatcctttaatcctggcaacggcttagggagccacaagaacagaaaaaaacacaaaacttgtggggccggcccggaaagcttcccaaccctcgttggcgcgcggcccacatgatagtactgccaccgttcagagatgggcatagaggtgggttccacaaacccggcacgcgttgacacaggtgggtggctacggcg

SEQ ID NO: 624902 - DNA, 344 bp, Homo sapiens
gctcggaccccctaggtatatgtcgtgctgcagatggcgtaggcagattccagtctgagtacacagagcgagaagacggccagtttcaaggtctgggaaaaaatcaacagtgagaggctgaatagaaaagattgcataataggcaggctaagaagcagcagcagcgcagcatggctcagagacggctggaagagtctcgctcatgtaagcagcagtcgtatgatatcaccgagaaggcaagaagataagctcgcacaaagtatcctttggatgagtcatatagtgcctgcttaatctggggggttacattcccagcctcgcagcggatgcgcgaaaccatggat

SEQ ID NO: 624903 - DNA, 843 bp, Homo sapiens
  misc_feature (674)..(674): n is a, c, g, or t
tgtgaaagttctctttttctagcagcagttaaaaatgtaaacacaccgttagtttcaaaagtttcattataaacatttgtgacattgtcaataacaaataggcatttttcctaaaaaaaaaaaaaaaatctgaaaaatcaaagcaagttagatgcagttttatcctaccgagggtctcattgggtacaagtagtatggtaaaacattaataatttcgggtattggggtcattctgggtttttgggtttgggtttgggtttttgggtgggtggtgggttttcccattgggttttcattcaggggttaaatcaaaagctgggcttcaaaagggttttttttccgggccaagtggttttttcgtggcagtaactaaccctggttcttccatcatggtttctggttcctggtagattctggtgttggttccaagaagatgggcagcacaacctctggaagtttttccttctctggtgcataacctaatgggtggtggcctggttgtgggccctctatttttactcatttttcttacataagtaagtatgtctcattgaaaaacacagaatggtcggaatttaaccagtggactgtggatctatcttcccttgattccacgcaggtgtcatccagcaaaccctccttctctgaggtcctctctgaagcacttaacacgntggatgaccttccaagacctttcttgtgtaacctgctgctcgtttggggtttctaccgggtcccttttgtgctttacccttggtttttattcaccaagtgctgagtatcttacctttatggacacgccgtgggtctcggcttttaacccttattcctggctctgttggg

SEQ ID NO: 624904 - DNA, 343 bp, Homo sapiens
gattttggaaaaccgtgacagcgcctacctcaccccagacctactgaattctgagtcttcaagggatggggccaggcaatctgcataactaatgcgctccctgaccaacgcttcagatgcgtagaagtaggggaccacggtgcctgggccaggtcagcaagagctgcctcgtacatgctggggtatcgtcatgtggagatgggaaggagaatgcaaccccaaaagcaggccaaaacctttggctccaacgccaaagcttgctacatctagggccccaaaaaaccattcctgagcgatgtgaactcatagacaccttcagggtgtgggagtacaaggactctct

SEQ ID NO: 624905 - DNA, 125 bp, Homo sapiens
accggtcctgaggattttacatctatgttaattaaagaccctgtttcctggcttccctcatcttccagttgtccctcagtctacctgggctctccctctatcctctctctcttccctcgcaaata

SEQ ID NO: 624906 - DNA, 470 bp, Homo sapiens
  misc_feature (89)..(89): n is a, c, g, or t
  misc_feature (141)..(141): n is a, c, g, or t
acgttcagcttgtggatggggcaaagaaggaggctaaggccaagggagttaaccttcaggtgcaggacgcgtcagacgacgccgccacncaggccaaccagcttgctaacgcggtatctacctcagccaaagtagttatcntcaatccgactgattctgacgccgttgcgccgtctgtgaaggccctcaataaggcgaaaatcccggtgattacggtcgaccgcagctccagcagcggtgatgttgcttccttcattgcatctgacaacattgctggtggtatcgatgccgccaagaaactcgctgagatcatgggagacaagggtgaagtcatccacctacagggaaccccgggtgcctcggcttcccgtgaccgtggtaagggattcagcgaggaaatcgccaaacatccaggcatcaaagtggtcgccaagcagactgccaattttgtcgacgcggccgcgaattta

SEQ ID NO: 624907 - DNA, 122 bp, Homo sapiens
cggtagtgtacataggtattatagtatacaatatacatgacgttacgccagctagatagaatagtacttatctcaacaaatgtatctagctggcgaaacgtcatgtacatagtatactataa

SEQ ID NO: 624908 - DNA, 671 bp, Homo sapiens
cagacgaagtatgcggagatgtgggcgcgtacacccaagccgatgttcggctacgcgggttccacggcgtcgccgcccacgctgacaccgttagtcaagccggatcagaccaccaaccccgggcgggaccaatccggagccgtagcgcaggccaccggcaccgccgccgggagcacacgcaacgcggttgcccagcaaccgttctcggcggtacccaacatgttgaccagaaccgcagtggggccaactgccgtcgacccgtcggtgacggacgtgctgggcgtggagagcgatctgatcacggtctttctgaacgggcccgccagcgtcgctggactcggcgtggtaacccccttcggtgcgacgactcttcccttcaacattgccggcgcgctgaccggtttccacaccgatgacatcgtcagcgggtgggccggtgtgcagtcctggccgggggcgggcgcggtgccgccatcgccattcccggtcatcacgaacccggcgggtggattcggaactctggcgtcagcggggctcggtgaggccaacaccgtcggcggcctgtcggtaccgcccgggtggacggccgccgccccggcgatacggccggccgctttggcgttgccggcgaccagcgccggcgccgccgcggaagccgccgccgcggccgc

SEQ ID NO: 624909 - DNA, 117 bp, Homo sapiens
cggcagcagacaacagcattatgcagagcagacgtgaaggagagatcttcattatgggcccatttatcattatgtgtacagggaagcgtgcatgcaatttgaaatcttcttaatggc

SEQ ID NO: 624910 - DNA, 257 bp, Homo sapiens
cgggatgttgtcgaacctatatgcactgtgaggtggtgaggtagagaagataagactgaaaaaaataggccgggcgcggtggctcactactgcaatcccaggaatttgggcggcagaggcgggaggatcactaggtcaggggtttgagagcctggccaacatggtgaaaccccatctctactaaaaatacaaaaattagacgggcagatcgcgcccctgcactccagcatgggcaacaagagcgaaacttcgttgtc

SEQ ID NO: 624911 - DNA, 396 bp, Homo sapiens
gttgggggcctcagggagggttcaactctgagacgagaactgccttggtgaaggcaagttcaagcaccacttgagaatgggggcacatggagaggggagggaacgggggaaaggtgaacctgaacttatactgagccagtaaacaaggtgacgggtgtgtaggtacacaccagaagatggagcactgcagatcagcaacctcagccccacctgggaatttgctggaaatgcaggctcaagccctcccacacctggtgaatgagagagcccagctgaccaagccagggactccatacctgaagctgggcatgctgggcagcaccggtgccaaatctggctggtggacagaagcacctggagagttggagagctttttaaaaagacatctctcagcac

SEQ ID NO: 624912 - DNA, 394 bp, Homo sapiens
gacttgggctgtgtcgttggacttcgtactgctaggaagctccgtagtcagcgacgagacctgaagtgggcatgataaaccgtataagaaagctcctttggggcccggcctaaagggccaccctttgtggggggtggcttcttcatgccaaagggatcgtgctggaagaagtaggagttggaggcaaacaggcaaattctggcattaggaaggtggttaagggtcccgcttgattcagaattgccagaattatcacagcctttgtaccccatgacggttgcttgaactttattgaggaaaatgattgaaggtctggttgctggatttggtcccaaaggggggtggccggtgggggaattcctgggagtccggtaaagggccggcttcacggggg

SEQ ID NO: 624913 - DNA, 845 bp, Homo sapiens
aacgtgttttctgtcgagtttggtccccccgcgcgatgtcgccgcgatccccgtgtggggtccccgcgtggcccaaagtgaccttttttcggtcttaggacaacgggtgccgcgtcttgcctgtcaagaagtggggcggtccccccattttttttagaccgtgcggtgacccgcccgctctatggggcgtgttcccctgcgcgcccacctctgtttggtttagggatgcttgtccaggaggcatacacacccacgggggcgcttccactggcggttgagaaacaaagcaacggccgaccttggcggggcggggtgaaccaacgccagggtagcaaaaagggcgtccaggcagtggttcggtcaagcagcgccacaagcgggccacgcaggacaactcttattggatgccttgtcgatcggagtgtttgtacgctcccactatttgccggccccgcccccctgctgatcatatccgcgggcggaggaacgccgcagtattctcgtatctggcttgtatcgcgatggcggcccactggatagaccagtattatgataaacaccggtcttatttaaagacataaacgaacacactgctgtgtgctcccgcccagaagggcagaagataattcttgttgcggcccactccttggagtattattctagtctgtcgagaggtgcagccttacagccagcaatggctattctatcaagaacaggcactatgttctagcgctgaagaacgctcccctgtccccgcacaggggtgtgcagcccgcagtgctgctgtgccccgggggcaaacaaatgaatagtgcagcataagtagcataaaaagataatacaca

SEQ ID NO: 624914 - DNA, 400 bp, Homo sapiens
cggtttccccgctgatacctgagcagcccccttgtcctcccagcacactcactgtcagtattaaggcacagcagcctgttaataagctagccctgcctcagagtgcacatgtggggacctgccagtggctctgctctgccgcacacagcggagcaccacccttgatggtcagagcagagccaccgaatgttgtaggctggcctgatttctgaggggcctaggaaagtgtccagcctggcccacttccttttgatgtgggagggggacagcattttgtacctggccactgatgcagcttagaaccatacccagataatccggcaaatccttcacaacctggaaaatgttgaaagcaaccattcctattttggttttttattaaatcttgcacaaaaaaaaa

SEQ ID NO: 624915 - DNA, 272 bp, Homo sapiens
  misc_feature (264)..(264): n is a, c, g, or t
cctgggtatcaagcgaggggctgtcattgccacggtatgaagaacaacagctacaagtttggcccggtggacctgctgtgctttcgctgggctggatctgagtacctcaagcttggttatgtttctcggtaccacgtgaaagacccctcacgccacgtcatcctaggcacccagcagttcaagcctgatgagtttgccagccagatcaacctgagcgtgtacgcatgcctggcggcttttaacggctgccgcttgaagtccacnatttcttg

SEQ ID NO: 624916 - DNA, 207 bp, Homo sapiens
  misc_feature (33)..(33): n is a, c, g, or t
ggtcgactcgttgtccgcagattctatattccnatctgcagggtctttagtagctcccccgccgcaagccggtccgcatgacccagattctgtctcgagccagcagatctctgaacggagtaggcaatcgttcccctacccaggttctttccacgtccagcttctttccatatccaggagttcagaatctacggctagaggtcgacg

SEQ ID NO: 624917 - DNA, 124 bp, Homo sapiens
ccgaaggactcagaagagaggacttgaggcatgaggtctggcctcttccctccccatctgagactctttctccattgctggctggggtctgtagcttggtgttattgaaacttctagaagtagg

SEQ ID NO: 624918 - DNA, 757 bp, Homo sapiens
gggcttctgctttgacggaggttatgaagaatacagtggaaacaaacctttgttcatcaaatacataggagaaggaacaccatcatacagtgatggaagaattagatgtggagatattcggcttgctgtcaatggtcgaagtacatcaggaatgatacatgcttgctttgtctagactgctgaaagaacttaaaggaagaaggactctaactatagaagcttggcctggcacttctatatagaatcaatgatgggtcagaggaaaacagaaaaatcacaaataggctaagaagttgtgacactatatatagtctgtaacgctttgtatttaaagaaagaatccactgtaaaaaagccatgaaaagtatgatcatctaatgaaagccagcctcccctcagaaaatatgattcccaaaaaagcgtaactactacttatttttgcagtgggggaggatttcttatttactctacaaggatagtttatatattctcgtatccataaaaaagccctaaaacaaccttaaagggatttggataccccaccggatttccaggctggtgtgaatttaagaattgcgcatatgctggaggtcgcccacgggacattatgggcctttttagtttacagctggaaaatttcttaaaaggcgcgggtagaaacggtgcttccataaaccggaataattttgtccaaagcaaaaaaaaagtaaaaatgggcctgttgacctcacgggggaaaccttgaggccgtttccat

SEQ ID NO: 624919 - DNA, 1349 bp, Homo sapiens
tgggtttcctgaccttgggctacggttgaccgtttttggggggtgtactccgtgccatcatgtgttccgctcctgtgaccgccgctgtgcttgcgtggggggctttgacagggcttcggcccgggggcttcccagtgtgccgccgcgccaagatctccatttcgtgtgccgccggagggagaagctggggactcatgtggaattgggccggtggggcttatacctctccgtgctttcgtgtgaacctttccttcctgtgccaggggggcgggaatccgtgttcacaacctgggaagaaccttacgagggaggcccagaagttgagaggggctccgttcttgctcccttcaacagtgtggtagacctgtgacacggcccccagcgcggcccattcgcgggtctcagtgttaacgtgacattttgggtgcgccgggcctctcccgcgtgggactcatgtgtgtcattctacaattctccagtctcaccttctttgcgtgaaaatctcatgtgaaacctctcttgtgaagtgctcttccgagtgcgtgtgcaccccctcctgtggggggggggctcagtagagaacccctgttctttgtggggggggggggcccccctctgttgtttaaacacattaaaacactcctattctaaaactttataaacaaaaacaacaaacaaacaaaaaacgctccagaaggggaccactcaaagagggcggggggggcgcggagacaaaaaaggggcggctaaaagaagaaacaggggggccacacaggtgcacgcaaaagagccgggtattcccgtgaagacaccccagagactttctttttgtgcaccacacacggcgtggacaaaaatccaagacagggaacccccccaaaaaaagggagaagacgccgcactataacacattccacaaaaacgccccgcggttaaaccccgactaagaaaccaaatggctcgacacaacaaaccacgacggccacgacgaacacaacaacggcaacacaccgagcaaacaacacaaccaagagacaccaagcacgaatgtgccaaacaaacaaaaagaactcacaacgacacacatcacaccactacaccataaaaaataaaaaactacacacaattccaatcacaaaaagaaacaccacaacaaacaaaccaagcagactaacaaacaacaccggagcaaagaaaaactaacacaaatagacagaacatatagggcaaaagaaacaaggccagcgggcgagaaggacgaaagacagacaagacgaggaagcaagaaaagcagcggaggagaaagaaaccgcaacagcaccagacagaaacacagagaagaaaaaaag

SEQ ID NO: 624920 - DNA, 821 bp, Homo sapiens
atgaaatggaaatgatgagatgagatgagataaaatgagatgaaatgatgagatgaaatgaaatgatgagatgagatgaaatgagatgaaatatgatgaggtgaaatgccataatgaaatgaaatgcatgcaaatggcaataatgaaatggaaatgagcatgcagatgcaatgagttgaaatgagatgaaatgatgaaatgcatgagatgcaaatgatgagatgcagatgtggatgcaaatgcatgacatgcaaatggatgacattaaaatgaaatgtactgatgcagcatgcagcatgcagcattaaaatgcattatgaaatgcaggcatgaatggatgcagatgcaaatgcatgcagcatgagcatgcaagcatgcatgcagcatgcaaatgcatgcagatgcaactgatgcagatgcaaaatgcaaattggaaataaataaataaacattgcaaatgcagcatgcagcatggaaatgcatgagatgcatgcaacatcaacatgcatcaaaactgcatgaggaatggtgatgacggatgacccatggactgacgatgaggatgacatggacaataaaacacaccacaaacgccaacacaagcaacaacacaactgtgtcgcgcccccgggcccccgaaaaaagccctccacaacccatcgctttcgggccccggggcaccgtacgacactgcacccggccccaccgcgccccacagaacccgggcaagcaccaggcgcgcttcccccaacaaaaaccccggggcccggccctgcgcaccccggcgccggggccaccgcctcaggggacaggcgcaaaac

SEQ ID NO: 624921 - DNA, 153 bp, Homo sapiens
  misc_feature (22)..(22): n is a, c, g, or t
cgccgtggtcggttcgtttganctttcccccagtaggtgactttccagtgtgtgggatccctttctcctcctcagttccctttcgagagtgcccgtcccgcttggattcaccttctctcgctctcctcttttctcccattctgcctagtaatg

SEQ ID NO: 624922 - DNA, 206 bp, Homo sapiens
  misc_feature (18)..(18): n is a, c, g, or t
  misc_feature (30)..(30): n is a, c, g, or t
  misc_feature (40)..(40): n is a, c, g, or t
  misc_feature (48)..(48): n is a, c, g, or t
  misc_feature (52)..(53): n is a, c, g, or t
  misc_feature (57)..(58): n is a, c, g, or t
  misc_feature (68)..(68): n is a, c, g, or t
  misc_feature (101)..(101): n is a, c, g, or t
  misc_feature (114)..(114): n is a, c, g, or t
  misc_feature (123)..(124): n is a, c, g, or t
  misc_feature (128)..(128): n is a, c, g, or t
  misc_feature (147)..(148): n is a, c, g, or t
  misc_feature (172)..(172): n is a, c, g, or t
  misc_feature (178)..(179): n is a, c, g, or t
  misc_feature (190)..(191): n is a, c, g, or t
  misc_feature (203)..(203): n is a, c, g, or t
  misc_feature (205)..(205): n is a, c, g, or t
atcccccgggctgcaggnattccgcacganagtagctcanaatatgcnatcnnattnnatactttctnatgatggttttatctgcagtaatatgtatatcntctattagaattnacttaatgnnaaantgaagagaacaaaatttgnnaccactagcacttaagtactcctnattctnnacattgtcttnnatgaccacaagncna

SEQ ID NO: 624923 - DNA, 170 bp, Homo sapiens
catcacacatccggagatgagacgtccccttcacagccttgccctgggcgttccctgagagcaaagggcagtccaggttacagagggaggaaggagacggaagcagcacggatgtcaaggttgagcaccttcagacttagcatgaggttatggcaggatgcagcagctcg

SEQ ID NO: 624924 - DNA, 420 bp, Homo sapiens
gtcccatcatgggatgcttttttttctcttccccctccccctcaaataattttaaatcatggatggagatacttattggccgctcttacttgggttttctctgcggatgctgtttggtgtccggtgtcctttacctcgtttttaagcgctaaatgtttggtttttatttgggtgtctgtctctcgatacctacatctgtgcggtgtgtaagtactccggtatggtcggggcatggcgaaggcttgctgtattgctgttagattcaagatttttctttttgttgtgctttattttagcatgtcagtcgtgcagctgaccagacatttagccgtttggattttccagagttcagtggttgtgaaatgtccttattataacaatgattttggtaaataaagagaagttttttgaacaccacca

SEQ ID NO: 624925 - DNA, 203 bp, Homo sapiens
cactgcttctctccagtggatgttaacattaatgctgatctcatgaactcagctaataatacagttttatgatcactgagatagaagtggggctgagctcaccacttttccaaggagaagaataaagtaaaccaggatttccttggagggaacatccaacacttggcttaagagaacaagcttgtaacaacactcttgagcaa

SEQ ID NO: 624926 - DNA, 107 bp, Homo sapiens
tatccggcgagtgaagggaagaaaaagaaacaacatagaggctttgagatgacagaatacaagttaattttacacaaatattatatttgaaatggcattttctctct

SEQ ID NO: 624927 - DNA, 749 bp, Homo sapiens
cgcagctgccatcttaggtggcgcctggacgctacggggtttcatcggttggatggctggcgttcgtggcagcatgtagacgaccgggagaaatggcataaatgtaccgattggaccgacacctttctttcctccggcctcggtagaaccggcagtcccgcgtccgaaggcggaggcagaggggaactggcgcgacgtgatggggccgtgatggctgagcggttagagcgtctcccggaaggatgggccggtcatcggagccggatgctcgatcccgtcgtccaagcgacaccaagagcggcaagcacaacaagaagcgcagccggtcccggtcgcgatcccgggacaaggagcgcgtgcggaagcgttccagactctcgggaaagtaaacaggaaccggcggcgggagtcgcggtcccgtgtcgcgctccagcaacacgggcgtgtcccggcgcgagcgggaccgggagcgcgcctcgtccccgcccgagcggatcgacatcttacgggcgcacggtgagcaagcgcagacagcgctggaacgagagagcgagcaatgcgagacggaggaggagaagaaagcggagttcgagcggcagcgaaagattcgacatgccagaaactagaagaaaaaactcatcgagggaagaaacagcactgaagagtagaagaattggtagcaagaaagggtggaggaagaagctggagaaaaggaaggctgacattgaacgagaagttctccgacgggg

SEQ ID NO: 624928 - DNA, 510 bp, Homo sapiens
cgacgtgtttccgcactgatgaccaatatccaagtagctacttcacatcgtgtcggaagctgtgtcatcagtgaggaaaacatctgcttaaattacaggaattctggtcttatacaggtctgaaaattctgccatttccttattaactagcagctttagtttgtagtttatgaaaatcttgaggggctcttttactgggcatttcttattttttggttttttccctgcttaatttggtgggaggtcaaatggaatataaccccaatcaaaggcttcttcaatgcacaaaattggcatgttggcatgcatgaaatggaaatgcacagtcatggcactgtccggtatacaaaataacattaattcaatgtcagataaaattacactagtttaaaacatgtgcattcacttgtcatttgttcagtgttttagtcttttgggcaaagcatgtgctctgttaatgtggcttttttttttttttttaaatacatggtagtctaacatttcgtggtc

SEQ ID NO: 624929 - DNA, 589 bp, Homo sapiens
cgacgaagaggtgacgtgttgtggtggatgcactgagtggcctgaagggtgacctggctggacgttactataggcgtcagtgcagatgactagaggcatgaacagctagccagcttattgatgaccactttctgtttgataagcctgttgtcccgttgctgacttgcagcagtgaatggctcgagattggccagcattttcgaagaatttgccacaacaatgagaagagcttcctgatctgggtgaatgaggaggatcatacacgggtgatctccatggagaagggtggtaacatgaatgagagtgtttgaaagattctgccgaggtctcaaagaggtggagagacttatccaagaacgttggctgggagttcatgtggaatgagcgtttgggatacatcttgacctgtccatctaacctgggcactggacttcgggcaggagtgcacatcagactgcccctgctaagcgaagatcgccgcttcccatagattctggagaacctaagactccaaaaacgtggtactggaggagtggacactgctgctacagtgcggtgtctttgatatttctaatttggaccgactagg

SEQ ID NO: 624930 - DNA, 105 bp, Homo sapiens
cgtgggccactatggatggtggtgtcatgcaccacacagggctcacacagactaaaattcttgtgttgcaacgcagagaccacggagtatctttgcctctggttc

SEQ ID NO: 624931 - DNA, 1588 bp, Homo sapiens
gctcgccgacagaccgccgtccgtcgcgcgcctcctccgtcgcacgcggagctccgggcagcttgtatcgccagagtccctggaactctcgcttatctttgttgaatcccgcgtgcatcggtagtcatccggacggtgcgcccgatgcatgtcaggacgtcgagccgtgagacgaccaggctccgaaatcaccagccaaggtacgttgaaaggagaagaaggaagcttgtggacacgaggcatgataacagtggaccgagaatcgccctctgactaacggggcaactgctacactgagggatacaaatgggcgccgtaaccaacggagaggggcattgaacccactggtagcgtaagaaccaagtgaagcgcagcaactgacggggacccgcccagagcagaggcgagccgcagaggagaggccacccaacgccccgcgccgcacctgcgcagcaggcgcacacgcagagccattgcgtaacacaccacacgcatgacaaggcaacgccctggaccgtcccgtcggaaccgtgggccccagaccgcggtcgacacagcacggtacatgacgagtacggcggagcttgaacaccagacatagctgagaccgaaagcaggacgcagacggcaagtaccgaacacgcgacccgcaaggaatcgtagcccaataccacggcgcgaacaagccgcgaggacacttccgaaccaggtagcccacgaaccccaccgcgcccgcacgggcacatcctcgggcacatcaccccgccacacctgaacaaccggtcctaaacggaatagccacaaagagcgccccacacccatcgcgacaacacagccccccctacagagcgagccacgacacaccgcaccgctcgccaacgcagacgacaccgccccgagaatccgcgacacgtcagccgggcgcccgtaggcacagaagggcaacgcgaaggtcagacggacccacgcaccgcatcaggcgcacccgcagtcacagcaggccaagaggagccagaccacgggccccccaacacgggccccccaccagcgcgtggcacggacaagacgcaccgactgaaccggcgcagccgctggctgcaacccatgcgcgggagccgcgcacgcaacggcacaacccggcgcccacgcgagccagcaccgcgccccccgcccaacgccgtgcacacgccggcccagtgcccaacccgtaagccgcgcaacacgcagagcggcacagcccccgccgccctacgcgaggccaacaagcccgtacaaggagcagagctgccccgcgcagggaggcgcgccgcgccccagccaccagcaacccgcgctcacagcacgcccctcgagccacgcgcacgccccgacgcgccgaaccaccgagaccacaccacaccggcgcaccagttcgcgcaaacaccacccagtccacccaacagacacacacgacgcccaacaagggacgcacccaaccccccacgctcccggcagaggcacccacgcagctggagcacaacacctaccaccgcgcacaacccaagcgcgcgcgcgaccagccaccagagcagcacgagcacacccacag

SEQ ID NO: 624932 - DNA, 878 bp, Homo sapiens
ttccgccggtggttgggggccaccgtctgccatattgtgacacgggtgtgcagttgactctgtgagagggctcctgttgtgcgatatgcacttctgccggcacctctgggggtgggccgcgatgtgccttcccgcctgggctttgtgcgtagtaccaatggccccccccccggccggggtctgtccaacgagttttctcggtggagcgatgctccctctcgtctatacggggtcctcatcattctcgcgggcacgtgggctctcgctattattgctgccttgttaggaggggcagtctcccgcctacccatgtggcggcccccccctccctgccttggttggtcgctcccgatccatttttgttttcacccgaagcgcctttttattgaccgcgtctcctgtttttgtcggccggggcctctgacgtgagggggtccctgttccccacccatggggctgcgactcgccccggcgggcccttcctctgtattgtcatgggcgcacccccgggtgcgccacccactgcgggactgtcaccgtgcgtcctgtgcatcccgcggccccctcctccgaagtgcggctctgtccgaggcccctccacgaagaagtgcggttgcgttctcggcttcactacgccccccccctggggcgctcacaccgttcagccgcttccttggagtccccccccctctgccgccacctttgttgtcgccccctctctagcaccccccctgtcgccgtctctttcgcccccgactgccgccatgcggtgccgccacgatactcttggtgggcctggggtcgtgttcttggcacccctaggccgtccgttcgctggcccccccaatcccccccaggggcctcccccccacataaca

SEQ ID NO: 624933 - DNA, 151 bp, Homo sapiens
tctagaggatcttggtgagcaagcaagaaaagctggggtcctccttcagtatacacagctccttggctcccggggagcaatgaaaaggacatcagctttggcatgatgcagtaggtgacgataagggagaagatgaggatgccgaagccca

SEQ ID NO: 624934 - DNA, 437 bp, Homo sapiens
taggtggatgtgtgatgatcagcgatcggcgtcgatcagagaagttcattcaatcactcagtcacgtgtaagtcatcgttagtaatgcaatcgctctgctaaataatcttcttcatcatcatgtacttcatcaagagcttctcttctacaacatcctcatcgtcctcgtctacctcatcttctccttcttcgatccatcctcctcttcatcacaccatccacctcgtcatctgagtcaggtgcttcctggtcctctcggtcatagctcctgctttgtagaaactggggcaggagcttgaagacactctctcggtagtcattcaggttggtaacctcacagttaaggaggtccaggcttttcagacattctaactttttcaaaggttccaaggtgctgatatctttcagtttatttccacttaagtttagatgtgtga

SEQ ID NO: 624935 - DNA, 1660 bp, Homo sapiens
  misc_feature (1352)..(1352): n is a, c, g, or t
tcacttgaacccgggaggtggaggttgccgtgagttgagattggaccactgctctccagcctgggcaacagagtaaaactctgtcccaaaacaaaaaataagaatacaacctttgcaggatgtctctcctggagacagcacgagggagaggagggagagggctctttcttacgaaaagaggccttggcgtgagcccggaaagtttggaaaccagcctgggccaattccagcaagatcccggtctctactacaaacaataacacaacaaacattcagtcgtgggtgcccactgtgccctggtggttccaccacactgtgcactgtggcgaagcgcatgcagggtggcgcagaacatgggccttacgcccgtaagcaagctgggaaggcctcaattgaaccccatgcatcaagtgccacgtggcaaatccaagcccgtgggcgtgggcccatgtgacatttccgtgccgcgtggcactgtgcctatacagagtgtgtgcactttggtaagggccacacctttctccaccagtgagcttgacccctgtggacaaccatggcccagtggaaccacggcaaaccagcacttccaccaaccccaatgaacgccttggggggtatatcaccgtccgatatacagatatcccagtgggggaataacccccaccttgttggcaccactgaacgctggcaacatatggggcactggacggtgtcaaaacatttctacggggttaactccgcattttcgccttaagcacccacttctagcacacacacagacttttctcccccacaaatcacccagagggggcccccttggtcggcgaccacttcgttcaacgttggcgaaacttcgccacacgggcgcacaatctactaccacggcccccttttcggtggaccccatgtggacagactacggtttggtaacctattatacacgatgtaggcactaacgtgaccaacgtctttgtgacaggaacacgacacgccacagcggcggccttcctctacaacggcgttggctcaccacaaccgcagtgacacaatcacgcagatgtgagtcacacaacgggctttatcatactaccccactgtaggagccttatgacacccacactttacaaccgtgcgatctcacagacaatttctgtatcggagcatcacgacaaccacttgatgatgctacccatacagcatgagctggccgcaatcctacggcggactaccggcatcatattcacgtcgaacattcttactacagcaggctgccttactaaaagtccacatcttctcatcagactgacgacgatcaagcatgtggtcgaggcgtttcctaacacacgcacgtngtaactccgacccccacaggggtatgtgctccacctcaacacaccgcccgtgtcaagctccacagagagcagagaactactgactcacacaacatgtggggccacccaaccacaagaggcgcgaggcggaataaaaacagagcagagtgaaacagccgacgccacaagacgcgcccagctaggcagccaactcatggacacctactccacaccagaccaacaccaaagcggcgagcgcgcccactaacacaaccccagcgagggcgcagccaaacacatacttccaccacagccagcgtacaaacgct

SEQ ID NO: 624936 - DNA, 1166 bp, Homo sapiens
cctggtccaaagtggacgagaatcccattgttaagacatgtctcattaagacttctctaagatggagccagcaaacagcccagtagcatcgaggctgctgcctgggaaagagtcccctcctctcccctgttcattaatgattatgggaggttttattccccccaacaaaagtgttaattagacatcatcggaacagggatattacacaaatgaattaaactcaaaccaatcaacaagctggctctgtgcttcaggtcccccgaacgaaaagggaattgaaggctgtaatgggaaacaaacggtaagatgtctttcctaatatcaaataataactaggaaggctgcctttgcttctagagcttgtcttcttattcttttctttctcccctccactacacacacacacgcgcgcgcacacacacacatgcacacacacgcactgccatgaggctggagagttagggttcattcttgtgactgaaactgaaactggctgggactgcccagtggtacttctcaggtgccctctaggctcaggggccaagtgggatggaaggagtcagaagagcccagttccagtccctctctgtcactcaccaccttcctcatcagagaatagtgtgtgtaatgctcaggagttcacagggatgcagtaggtactcaatacttacctgctgtgtccaaatggctgggcgacttctggaagcattctgtgccctggcagcaaattcctgaggctgattgacccctgtggggagagtgggaagaactggagggaaaagagttttagtccttgtattttgagggatcccagttgcttggagggatagataaagaagattgaaaagtcttctaaaaatggacagatgaagccagtgcaatggctcatacctgtaatcccagcactttgggaggcagaggcaggaggagcacttgacccccaaaatttgagactagcctgggcaacagggttagaaaccatttctacaaaagaaaaacaattagcctggtgtggtggtgcatacccttggccccagctacttgagaggccaaggtggaaggattgcttgagcctaggtggctgagcctgcggctgtgatcacacaactgcactccagcctgggcaacagagccagatcctataaatgagaaaaagaaaagaaaag

SEQ ID NO: 624937 - DNA, 187 bp, Homo sapiens
aatcagctcggtacccaattttcggaaagatccgcaggcggaacccggctcgactcgtcaccggcgcccgcatgccggccaggcgcgtttcatgggaaaccgcgtgtttccctaggaaaaccgggcgtttacggcattttttcgtctgcctggccgggctgaatctggcgctggcggagcagcattg

SEQ ID NO: 624938 - DNA, 662 bp, Homo sapiens
caagttcactattctggactgtaaatatctgagagcaaggatggaagagatctggttggcatgtgggacggtctgttagaagaaattcgaagaaattaggaaattgagctgttcagagaatggtgagtacatacagttaagcaagttggacttcgggagctaaatgtggaagagtcatatctaaacgatgacagaatgaagactgacgagaatcagccagaaaggttatgggggttaaatctctgggatgcttttctcttccgtgtagcgtagaggcttacctagaggcggtcgcggcgcaggtagtgtaaccagtataagtttgtgtacccgcgggatttgccaatctctgtgtagcttgcagtactcttcgtgtgagggtggcagccgtggcagttgcacattggtgatcagctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttaggtttggactttcagca

SEQ ID NO: 624939 - DNA, 103 bp, Homo sapiens
agttccataaagcatcccaggaagattagaatgcaaatggacattctctgggaggtggggatacatagccaaggacattcccatacggcggcccaataaatcc

SEQ ID NO: 624940 - DNA, 113 bp, Homo sapiens
acgaagaataaggagatgtgaagaaacatctcagttatattggatagtcccattactctttcggtggagaaggaacgtgataaagaagtcagcgatgatgaggctgaagaaaa

SEQ ID NO: 624941 - DNA, 139 bp, Homo sapiens
catcctggaaaattcacctgtgtgacttatctgtcagacaccatctgctgatccagctgcctgtgatctgcagtgtgaagccaccagacactgttgtcacagtcagtgcatgtggaacactgtggcatcagtaatcatg

SEQ ID NO: 624942 - DNA, 118 bp, Homo sapiens
caagcgtagtcagggcatgggcagggcgcatgcaggcactcaggcatgcataggcgggccaggcatcagattccagcaccggtttcgtcagtttccctgcagacgtcctgcagcatgt

SEQ ID NO: 624943 - DNA, 550 bp, Homo sapiens
aaagacagtattcaaatctaaaaaagatatcgttatctcataccccattaacaaataacagggtttctaggaatactaagtaaaaacacacaggcagagacagggcacgaaacaccgctgctcacagagtaaagagtataatccctgcaggtctctagatccaatgggttctggtctctctggtcatgactttttcttctgaataccccacattattattttatatggtataggtactctgttgagatggagtctcgctcttgcacccagactttattcaactaacggcatcttccactagttgatcctcttaaatagaccagctggcgtgctaccttgttgccactcgccgtcgtaaaacatcattgttagtagaacccgtcgccgcccacaaaaaaaaaaaaaacaccccaatcaccactaccaataaaaacaacacacatgaaaacaaaaaaaacaaaacaacaaacaacgaattacaacattcaaacaaacaacacacacaaaaaaaaaaaccaaaaaactatacaataacaatacgaaccaatcg

SEQ ID NO: 624944 - DNA, 359 bp, Homo sapiens
aaaggaacacagaatatggattaagcgcagggggagcttctgactgagagcacaatctgcagattcatgggttcaaatccagactcaacctgtgtgatcttggtcaccgttctgtgccttggctttctcatctataaaatgaagccattaatagacacatgcctcatagaattgttgtaagaatgtatataaaatacttaaagcgtggcacatagtaagcactcaagaaatctttgctgtaatggtcattctaaaagccaagtgttcaagtctccacttgacacattcagaggcaaagcagagcctgaaagctcaccacagcctatagtttctggcctgtcatagcacagaatctgccg

SEQ ID NO: 624945 - DNA, 368 bp, Homo sapiens
caccctgctacgctccttcccctactcatcgcactaagtttacactcacatacaccctaggctcactacaaccttcctactcactcactctcactgcccagaactattcatctcctatatcttcttcgaaacctgacttgtccccagcttgagtatcatcacccgatgaggcgaacagccagaacgcctgaacgcaggcacatactaccaattctaaacccttagataggctcccttcccctactcatcgcactgatttacaactcacaaaaccctaagctcactaaacattctactactcactctcactgcccaagaactatcaaaatcatgagccaacaacttaatatgactagttatgtacgtga

SEQ ID NO: 624946 - DNA, 354 bp, Homo sapiens
  misc_feature (138)..(138): n is a, c, g, or t
  misc_feature (225)..(225): n is a, c, g, or t
  misc_feature (246)..(246): n is a, c, g, or t
  misc_feature (253)..(253): n is a, c, g, or t
  misc_feature (281)..(281): n is a, c, g, or t
  misc_feature (285)..(285): n is a, c, g, or t
gataaattcaaccaggtcatggcagggattgatgctgcatttgaggccggttttgagaaggtcaaagtcaataccgtgctgatgcgtgatgttaatcatcaccagctcgacacctttctgaactggatccagcatcgncctatccagctgcgtttcatcgaactgatggaaacgggcgagggcagcgagctcttccgtaagcatcacatctctggtcaggttctncgtgacgagctactgcgtcgnggctggntccaccaattacgtcaacgcagcgacgntccngcgcaagttttttgccatccagattacgtcggagagattggccttatcatgccgtattgataaagactt

SEQ ID NO: 624947 - DNA, 321 bp, Homo sapiens
ctactactactaaattcgcggccactcgacatctatctatctagacatctatagatatgttctagtatgagaaattctggcgagcccttaaattttctggcttataatgattgctatcgctatagactatcgctttcagttacaaacgcagtcttgatacggaggttagaatgtccagtgtgagatattaatcaggctgggtgcggtggctgacacctgtaatcccagcactttgggaggctgaggcaggtggatcatgaggtcggaagatagagaccatcctggccgagcatggtgaaaccccatctctactaaatacac

SEQ ID NO: 624948 - DNA, 113 bp, Homo sapiens
gacctggaattgtctgacccagtcccgcctgcgtggtgcctgcagccaccgtggactgtctgtatttgtaacacttaagttatttgatcagcactttatgcacgtattattaa

SEQ ID NO: 624949 - DNA, 111 bp, Homo sapiens
taagaggtcacacctaggctgtgccatatggtgtggggctgtgagagccccaggcggagctccgggggacttcgttagggagcctctgggaagaggttctggacggagaag

SEQ ID NO: 624950 - DNA, 85 bp, Homo sapiens
cgggggggttttgggggggccccccttttttttttttcccgggcccccggttgggtttttggccccccccccccccttgggggga

SEQ ID NO: 624951 - DNA, 301 bp, Homo sapiens
gtcacgcccacagactgggggtgatcccatggtgtggagagaccaccaggccctgcggggagccatggaagaaacttgtggatccgttcttatggagctcatgcaggagagtaacgtgtggacttgaacgatagcgtcttgatcaactggaacattgctgcatctacctgtctcggagagagacaagacaccatcggggaggtgggaaagccacgggctcggcgccgagagttgcacgttggctctggaggggctccagcgtctgatgtctgtcctcgctgcaggagagatacatcgcact

SEQ ID NO: 624952 - DNA, 349 bp, Homo sapiens
  misc_feature (119)..(119): n is a, c, g, or t
  misc_feature (264)..(264): n is a, c, g, or t
tccagtgttttactaatctggaagtcttccattaatacaacacggacgtgttaggaaatggatagagctgggtgtttacctgtctctgtttaaacctcttggccattgcgggtcttttnctctgtgaatgatgtctaaatatttctgtaactttaatccccttgtaggtgatttgtcctctcttgccaccccacccccagaggagagcagaagctgtttaggtagaaggaatagaatgaatataccttttatattcattgaggnaccctaaaatatgtgtggcattaaacagatggttttggtcacagcagagcaggtgctgtacatatatttctaaaataggcatatg

SEQ ID NO: 624953 - DNA, 406 bp, Homo sapiens
aggtgtcatactacatacatcaagtgtttatactacaactagttcataccaaatacatacatacagatgaaaagattaacatcaacaggaacagcatcaatggctccatattccgttccctccctctcgttgtcctcttccaagtcactgcttacaccattttcagccctacctccagaagcttcacttaataagtatatcatctttatctgaagtatatgtgctgaatcttacaagactggatacagtaatacctgtatacatctacatctcttgaggatgtacaggcttaaatctatgtcatttacactcactgaatcatcaacctcatcaccacctgtaccctgggtgtagcgggtatcatctgcttcctcatcatcatcattgaccagttcaggacgaaata

SEQ ID NO: 624954 - DNA, 385 bp, Homo sapiens
ctgaggtgactctaaggatcctaggcctggaactggaactgtatccccaagcagaaaaacaccagccttaagtcggctgcttttctacgtatataatgcaattgttacgtggagagagccaggggagccttcttataaaactatttccactggaaaacaaagtggatgaatgacatttttacaaaatataaattcctgttcgtatcttctactgttattagcacatacggggttgaaatacctctctatgacaaccatatatgtacgtgtgtgtgacaggcgtatgcatacacacacatctacctatggaggaacaaacactagatttttaggtcatcatagaaacaaacggccagccctataatgttacacaattacgccaaca

SEQ ID NO: 624955 - DNA, 877 bp, Homo sapiens
  misc_feature (80)..(80): n is a, c, g, or t
  misc_feature (110)..(111): n is a, c, g, or t
  misc_feature (129)..(129): n is a, c, g, or t
  misc_feature (143)..(143): n is a, c, g, or t
  misc_feature (167)..(167): n is a, c, g, or t
  misc_feature (183)..(183): n is a, c, g, or t
  misc_feature (193)..(195): n is a, c, g, or t
  misc_feature (200)..(200): n is a, c, g, or t
  misc_feature (207)..(207): n is a, c, g, or t
  misc_feature (213)..(213): n is a, c, g, or t
  misc_feature (240)..(240): n is a, c, g, or t
  misc_feature (242)..(242): n is a, c, g, or t
  misc_feature (245)..(246): n is a, c, g, or t
  misc_feature (258)..(258): n is a, c, g, or t
  misc_feature (285)..(285): n is a, c, g, or t
  misc_feature (290)..(290): n is a, c, g, or t
  misc_feature (298)..(298): n is a, c, g, or t
  misc_feature (322)..(322): n is a, c, g, or t
  misc_feature (325)..(325): n is a, c, g, or t
  misc_feature (359)..(359): n is a, c, g, or t
gcggtaggaacatggcggatcggctcacgcagcttcaggacgctgtgaattcgcttgcagatcagttttgtaatgccatnggagtattgcagcaatgtggtcctcctgcnnctttcaataatattcagnaagcaattaacaangaccgccagctaaccctacagagngtatgcccagcttttngcgcatgatnnncacgncagcaangacatngatgtttgatagattccttaccagtangnatnntacagctgcttnacaggctgctagctgtatagctagagnagaanaccatgangctgctacatgtctggaggatgtngtntatcgagagacatgctctggagagatacaaagcncacttgctgataattgcacaagtcacagctgaagcacaagaagtggtacccatagccagtctccttccaagaactccactaggccttcagatgggattacccatggttaagcctgcagaaaaaagacacctggtacgacgttgcccattatagagacatttctggcactccagacctctagaatagcaagcctttaccgcaaacaattgtcccgaaaccattacaccccactcatggaccaccatttaacccatttctgaagagaacctcgtataacaaagatacctaccgataaattattacacccatcctttgcgaattcaggggcctgtttgttatacacatccactgccgcactgggacactccacagccctcagcaacaagccacttcactttacccaatccacatttcggtaagacctgggcaagatggcaaccaggtcgtgtgacacagccgcacgtgatacaactcaacatatacacacatgaacaccttaaaatactacacggggacac

SEQ ID NO: 624956 - DNA, 1498 bp, Homo sapiens
ggtcagccgcatcttcttttgcgtcgccagccgagccacatcgctcagacaccatggggaaggctgacacggtcggagtcaacggaatttggtcggtattgggcgccctggtcaccagggcatgcgtatgtctaagctctggtaaacgtggagtatttgttgccagtcaatgatcccctttcatttggaccgtcaacgtagcatggcttatacaatgtttacccaaatcactgcatttcctacctcgaatggtcgaataaattcccgagtaggactacccgttcaaaggccttggagaaaccgcggaagcctttgggtctccattcatagtcggggagacattccccaatactaactcaatcctttgcccaagtgaagcccggaagattccgcacttccccaaaaaaattgccaaaagtttggggggcggaattgcctagggccggcctgcaaggtaaccggttccggtgtgcaaggtcactaccttgggcccgttcctttccaaccaaacccaactgggtatgaaaggggctggggggggcttccaatttctgccatgcgcgcgtccgcaagggccaattacacgcggggttccacttcacttccttcctgggccccccccttccttggcccttgcattggcccaccccccaagttggctttccgggtcaactggagcgaattgcttggaacacccccaatttgcaagcaacgagcctcacttgcaagcaaaatccaaggtccccttccacctggcaagttccaattcaaaggcaccataaatggcccttacccttgggcgagcccaagcggcaaaaccccttgggccgtatttattggccaaacgccaccccatttggcgtccaccaaacatggtggtcccaattacgccaagttggaaccaaaaagcttttttctcggggactaaattccggctaggtggaagaccgggaaccccttcaacttgggacaccccaatcaatggtgtgccgccaattgggccccaacttccgaagcattgggctccaacgccccccaggtgaacagggaacccttggcttgtgcgcaccttcgcgggcccccccggattcccggggggcaaaaaaactcttggcattgacgcccggcttgaaccttgttgtcccccggaccggtgcggcgcgccctttcctttcgccaatggaaaaaccctagtttcctaactatcctcccgttgggccccatttcataagacattgggggacggggcccctggatccccaaaattgggcccactgagcattggccgcccacaaagggcgttccaatcccccccttgtgagacaccacgtgaaaacaccgcgggggacacaggccttcctaaccttggggcgccccatggggggcccgccatattcccccgcgtgacgtatcccccccaaactcttgggcctccacaaaacccggcgtggtcattccacgcgacttgcggacttgggcaaaaccccttggagaaccc

SEQ ID NO: 624957 - DNA, 261 bp, Homo sapiens
gacagcgaccgacactcaatggaatcccgattccatggaaatggaaaatagctctatttatacagcaaattcaaatacagtagcttgctaagcaacttcataattcattaacactcgatggcagagcagatagtcacaattactaacgattatcatgatctgcattcttgacaagtatactatggcgagataaatcaaactcagacgatgataagcaaactcaaaaatgaaaatgatgatgccaactaagcttttgttaaa

SEQ ID NO: 624958 - DNA, 587 bp, Homo sapiens
tgcatagctgcgtctctgctttatcttttagcaatagctgtgaaatgtgcactgccacgtagatacactacttgacacatactcaggggactgttcgaatgctacagatttctcccagagcttggggaaacacaccaggaggggtgcggcatcctccagcacagaacgaacagctggccacacctactctcaaatatgcagtagtttagctcccagatgcacattctctctctctccctctctctctctctctctctccccctcatcatccacccatgtgaaaaacactccatttttattaatttccattagcaaacataaaatttttttcagagtgcaagtggaagtctttaaacaatttctttaccaactaatgaaacagaaatcattttagtttaataaaacagtgatcaaagagaatcactgggctgtataatatacgcattcccttatttaccagattttatcccagtcctggaagagatttacatcgtagcaggggataaaaacattacatgtgcatgtaactgctaatgatggtgagggtcatgaagggagcatgaaggcacttacgggagagaatgtgg

SEQ ID NO: 624959 - DNA, 578 bp, Homo sapiens
atgatattcacagcatcttctaaatttgggccaggagtcaaaataaatgcatttaaacttgggaacgtgccacataagacagtgaggctgatcccaacagtagttggggcggatacccacaaaccaaagtgctgggaaagtcaggaagagctgacagggattctacagtcagttcatgacctcggtgcagtgagacctctagactgacacgtacaagagagatgcagttccgtctacactggcagctgtcccttccattacttgctgggcctgcttctgtcccatgccgcactgtgcgaccgactggaataacttttcgattcctggggcaacagttgtacaattccatggtaccagaactgaaacgctgggtttgtaatcagctcaatgaagttaaatatgaagaccccgaaggatgtggcctatttacaatcaacctgtatccaagagaactcttgtgatctgttctgggctggcttccgtattggcctcgtgcaaaaggtacagcatggtgcaactgaagtagtgcgtgtggctatctgggtcacggagctgatttgcacttgcattcacaacga

SEQ ID NO: 624960 - DNA, 121 bp, Homo sapiens
acggggaaaatcacttgattagagggttaaaacttgtcggcccacttgccaaccttggtggttgcagtgacagagattgaactctataaaaaactcctaatactgatgttgcttactggat

SEQ ID NO: 624961 - DNA, 238 bp, Homo sapiens
cacacgcgatgggtataatactaagattgagatgatatcattatactgggggaaggctgctttgtcgaagtagcgccttatttctcttgtcctttcgtacagggaggaatttgaagtacatagaaaccgacctgcgattactccggctctgaactcaggatctacgtaggacctttaatctgttgaaccatacgtaaccctttagatacgcggcctgcacctatccggcggtgtgggt

SEQ ID NO: 624962 - DNA, 366 bp, Homo sapiens
gcttttggggcccgggggccgtttccccccaagtgtgggggggggccccaagccccccaaaacccccaggtggggctggggaagcccgggtttcccctgccccggggtggggagggggcccccccgggggcaaaagccccgggcgggggaggggttaggccccccccccaacaagggggggtggggggggggccccccccaagggggctgggggggcccggggttggtgtcccggccccggggctgttaggggcccccccctttccccttacccccagggggggggggggtccggggttgggcccggggaaaccaggaacggttggcctagggcccgggccggaacctggaatttttttttttcca

SEQ ID NO: 624963 - DNA, 236 bp, Homo sapiens
cttattagcctcggggtgatacctttctccttccggtcgaggccgttgcctgttacgtccatccatgcttgtatcagctgcgcctcatcttacttcatcccacgactcttgacctctggggtgactttcatggctgtgagaagaagtctctatcctcagactctcaccagagacgaatgaggtgatatcatccgtcattgctgggtccgctccgcgggaaacatgtgccggacctg

SEQ ID NO: 624964 - DNA, 743 bp, Homo sapiens
gtggcagaggcgtaaagcatgactcgctcagggccctaaactgggctcacactactctgtcattctgacctggctgctatccaccgtactccaaagattcaggtttactcacgtcatccagcatagaatggaaagtgaacacccctgaatcgctatgtttttgaggttgatgcatccgacatagaagaacactcactgaagaatggagagagaattgaaaagcggaacattcacacttgtgtttacagaaggacagtccatctctatctcttgtactacactgaattcacccccactgaaaaagatgagtctgcctgtagtgagaaccatacgactctgtcacaagccaagatagctaagtgggatcgacacatgtcagcagcaccattggaggtttgaagatgccgcatattgaccggatgaatcccaaattctgcttgctagctccttaatatagacaagcttatacacttacactttatgcacaaaatgtagggttgtataatggaaacagggcctgaccttcttatatcctaacttgagcgctgcctacaggttaagggatttgaacacggtccccccaggtaaaattaagatggctggcaactaaaggggggagcttaaaatattttaccaacatcacaattcggtaaaataaaccaataatccttgcccccaagcttgtaaaatttaaaccagataacttaactaaaactaaaccccgctaaaattggggcttttgg

SEQ ID NO: 624965 - DNA, 148 bp, Homo sapiens
agaagaagaagtcaccaaaggaaaggaaattcaacttcagcttagctgtttatcaatcaggaggtcaagattcttttacaggacttaaattgcgacttaggagaatcaccaacagttcccaccgttgcaagaatgactgtatatcaat

SEQ ID NO: 624966 - DNA, 692 bp, Homo sapiens
aagcggagtgttgctgtagctggttgagaggatcgtgctgctgttatggcggaatgtcgacaatccttcaccatggcagtcagcccggcccagtgtggcgaggcaatgatccgtctcaccatccagcacctggacgaagctcccggtcgtacatgatgccctcacctccaggcctggccgtgactttccaccatttgaggatgagtccgagggtgctcctaggacacagaggggcccctggaggaagaagaggatggagaggagctcattgcgagatggcatggaaagggacatatcggcacatcccacgagctggacgcctatgaggccgagggacatggcatcgtggatgatgagagacgtagaggagctgacggccatgtctatgagtggagtgcaggcacagcaggggccatgcggaggcggtgacacgggaggctggccgtggacggtgggtccgtgatgcgccagagggcctccatgtaatgagcagtcagatgaggaaggatcgcaggagcgccctgctacccgacaaggagcatgtctcatgtgagaacgggcacaatggagggacgggccgaggcgtgacggaggcagatgatacgacgagacatcggagaaaacgtggaaggattcctagaaaagggcacactctggtggcgcgaagtggggtgaggcatggagggagcaca

SEQ ID NO: 624967 - DNA, 278 bp, Homo sapiens
  misc_feature (2)..(3): n is a, c, g, or t
  misc_feature (90)..(90): n is a, c, g, or t
  misc_feature (109)..(109): n is a, c, g, or t
  misc_feature (125)..(126): n is a, c, g, or t
  misc_feature (129)..(133): n is a, c, g, or t
  misc_feature (136)..(139): n is a, c, g, or t
  misc_feature (141)..(146): n is a, c, g, or t
  misc_feature (148)..(150): n is a, c, g, or t
  misc_feature (179)..(179): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (225)..(225): n is a, c, g, or t
  misc_feature (252)..(252): n is a, c, g, or t
  misc_feature (254)..(256): n is a, c, g, or t
  misc_feature (259)..(259): n is a, c, g, or t
  misc_feature (263)..(264): n is a, c, g, or t
  misc_feature (272)..(273): n is a, c, g, or t
  misc_feature (275)..(278): n is a, c, g, or t
cnngcagcggggcggccgaggcagtagcggcggcagcggcggcggcggcggaggcagcggccggtgtccggctcgggctcggctcctgcnaccccggggcgcccggcgngccccccgcccccccnnccnnnnnccnnnncnnnnnncnnnccctcccagcgcgcccgcggccccgcggnccttggcgagaagntcggntncccccagcgctccccgggcacaaanatatggaaatggtagttagcagttggngnnnttntaannaggatgtnntnnnn

SEQ ID NO: 624968 - DNA, 538 bp, Homo sapiens
  misc_feature (84)..(84): n is a, c, g, or t
  misc_feature (90)..(90): n is a, c, g, or t
  misc_feature (397)..(397): n is a, c, g, or t
  misc_feature (440)..(440): n is a, c, g, or t
  misc_feature (500)..(500): n is a, c, g, or t
  misc_feature (507)..(507): n is a, c, g, or t
  misc_feature (511)..(511): n is a, c, g, or t
  misc_feature (518)..(518): n is a, c, g, or t
  misc_feature (530)..(530): n is a, c, g, or t
ggagtctaaaatgataccctgggtggagccggggagctgagcaggaggccaggtggcaaccagtagctgctgggcccgtgctgnaacccncctgcactcctccagctggagtctcaccgcggatcccaggaatacctgctgttcccacagggctgcctttccgtagtttgtctggagacaccaagagtggtttccatgcctgctgggaataggctgagcatgcaatgacatgagggccaaggcttgtgggaaaatgacagcttcacagccccttgaggagtgaccaagccacaaagtaaatcctaaagccacaaccccttctaccactgagctgctggaggtgggtccttatttcaagccatattcacccacccaacaaaacctaacattgaggtgngggcacacggccctgccgtggggctcactctgcagctggaggncagcatacctgaaacctgcaagaaccggtttataaaacaacagacagccaggaaaatggngctaggngagncagtggngaggccagagangcaaacca

SEQ ID NO: 624969 - DNA, 203 bp, Homo sapiens
gagaacatttttttccccctttttttttggtgaggaatttgaaaacaaatccccagggggggattggactcccgcccccttgagggggcatttttggaaaaaggatgttttttcccagccccccaggcggtaaatcaaaaccagtcattttttggaaccctggattagcaaggcccaaaaaaaattttttttgttgcccttga

SEQ ID NO: 624970 - DNA, 156 bp, Homo sapiens
aaaaaaaacccataaatgaaaaattcctaatgaaactgtggggacgggtttgtgcgtgcaacataaaaaaccagtagcccctaaggagctttaattttggttcctgtaaaatttcaaatttatgtggttttaataaaaaaaaaaaaacccccccca

SEQ ID NO: 624971 - DNA, 262 bp, Homo sapiens
ctgacccgaggattagtattggtggtgcatcgcggtcatgcctaacttggagatccagcttcacattcaccaacaccagcagcaacaatcaggacagcacagtcagactgagatgtccctgataatcatgttttctgataaagtctctgtgtcctgtgggcatcacatgatagtcacatcagtactctgctggtctcacaatttccagcaagggagatatcaataggtgataccacagttcacgctacagctattacagttt

SEQ ID NO: 624972 - DNA, 690 bp, Homo sapiens
gcttcgggcgctgatttctgtgttgcaccccgggggtgccccactccctccgggctctctgtgtggccgatctctcttccggcgcttgcaccgctagtctatcttagatgtgggcgtgtaccccccgggtcacccacagggtccccccccccggggataacatgggtgacagaagctccgtggatctgggcaccgacagggccccctatcccgcgccccccctgggagccactcccgtggctgcagctttacaaggagcctcctgcccatgaggttcaaaaatcgaaccccggagtgctgctgcagacaagcaccagcccaagcggatatctctcggggtgcatcgtagctgccccccccgctcgtcgtgtggttctccaggtccatccctgccgcatgggatgcacaccagagtgtcttatcaacagggctcaacaagggatcacatctacctcttatcatcctcacatctccacatataaagccagcctccctcactcttccccccgcaagcttcctttacgcagcatcctccctcccctcagcccccatgaattcatgctaggagctcccccactctttctctgtttatgttaaccccttgtttatttaacaacgttgtataccaccagccacagcaaatatggatcaactgcgacagataacaacgttttttaacccccacataac

SEQ ID NO: 624973 - DNA, 411 bp, Homo sapiens
atctcctctgttggaggtggggcctagtgggaggtgattggatcacgggggcggtttctcatggtttaacaccatccccccttggtcctgtcatcacaatagggagttccagtgagatctggttgtttaaaagcatgtagcaccccctccatgctcatggtcctgctcctgccatgtaagacgcctcacttcccctttgccttctgctatgattgtaagtttctcaacacctcctcagaagctgagcagatgctgccttgcttcctgtacagcctgcagaatcataagccaattaaacctcttttctttataaattacccagtctcaggtatttctttatagcattgtgagaacagactaatacaaccgggctacctctcagtcagtgccctttgccccagctgtctctca

SEQ ID NO: 624974 - DNA, 137 bp, Homo sapiens
atcatgcgccgattctggaagatgattggaacgctctcgagggccgagggccgaatgttatagagataggaacggggtgccgaaaagtaaaaggtttaaatatttaaaaagttgggataaaaatccaaaaaaagcgc

SEQ ID NO: 624975 - DNA, 324 bp, Homo sapiens
tgtgaatacaccagcgcagcagagaacttggtgtcaccgaagtgcctcgtccatgcgcgttcgaagaagcgctgcaggctgatgatggactgcacgtctggcttgtcttaagtaaacttgttgaattgcttgaacatgcggtccacatcctgggcaaactcctgtggggagctgtagggaggtgacacattctcctgtaggcgggcacggatcagggtcagatccagggtgccaccgaggggtggtccaggaagaaaggtgcagtcggtagccagctgatgcagggggcggcagggttcgtgacagaatagagcgacagcagta

SEQ ID NO: 624976 - DNA, 1179 bp, Homo sapiens
gtacgcattcatacgtagcaattgtagcatgatatggcacatgtctagggagaaggttgacttttctgccactatctagtatcatcagtcaaaaacagcagcagcaacacctgttcatcaccttcagtccacagatctcatcatatctctagcacatcacaacacacgtctcatcacatatcacaaggcagctttacggttccacaggctcaaataacacatgcaccagcagcgtggagtggacagagagtttggctgtgacaaaaaaaacgtgtgagccaccacggaccgctctaaggcgaccgtcacaacatagcgcgcccgtttcacacacccagtgactctgacctatgtcggcctctttccatgttggttgggcacccaggacgctatggcctaggagtatatagacccacggggacaatttattcatatctatcacgaccctgggaaaacaggaatatacccggccgcagttcgccttttgtcaacacgcccgcttacatgtgaacgcttgatccacaagacgacacgctcttcccatatgtgaagcgccccagaagacttatcttgaccctgcaaacggaacctacacgtttaacccaatacggacacaatttacggcacgggttaccccatattctggtaaacaccaaagtatgtacaaacggggtatggacaacatttcgacgtgggggaacttccaagggagttcaactttccccctttataagccaggtttcgttgtgcaaacgacgacggtcaccgttagtccacgctggattttctaacaagaacacgagttcttccacagccccatcgcatgccggcacgtcccgggcaggacggcacacacgggcaacgcggtaagtatagcatacaaaggcaagcgccgagtaagttacgtttataggctcccccaggacgtccacaggcttgtctccgtaggccaccaactagtgtcgtccaggatgggggtaatcacacttgggtccccaaccacacgatcaacaacagcagtcccttttccacaacgaacgccaccacggactcactttacagacccgctgtgttcgcagcccaaacacgactgttctgcctagagagcatccgagtttactatcgccatgggtgcgcacgaactaacccctcaatcaaaatgcataagtggactagcac

SEQ ID NO: 624977 - DNA, 919 bp, Homo sapiens
ggccggtggagggaaagtaatgccggctgttgcaccatggacgttcatggggaccctcgccttcgatgaatatgatcgcgctgtttcctcatcatcgaaatgatctaaggaccgtaagtgccgtcttatgggacattgagagcccttcaaaggtgtcaatatcaatggcaggctaaaggctgataagctaaattgcaactggagagcattctgccgttgtgaccaggatgaggtcattggatagtatgaatggtggattacatggactggggagtgtgatcctgtaactctaatgtgatctcggggcccaccaatcttagcgcaatgactgtgagtgttgatccgctcataattttgacccacaggcctggattgaggtgtgaaaaccttgggtcccgagggttaccttccaggcggaattggacattcgataggaatttaggggaccaattgggaaacccaaccaaggagaacgtgggttcggatcgctgggttgtggtagccatttgtctacgcaagtaaaggcagtgacgcaagttgtcttagacccgacgtgtcattcaacccgattccagatactagtcgaggggcctatcgaggcagggtctcgcataccgtcgattgtcgtgattgaagctacccctggaactagagattccacgcgactaggagttctttggtcagatcgataaaaaggggcaaccgaaactctcccttgaaaacaagatacaggtgaaagaggccctctcggtgtggggtcttgcccaaaaaggtggggtccgaaatcacgcgtttgtgctctcacacccggaaagtcaggacatggggggggtgtggaacaaccaattttgggcgcccggggctgggagagaattttgtgccccgtggccgcagtcgaacttgggttgtggttgccact

SEQ ID NO: 624978 - DNA, 693 bp, Homo sapiens
  misc_feature (98)..(98): n is a, c, g, or t
  misc_feature (102)..(102): n is a, c, g, or t
acacacccacacactcgcccgcccactgtcctgggcgccctggaagccggcggcccaagcccgacttgctgttttgttctgtggttttcccctcccgnggtnaagaaatgctgccggcctgtctgtctctccatctgtttggtgggggtagagctgatccagagcacagatttgtttcgtgcattggaagacccaccccaagcttggcagccgagctcgtgtatcctggggctcccttcatttccagggagtcccctccccggccctaccagggcccgttgggttgagcccctaccccacaccaggccgtccttccgggccctcccttggaaacctgccctgcctgagggcccctttgcccagtttgggcccagttgggttttgccaccctacctgttcagtgtcccgggcccgttgaggatgaggccgctaaaggcctgaggattagctggaaggagtgaaaggggacaaaaccccccttgttggagcctgcagggtggtgctgggattgagccagtcccaggggcatgtattggcctggaggtggggttgggattgggggctggtgccagccttcctttgcagctgacctttgttgtcctccccttggggggttgagagccccagctgacatggaaatacagttgttggcctccggcctcccctcaaatataaacagggaagacatgacgg

SEQ ID NO: 624979 - DNA, 383 bp, Homo sapiens
atggtccagcgtaagtactagttacattaagcagaagcattactattaagaacaggcaagttcagtggctcacgcctgtaatcctatgtgctttgggaggccaacgcaggaggatcacttgaggcaaggagtctgagatcagcctgggcaacaaagaccccatctcttaaaaaaaaaaaaaaaaaaaaaaaatttaaattcagttggggcaggggggggtatgccaacaggtcctagcaatgtggggcaggggggtcggggggggaggggcccttgagcccaaaagttaaggggacagggagctataaccagtagactccactacaatccagcgggggcacaaaaacaagacccggtcctcccaccaaaaaaaaaaattcaca

SEQ ID NO: 624980 - DNA, 417 bp, Homo sapiens
gacagtcgagatccccggcaccagcgccccaagtgacactctttttttttgttcgctttttgagatggagtcgtgctctgttgcccagcctggagtccaatgccgtggtctcggctcactgcaatctccgcctcctgggtttaagtgattctcctgcctcagcctcctgagtagctgggactacaggagcgtgccaccacacctggctgattttttgtatttttagtagagatgggatttcaccatgttagccaggatggtctcaatctcctgacctcatgatcctcccgcctgggcctcccaaagtgctgggattacaggcatgagccatggcgcctggcctgcactttcaacttttcaatatttccagcgtacaatgggcatatagagatgtagcaccatggtacgtgaggagct

SEQ ID NO: 624981 - DNA, 866 bp, Homo sapiens
  misc_feature (34)..(34): n is a, c, g, or t
  misc_feature (88)..(88): n is a, c, g, or t
  misc_feature (144)..(144): n is a, c, g, or t
  misc_feature (146)..(146): n is a, c, g, or t
  misc_feature (164)..(164): n is a, c, g, or t
  misc_feature (204)..(204): n is a, c, g, or t
  misc_feature (208)..(208): n is a, c, g, or t
  misc_feature (235)..(235): n is a, c, g, or t
  misc_feature (237)..(237): n is a, c, g, or t
  misc_feature (279)..(279): n is a, c, g, or t
aacagggtttggtttcgccggaggctgccccgcnttttattttcccaaaggcgttccgcgcgcccagcacaagaaaccagatggagantccccaggagcacggaggcccccttggcccggcggcccccttcccgacatcacacncnagcaaacttcgccccgcnccacttgttccttgggcgccccttggagagcccggcggcnccanagccacgactttgcttgtttttgtttntnttggtttttcctccttcccttgggtttcagtaaatgcttgcncttcccttgttcttttttcttccattcttgttttggtgggggtagagctgatccagagcacagatttgtttcgtgcattggaagacccaccccaagcttggcagccgagctcgtgtatcctggggctcccttcatttccagggagtcccctccccggccctaccagggcccgttgggttgagcccctaccccacaccaggccgtccttccgggccctcccttggaaacctgccctgcctgagggcccctttgcccagtttgggcccagttgggttttgccaccctacctgttcagtgtcccgggcccgttgaggatgaggccgctaaaggcctgaggattagctggaaggagtgaaaggggacaaaaccccccttgttggagcctgcagggtggtgctgggattgagccagtcccaggggcatgtattggcctggaggtggggttgggattgggggctggtgccagccttcctttgcagctgacctttgttgtcctccccttggggggttgagagccccagctgacatggaaatacagttgttggcctccggcctcccctcaaatataaacagggaagacatgacgg

SEQ ID NO: 624982 - DNA, 970 bp, Homo sapiens
  misc_feature (35)..(35): n is a, c, g, or t
  misc_feature (71)..(71): n is a, c, g, or t
  misc_feature (84)..(84): n is a, c, g, or t
  misc_feature (94)..(94): n is a, c, g, or t
  misc_feature (100)..(100): n is a, c, g, or t
  misc_feature (113)..(113): n is a, c, g, or t
  misc_feature (141)..(141): n is a, c, g, or t
  misc_feature (144)..(144): n is a, c, g, or t
  misc_feature (176)..(176): n is a, c, g, or t
  misc_feature (217)..(217): n is a, c, g, or t
  misc_feature (221)..(221): n is a, c, g, or t
  misc_feature (284)..(284): n is a, c, g, or t
  misc_feature (287)..(288): n is a, c, g, or t
  misc_feature (347)..(347): n is a, c, g, or t
  misc_feature (349)..(349): n is a, c, g, or t
  misc_feature (422)..(422): n is a, c, g, or t
  misc_feature (476)..(476): n is a, c, g, or t
  misc_feature (496)..(496): n is a, c, g, or t
  misc_feature (574)..(574): n is a, c, g, or t
  misc_feature (589)..(589): n is a, c, g, or t
  misc_feature (618)..(618): n is a, c, g, or t
  misc_feature (620)..(620): n is a, c, g, or t
  misc_feature (630)..(630): n is a, c, g, or t
  misc_feature (636)..(636): n is a, c, g, or t
  misc_feature (638)..(638): n is a, c, g, or t
  misc_feature (644)..(644): n is a, c, g, or t
  misc_feature (647)..(647): n is a, c, g, or t
  misc_feature (651)..(651): n is a, c, g, or t
  misc_feature (654)..(654): n is a, c, g, or t
  misc_feature (662)..(662): n is a, c, g, or t
  misc_feature (675)..(675): n is a, c, g, or t
  misc_feature (690)..(690): n is a, c, g, or t
  misc_feature (697)..(697): n is a, c, g, or t
  misc_feature (722)..(722): n is a, c, g, or t
  misc_feature (756)..(756): n is a, c, g, or t
  misc_feature (766)..(766): n is a, c, g, or t
  misc_feature (770)..(770): n is a, c, g, or t
  misc_feature (827)..(827): n is a, c, g, or t
  misc_feature (861)..(861): n is a, c, g, or t
  misc_feature (885)..(885): n is a, c, g, or t
  misc_feature (923)..(923): n is a, c, g, or t
ggggggggaactggttagggggcggcagggggggnggggggctggcactcaggcggggactaggcgggggnggggctgcccccnggcctgttgnggaganactgaggccagcnctggcggagacctagcccagcggggtanggngggtgggggaaaactgggtctgaaggaatganggccccctccctctgggctttcctcctagagggccttagtncctnctgctggctgggctgcacgacccccaatccttgctcccctaacccgtttttgggggccagatnttnnagggcagtggacagggagcctgggggagttggggagcgcagggcagggtccatggtgtncngagggggtggcagctacctaggtggtcagttcctggcagcgatgaccacagagagttccaaaccccccaaggnaacagcagttgccccaaacagccacttccatgggatggaccaggcacccttgcnagggcacttagcaggtagcnggctggggttgcccagcattttccggtacaaggcggtctccgtgctccgctgcgccgcatgctttttcaccagctttnagagctctgcgtggnttgtcttgttggaaggttccagcttcagngntgctcttatntttttngntggggngantgtnctncccctgcngggccagcccctngcccttgcggaaganagctttnatgttgtttggctggtgctccagcncaaggctgcaggagcgcagggctgcgcggtagtngtcgagcttnagcngcgaggccgccaggttgttcagacacttcaccttcaactgcaggagctgtgccttcncctcgaacgttatgtccactttggcgctggaggngatagctttgatggcgaggtcgtnggagttggcggccaggacgaatgcccccgctggtagtnggcgttgcgcactcccgcttccggttggcagggcacgcgctcttccc

SEQ ID NO: 624983 - DNA, 979 bp, Homo sapiens
cgcacattcgcagcccgggcagccctgcttgcgcaccgggcctcgcgccccgtgccccgtgccccgagcccctgagcccctgaagccggtctccaggatcatgtggtatgtcagcaccagaggcgtaaccccagcgggctcaacttgtgagggggcccgtctttctcatggctatgcaccgtgacggggcgtccttcctttatgccatgaagagcctcccacagcttggacacgagggacccatgttgaccagttggaagacacgagctcgtcctatcctgtgccttggtgaaggagctggtgatgcccatcttcaattgtgtgctcgtgagactcctttccacaaagatgaagttaacactgactcgtagatcgacccgaagcctttcaaggcacggattaccggtccaccagaacgaacgtgggtccaatcttgtcccaggttgacaggagactgcggctgaaaccgtgatatggacgccttgttgtgcatttgtcgcggtcaacatctattgccattttaaatgcggaacctggttccccgtgttcctttgacagcaaaccaaccaggttctcccgtggcatcgtaacctttacacttggagacggacagcacgcgagacgaaacggccacgcgattccaccataggctgcggtatatgctaccgtggagaccacttctttggggggagaaaccaaccaggtcgcgaacacgtttagcttgcgcccaacttatcggaaacaaaagcttggttaccatacacggcgtgcggccacagatacggacagcccatgttgtcgaacacaatttgaagtccctgcgatctcctatggcgttaggcccaccacaacaaggaggtaccactcatgggaccacccccacaaaacgcgcaagttttccaacgcgagaagccttcctcaaagcgaatttagaccccaagcacggggtagccctctagcaaagtcgcacacgaacacg

SEQ ID NO: 624984 - DNA, 374 bp, Homo sapiens
gtcttcagtagtgccaatgacatactgaattgcagagagtaataacaaagcttaagggttacgtgaagcttgccctctgtgtgtaaccagaactagggtaacattatatgctggcacatggtatgaatctgacacagaaatagggggaattgagtcacaggaagtacagctacctgatcatgtcctacaaggcatcgtcaagaaatggacaattagatttactttccactaccatactgaaccatgtacaaatatcttgggtggctgcgagatctgatcctaggaagaaatatcccttggctctcgtaacgatgtagataactcagtagtgagacatggatagagcgggagtgagtgagagtgttgcatgtaag

SEQ ID NO: 624985 - DNA, 427 bp, Homo sapiens
ttttgagatcctctccaaagaaccaatgtatcagtatgttcagctcacctgttctttgttcttcattttaactatacaattcatcattctttatgtctctgtgcccacagtttcagtaacaaatcccctcctagcctctgtcacctgctctgacctgagtcacctttagtcacctggtccgtaaccatctttcctgtataaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctttcgccattgcaccatccatgagacgcacttttgtatagaagtaaaattgccttgctg

SEQ ID NO: 624986 - DNA, 308 bp, Homo sapiens
  misc_feature (191)..(191): n is a, c, g, or t
  misc_feature (196)..(196): n is a, c, g, or t
  misc_feature (207)..(207): n is a, c, g, or t
  misc_feature (258)..(258): n is a, c, g, or t
  misc_feature (268)..(268): n is a, c, g, or t
  misc_feature (283)..(283): n is a, c, g, or t
cttccaagctcctttgtctacctgtatctatagagggaggattgctacccactaagcctcctcctagaagcaactttagctcatcatcaatcctcagactggctcagcagctcactaagtgttaaagcacaaagggatctatggaagggagatgactaggagagggaaaatcttccaattagaaatctatnactgntttacaggtantaatctggaagtggccttactatataaattggatccatctaaactggagancacactgggnacttaaagaaggganctaattaaataaataatggcttggg

SEQ ID NO: 624987 - DNA, 779 bp, Homo sapiens
  misc_feature (340)..(340): n is a, c, g, or t
  misc_feature (706)..(706): n is a, c, g, or t
  misc_feature (763)..(763): n is a, c, g, or t
  misc_feature (779)..(779): n is a, c, g, or t
cttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttaccnaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgagatgatctctatggggccatcaataagctgtgctgtgtgcagtccccagtgccctcccaggttgtcaatgttcgaaccattggtcagcccaccaggcttaggagtgtggcccagaagattttacttcagattaactgtaaattgggtggtgagctctggggagtggntattcctctgaaacagttaatggtgatcgggatggatgcttaccatgaccccagtanaggcatgcgctccgcn

SEQ ID NO: 624988 - DNA, 181 bp, Homo sapiens
  misc_feature (167)..(167): n is a, c, g, or t
atagaggatcccctgataggcttctcagttagccttcatgcagctcatttggcagtatagctagaacactatcaagagtgcttatcctttaacctctaattgccgtgttactagacttttgggcccagagcatatgcccctctcaattgtttcttacgtttgtaccntttcacgtcgagtt

SEQ ID NO: 624989 - DNA, 775 bp, Homo sapiens
gtgtttcagtatcagtgcttttgagtgtactttaacaagtatagtaggcacggatggatttcgtttgaaactacccatgctgtccaatagcaagttaacggaacctagcgcatcaaatctggtatctcttcattcatgttggaacccttattttctgcgaaaagaccgtagtcctggaagtaatcaatgccatatagtagtttggcacactgctttattttctagaggctctgggagcaaattacattcatcgacattacctctgctctctcaatgattaaagtctttcagcaacattctttattgtcatcagtaaggcacaaaacgtgtttatcgtcaaatgatatgtcaggtctcacattgtaggtttaggcacgtatagattagtcattcagtaacattgcattgtcctctattggtaaacgagagactacataggtgacattctcattgcctgtgtctgcaggcttcagaggtacctggcacgcttactcaagcaaaatactagaaacaatcgagctttacttcaaaagcatgtgcctctggtaaattatccatcactttggattttaagagtggtccctccaagaatacatgtggcatacacagatgggtaaggttgtaagagcatgatgtacatagatgacttgcaagacgcctgctccttacatgcactcatggacaaggccctggtctgtatacgtaataggctgactactgttctagtcattctaacaaggtgacttggccattggaactttcgtgaagagaactc

SEQ ID NO: 624990 - DNA, 383 bp, Homo sapiens
gaccctgtgcacagcacatgctcttgtgccctccacaaatacttcaagcacagccttatggcccacttgaataactgataggttcgtggcccctgtgatcctggacagtccacccttcctgtgtaaaggctcccacaatgcccacctggaaaagtatgtcgtccaggtaatagtcccgcgaaatgatactctttggcagatagatctcacctctctctctgaactccaaagagtctctcccgcgcttcagggtctctgggaacagcatgcgcttccacttcctccctcgtgtcttgatcagggagtatagagagtgctctgcgcatcatctgtgtacctcagctcccccgcggcacagcacatctccgtgtcccgagagtgcg

SEQ ID NO: 624991 - DNA, 235 bp, Homo sapiens
attccgaacgcgggcaattccatgtcctaaccaaactaaacttcataagtgaaggagaaatagaccctttttcagagaagcaaatggtgaaataatttgttacgactagacctgccttacaggagctgctgaaggaagctctatggaaaggaaagaccgttaccagcaagttacaaaaacacacttaagtacacagacaacgttaactattaagcaaccacaaaaaggagtctgt

SEQ ID NO: 624992 - DNA, 111 bp, Homo sapiens
tgggggataaaaaaaaggccttttttagcctgggcataagtgaaatcaccaaaccccttgggggggtgggtaaaaggcccttccaaatgcataaccctgttccaatgttta

SEQ ID NO: 624993 - DNA, 441 bp, Homo sapiens
gcacagagaagccaggttacaaactacctgggcatcgagtggatgcgtaggcactttgctccagactacagagtacatatcatctcttttaaagaccccaatccaatgcacatcgatgccaccttcaacatcattggacctggtcttgtgctctccaaccccgaccgtccctgtcatcagattgatcttttcaagaaagcaggatggaccatagttactcctccaacaccagtcatccccgatgatcatcccctctggatgtcatccaaatggctttccatgaacggtcttaatgctagatgagaagcgcgtgatgggtaagatgccaatgaagttccaattcaaaagatgttttgagaagctgggtatcagtaccattaaggttaacattcgaaatgccaattccctgggaggaggcttccactgctggacctgcgacgt

SEQ ID NO: 624994 - DNA, 84 bp, Homo sapiens
  misc_feature (27)..(27): n is a, c, g, or t
ggatttgctggtgcagtacaactaggncttaatagaggctcgaattcgagatcccgaacctgaacttctgttgaaaaaaaaaaa

SEQ ID NO: 624995 - DNA, 113 bp, Homo sapiens
gcactgacaaatgctgagtttcagaaggttactcagggatctctacttcaaacggacatataggtgggttagaaagggaattacaccccttcctcaacctatttctgttctgt

SEQ ID NO: 624996 - DNA, 753 bp, Homo sapiens
attctagaggccgaggcgggtggatcacctgaggtcaggagtttgagaccagcctggccaacatggcgaaaccccgtctctactaaaaatacaaaagttagccgggtgtggtgatacgcgcctgtagtcccagctactcgggtggctgaggcacgagaattgccttgaactcgggaggcagaggttgcggtgtgccaagatcacaccactgcactccagcctgggtgacagtgagactctcacaaaagaagaaaaaaaaattcccaaccttgccaacataacaagaccatgtctctacaaaaattttaaaaattaaccaggcatggtggcgtgcacctgtagtcctagctactcgggaggctgtgacaggaagatcacttgtgcccagaagttcaaggctgcagttgagctgtgatcacttgtgcccaggagttcaaggctgcagtgagctgtgattacaccattgctctccagcctgaattcacagattgagaaccctgtctcaaaacacaaaagccccccgacctcaacagaaacacttgttctgagctgaatgcgagttcacagggacttgacactcctaggcagaatacacttcatttccgctctgccatttgcctatggagaacctgatgtgggccagataccgggatttagccgggattaatgaaagcccgcccccatacgccgggcgacccgcggcctcgcccactttataccagggccatgtagagatccccactctccacgatt

SEQ ID NO: 624997 - DNA, 1863 bp, Homo sapiens
  misc_feature (81)..(81): n is a, c, g, or t
  misc_feature (215)..(215): n is a, c, g, or t
  misc_feature (252)..(252): n is a, c, g, or t
  misc_feature (254)..(255): n is a, c, g, or t
  misc_feature (506)..(506): n is a, c, g, or t
  misc_feature (1246)..(1246): n is a, c, g, or t
gggcggtcgtggaagaacaaggcgccttacgacaaggcggcgaaggagaggttagccaagacatgaaagtggtccgatccnatttgctacagaaagattaggtgactgatggtggagcacgcacctggctactgttcctatctcattacaagaatagtacttgggagaatgactgctgcgctcgagacgaaggaagccacgaacggtagagacanacacatgagctacttcggtgatcgcgctccttcagangnnggtcgctaggtagtgtttgggacaaaggttgtagggtacttcgtcctggcgatctcttgtccacgccacattggaacttgaacacgatttcgcctaatttgtcatggagagacactttccaaaagcacttgagttttgacctggcacatggattcgctctccaaggcgggatcacacataggagctgtccgtggaacgtgaaagcgtctctccagtgggacaccatgggacagtcatttcaccccaggtgntacgaaagatactggtggttacccatggtgaatcctacatatacaatggggcttacccacagagatcccatgtgagacagtcatcgaacgttgtgtggcatgttcgaagcaacttaaagcctggagttgcggacttgaccttttaggaatattgccggatgccttggtattcgttagtagcgttggggggttgaatctggatcgtcataagaggagaaaatctcggcggaatcgaaaattgctaagggaaatccaccggggataggaaatcccgttcctttggattgaccttcaaggaaacacaaaacctaaggggttacccggggcttagaaattccaccggggaggaaagaagacggatttggaactcgggacactagttccattgggagctcgccggcacgcaaaggggtgggcgacagaacaaaaaagagttgaacactttcggcaaacaggacaccgctgggcttccaaacttagaagaccttttggaattttcccaaagaaagcaaagtctatctatggggacaccaacacggaaccacgttaaggacaacaagagaggcgcttaggccccaaagatcctaaagtttgtgaattcccgttccgtccccaattggtaattggtgcgtgttccggtataaggagaagacaacgttcaagaaaaagtgggctttgggaaaggcaaacggcgccccaagaggtttgtggacaatcttctgggcgggaacaagaggctnccgatttggcggagggctatcacacttggggtgaaaaaggggcagcgtgagggttccttggggaagaacagggccaactagggcggacccgaggacgagggtgtggctaagagtgttgagaaccggaaggcttgaattggggttgattgtaaagcaaccggtgttcccaggataattctgggtccgcacacggtttacaggaacttcacatagtcggtgtgcccacgtcttacacaagggtggctcattcggtgtgtgaacagcaagcacaaaaaaagaaaagtctcggagaggaagcaaaagataccgggggctgcggcgaacaaacggggatatctacaagcgggccccagtggcacataccccggagtaccggtgagacgagcccttttggacagacaagcgggcacacatcggcggcgccccacataaggagcgagaatatatgactaaccacggtcacacgcacagagagcgtacacaacacggcgaagagaccgacactatacacacagacagcgagcctgttactaagcgacaacacgcgacagacacacgagaacgcaacgaacgacacacgactatatagcatagacaacagaccacacacagatcag

SEQ ID NO: 624998 - DNA, 1992 bp, Homo sapiens
  misc_feature (1783)..(1783): n is a, c, g, or t
ggacgcgtgggtcgcggacgcgtgggtcgacccacgcgtcggatcgcgagggccgcccttttttttatttttttattgtgagaaatatttgtgggattttttaaaacatgtgattaataagtggctgagattagttctacaggtgtgcagaagtgtttaagcacccactttggtatcctttaaccgtgttaagtggcagcctatagtgggtatagacacgaccatgtgttcataccatacatttacccaacaaatacaaacacaaaaacaccacgttgcacatgtggcggggcaatatatctcacatacccatcttctcccacggatagacaacacacgatggggtgtgtttgcgcgagaacaacactctcatatggggccacgttgggaccacccccacgggggaacatcctgctgtggatatatctcagcggcccacgcggggcgacacatctcatttgaggaaagctgtgtgatatataacacaggcgctcacatcagaggggtagtatatatttcttcccccccagttgatacaccactgaaagaaaatatttctcacacgctgtagtgagagaaatttgtgaggcgaacaaccacacacatgtgttgacgacgagagccgcaagcgccagaaacacaacggtgctcgaatgacgcgcagtgtgctggcacaccacacaaaacaccacaacacagacaagcgacgccatcccgtaggagtgaggagctgcacaaccaatatgctatcagacgacgatcatgcagcgcagcgtggtggagacgccccaaattatagtacgaacaacccaaaccgcgacgggagcaaaatggcgacgggacaaccacactccgcgagcagctactcatcaactacctaccgcgcacaaatagagagaccgcacgcgccaaacaatatatggaggggcacacagacagccgcaggagacaacacaccactgattttgcatcagccgaacaccacagacagaacacaaacaaactacggcaggcgggcagagacgacgcgcgcagccaacaataaagacgggaacgaaaacacaccacaccgacaaagaaggagcgggggcaccccaacagcagcagtcactaagaaccgcgcaaccatattaaaccacgacagagagcacactcaagcactcggagtgcctccaccaacaagaggtggaggggcacccccccacaaaataagagaagagacgactgcaccaagagacgttagacgaagacagccacctatcgaaccaccagcgtggagcacgaccggacaaccaaattacacacaacacagactgagaacagccagacacagcatggcggcgaccacaaccacgcgagtcgcacatacaaccgacagcagggggacaacaacccactatagatgatgaaagaaagcagcgagacaccacaccactatcaaacccacggagagacgggcgacggcgacccaaaaacaatggaggacgacagacgaagacacacccgctcgatacggcagcggaggaatacaatacagaacgaccaacaacgggagggcggcaaccctcatagcaacagcacgcgctacagacggggacgaaactacgagctggggggctgacaacccaaacaagacgcgcagcaccgccaactctcacagtcgagcaggccgcagcagaacagacattattagacgcgacccgacgcgaggagatcacgtagacataagtacaggcatcacatttatctcacgggcgccgcggcagcgcacataaagacactnagtacagcgcagcaccacgacagacctacagacacagaccggcagccgagcagacccagccccgccagcataagtaagaggtacgtcatagcgaggacgatcatccgcagaccaactaacaaactaccaaacgccatccagacaacaaacacgacaagaccaaaccaagacgaacactatcagaccacaaagacacacaacagctagaa

SEQ ID NO: 624999 - DNA, 268 bp, Homo sapiens
ttttagaggagcagattgaaagaagaaaacaccacagtgggggccagtcaatatagtcataatgtcataggaggtgattaaggaatggttaaaaaaggaaaatccgaggaatcctttccggggaagccatccaaatgaatttttgggggaaggaaccagtttaaaagtcatgtaaaattttgttgtggaggaagatgggaattctttaccaccatttaaccccttggtccccgttttcattaaaaatgtaaggcaaacgatggccagg

SEQ ID NO: 625000 - DNA, 466 bp, Homo sapiens
gctcggcaccccggcaactgcttcggatgctgaggtgggaggatcactgcaacctctgcctcccgggttccagcatttttcctgcctcagcctcccaggtagctgaaactgctggcgcgcgccaccacgcctggctaatttttgcatttttttaataaagacggggtttcaccatattggccaggctggtcttgaactcctgacctcgtgatctgcctgcctcggcctcccaaagtgctgggattacaggcgtgagccacagcacctggccaatatattttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcct

SEQ ID NO: 625001 - DNA, 140 bp, Homo sapiens
cctcaccgtttatataaggaggtgcacttactgtacttccccaatattgtcatcaaaggatcggagctccaatcggtatggttgtaaaccattcatgagaaatccatcttcatgatccattcacctccaatgtataaacg

SEQ ID NO: 625002 - DNA, 329 bp, Homo sapiens
  misc_feature (146)..(146): n is a, c, g, or t
  misc_feature (159)..(159): n is a, c, g, or t
attgcgggcttggttctagatcactgcaataaaacaagtatcgcaataaaacgagtcacataaatctttggtttcacagtgcatataaaaattatattcacggcatactgtagtctattaagtgtgcaatagcattatgtctaatngatactttaattnaaaaatattttattgctgtaaaatgccaacaatcgtttgagccttcagtgatttgtaatcttttttctttgatgagacggagtctcgctctgtcatccggtctataatgcaatggtgtgatcatggctcgctgcatttttgaattcctgggcttaggtgatcctcctgcc

SEQ ID NO: 625003 - DNA, 332 bp, Homo sapiens
gaaaaaaaaaattttcttccccccccccaaaaataaaaaaccccgggggaaaatttttttggtgggggggggggctcttgtggtgttcggaaaaaaaaacccttttttttgaaaaaaggggggggcggaaaatggggaaagcccccccgtgccttttaaaaaaaaaattgggccaataaaaaaccccccaaaatttttccccacaaaaaaaaaaatatggggacccgtccccacctttgggggggggggcccaaaaaaaaaaacccccccggggccccaaatttccaaagttttcgaccccctttttgaaagaagggcttcccatcatggtg

SEQ ID NO: 625004 - DNA, 232 bp, Homo sapiens
ggggcaccgagttcactaagctcgaagggcagatgggagaggatggaaactctattaaagtgaacctgatcaagcaggatgacaggcgagtcccccatcagacactatctggtcaggataccgagacgaagctctccatccgaagtggaaaacagaagatcagagctcccagtctggcagatgaccactgtcatgctgataatccctggaactggacatgctgagatatgag

SEQ ID NO: 625005 - DNA, 118 bp, Homo sapiens
tgagaacacttacacgtttgtgcaggtccattttgaacaacttgaaagaccgtaaaactttgtggttgccacaagcgtatctttcttttgtgctaatccaataaacagctgtgccata

SEQ ID NO: 625006 - DNA, 400 bp, Homo sapiens
tctcaggatggaactggaaatggcgaatgaaactgagatggcaagtagaaaacactatctcttctatgacggagaatccgtttcaggaaggtaaacctaacctttaagcactggaaagagtagaacaccaagaattagaattgatttgtaggtcaattgaacttttcaatgacaagaggtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagattcggtaaaagagtatgatcttatagttcaccaagcttgccacc

SEQ ID NO: 625007 - DNA, 540 bp, Homo sapiens
aaacaactaaactgatctaacagatagaattgtgttgcttaactgatctaacagacagaattgtgttgggcctgtgagctattccctgggccatttactggtggtgggggtgggggagtcaccaaaatgaagtagcaatataaacctgtctctgagcctccctcttgtctgtttcctcatgaactgtgttttgggcacagagagtcttgcactcctaatttctttctgttagtccagcacagaacaggaatgggaagggaagaaggggagaaggtgagtgggggaccatatttctacagtttttctgactgctactgggtagataaatcaagagctctgcctgtaggtcttggatatctataattgggtatgaaaagtggaagaccctgatgaattctccaaaacaaagctggttttgtctcttgtagggttctgtgtagcctcacctagtgccaccgtaatttccttacttgagggagaccagcaccctggaaacgaactgggaaacctgccttcttccagtcaaaacctgcctaaaac

SEQ ID NO: 625008 - DNA, 427 bp, Homo sapiens
tgagtggattgtctgagaagagacggatggatttatgttgtgaagtgagattgagaacatgagtggtcggcccaagggaatattccaaatgtcagtgtcaaggaagggctggtaagtgcagccttttctcctggaatgggatgctccagaaggcaggggcacgagacgaatccgaggtcagtgagcaagaactcctcttctgggtaccagaggtccgacctatgtcctgggtctatggcatggcctaggagagtttgatggtggtgtaggggcccagatccctgtcgtgtaaccactccttggagtggaagaagtcggggctggtgcctgttccaccggtctttaggccaggcctcaactcaggtacttggtcggctcgtgggtgctgtccaggtgatcattgctgcagttgtcccgggccctgtgt

SEQ ID NO: 625009 - DNA, 153 bp, Homo sapiens
  misc_feature (117)..(117): n is a, c, g, or t
tcgcggcgctcctgtattcatgctttttgatatcaactgtagacatgacgttaatttgttgtatattgctgagaagtatagtctgccatgaaaggtcattatatattcattcatccngtttatggactatttgcagttgctagcttgtagttt

SEQ ID NO: 625010 - DNA, 173 bp, Homo sapiens
agatgtgcagagaaccaccccaaccaaatctcatgtccaattgcaattcccagtgttgagggagggacctggtgggagatgatgggctcatggcggctgagcgtcccccattggtggtctcgtagatagatgagtagagtgctcatagggatctggattgtttagaaagcatg

SEQ ID NO: 625011 - DNA, 130 bp, Homo sapiens
ctcctccttgcactcctcccacaagaatatggtctggtgtcccagccaaagcagtggggagctcagccccatcagtgtcactgtcagaactgccatgcaggagctccaggagcctcagacacaccatgct

SEQ ID NO: 625012 - DNA, 266 bp, Homo sapiens
gcgctggcggaacatgacgccagctactgagcaccctgctggcatgagactccttgagaggtggggagcacggggccttcaggactccgactgccttcttgttggtcttgtctcatcaccttgcttgagggtgagaagacatgaattaaggcctctcggccgagccgtcattcctctccaggtcctccttgaagcagaggaacagcgtgtccacacacatgccatagacgctgaagaaaccgtgtgcaatcaagtaggagccaacg

SEQ ID NO: 625013 - DNA, 891 bp, Homo sapiens
ggatacgggagttcctccttgctctcgcccctactctttctggtgttagatcgagctaccctctaaaagcagtttagagtggtaaaaaaaaaaaaaacacaccaaaggctcgcagccacaaaggggatgaaatttcttctgggacatcctccggcttctcccgttacgggatcgtctgctccctaaagtcctttcgtgaagctttttattcctaagaggagaaaatcagtcaccggcgaaatcgtgctgattacaggagctggggcatggaatggggagactgactggcctatgaattggctaaacttaaaagcaagcgggttctctgggatctaaataagcatggaccgggagggaaacagttgccaaagtgcaaggggacgggggtgccagggttcataccttgggggttagactgcagcaaccgagaaagatattaacggctctgaaagcaggtgacggcagaacaattggagatgtcagtatctagtaaataatgctgctgtagtctatacatcagatgtgtgtgttccaagatcctcagatggaacagatttgaagttaatgtacttgacatttctgggagtactagggcatgtcttcctgcattggcgaagaataaccaggccatattgtcactggggttcggcaggtggacatggtcggtcgccttctagggtgaggtcaagcatttgtggcggggtcccacacttcgacgggaagtggggctcacataccgggtcacacaacggggtctatcgcacgggccccgaaacctaagggagcccggacggaggacagggcgcacggggacaggcacgcaaataaacgagagcggtcgtaaacgtcgcggcgagacccgagaggcagagcccccgcgcgagagggtgc

SEQ ID NO: 625014 - DNA, 906 bp, Homo sapiens
cgactgtggggaaccccccctcagtggggcgccaagagtgaggagtaggagcgtgtttcgtggcaggctctcaggggggaggacgtagtagatagtggcgggtgggtgtgaggcagcaccaaaagggggggccataagcgccttttgggggaggaatatttgtaggcgcgggtgggaccgcgctggggtgtgcaccggtggttgggcaccgcctttggctcccgagaactctgctgtgatgggggtcgtccacaccgccgttgggggcgcataatatatttgcaggcgagcctcgcgggttgctcccgagatgtcttgttttttgggtccccccctttgagatgagccgcctgttggtgttgtcgccagccccctcggtgtggggtggccacggcccaaatgtggtgtcccacgcgcaagaaactcgcgttccaaagagaggccgccggcgcgccaggtgagctaactctcctgtctcgcagctacgcactcctatcgtacctcgttggcccacggtggtgcagccaccacacgcgccgaagacatcccatcttgagcagcgccctcgggggtccaaattcaacgcccccctctcttggagcgcgcagtgtctccctgtgtctgtgtagatacacccttcgttcttcggaaggaaatttcgcgcactgtccatttctctcatacgtgttctaactcgagagggaggatccctcacccccggcgtcccctgctgttataagacgtcgcttctcaataggcccacgcaagtgtttttatatcagaggggcgtttatctgatctgtttctttggagacaaaatagttggcgccttcagccctctcgaatgacgatagttttgagaacgacgtccccctggaaaaaaaacccccagggtcccacaagaca

SEQ ID NO: 625015 - DNA, 324 bp, Homo sapiens
gcaggagaatcgcttgaactcgggaggtggaggttagagtgagccaagattgtgccattgcactccagactgggtaacagagaaagactccatctccaaaaaaaaaaaaagggggaaattagggggaccgggtttcttttgcccaaagatggggtaaacggggacgctttaggacggttttggccattggaggacggaaaattattgttctcaggcctgtcttgggggggaacccaaaaaatttaaatcccggcttttgggaaaccccccatctttacaaaggtaattttaaaattaggcgggggggggggccagccatttgtg

SEQ ID NO: 625016 - DNA, 400 bp, Homo sapiens
gcgtcgacgtccaggtccacgaacaccacccacaaggcctgcttctgccgctcggccgtgccgatggcctgctcaagatgatggcgcacgatgtggcggttgatcaggccggtgagcgtgtcggcctggcctggaattccagttcggcttcatagcgcttcatcgaggtgatgtcgtagagcgccgccacgaaatgcgtcaccacgctactctcgtcgcgcaccggggccatggtagaaatcgttccacagctcggagccatccttgtgatagttgcgcagtacaacattgtgttcgcgctgttcgccatgggatccagacagtctcgaaccttcagaatgctgtcgggccctccaggaaacgaatgctcttgccaccggttcacgctgtgtagccatga

SEQ ID NO: 625017 - DNA, 199 bp, Homo sapiens
atttagaggatcccgtcccacacctgcacggagtccactacctgcacctcaccggagtcaaagtatttagctgacttgcagcactccacggaagctatatgaaatgatctgctgcagtgctctgagccctaggatacatcttacttttcaccgtaggtggactgagtggcattgtattagcaaactcatcacgggtacc

SEQ ID NO: 625018 - DNA, 1326 bp, Homo sapiens
ggtcagctggaataaagagagacatcgggggaaatccgcgagaatggccagcgatcctgtgctgggagcagagctagccgagtagggcgcccggcatgtcaaactggccggcgcagtgcacgcatgggccgacccggagcggtcgcagagacccgtcgggagtcgtagtccgggacgggcccgcggaattgtccgacgacgcaagcatcgggatccgggtcggggatgatcaggcacgggattgcatgccgggacaccagatcagacgcgttagaccaaccagacaattgagcatgacaagacggcatgtatactcccgtaagacacacctcgcatcaacgatcgcgcattcgaccatcgaccatcgcactgaaccgtgccagatagaccctttggcataccaaggcctttaacactccgaagaccgacatacgggacccagaagccccgaaccgagggacagaagagatgccagacagagacggaacagagatgcacaagaagccgacatacgcaaccccacatgagacagggaaggaccaacagacacatccattgaactgcaaacacccgagaggaacaaaacagagaacaccacaacacacaagaaacatcaactaaaccgaaaagaagagacagacgaaacgggcaaccacaaactacatcggatgaataccgtaaatcagcacatccatacgaaaagaacaccacaccacaagagataacgacagcatattgagacctaacacagcaggggcaagaataaccctcaaccatggatgcgcggtccacctaaatttacgaacacaacaagccacagaatactgagatccaccagatacctgcaaggcgatctttcgacagaatgcaacaatgggtcctttacactgccaaacaaaataaacaatttacgaacaattatatatacatggacagacacacatatgcgagggcaaattcaaatataaagaaccagtacaatatatacaacgaaaagcgatttcaaacaacaccaccagtcacaacaagacaacaatggaaaggatacctatagcagacgcaacacatcagaggatcatcgagaacacatgcattgcgtagacggaccacactctacacacactaacacaccacttcaacactaccacaccaacacgatcccacaaacaccaactacctatcaacacgacaaccaaaaacaacacttccgtaaccacaccagcaacacacaaaccaatcaaacattatacatacaatcataaaacaacaacactaacatatgatattacacagtaacatactcaaatacacataaaaataaataat

SEQ ID NO: 625019 - DNA, 1150 bp, Homo sapiens
ttctgagtctgtgattgtttactgttgtctgttgtctgtttgtctcctcttgctcagcgccgttttcttgttgtccatgttctgttcgcgtcatgcttggtgttgtggccttgtggtctccgtgctttctctttccccgtgttggctcctctccgttggcccattctcgcttccgtcccgcccggttgggcagcccccggttgctggtccccgtgttttgttcgggcggtgttatgtccacgcctttgatcccggcccgtccatcgcccctgttcggtgtgtgatcccgtgtggctttattgcgtattggtcgtccccagttttgttctttgtcactggggaattctgtctttctctttgggcccgttgcgcaattggtgacctttgcttattcctgcagaactgccctgggttgtgcggtcccaccagccagttcctgttcgtgtcagcaggaccctaggggccacgccttcacgatgagtgacctcccgcacagtgcagccaccctctccctgatggtctgggagcctggcctcaagcaaggggccttcctgagcctctggctccacgtgaagctgaaagtcctcacctttgttgggtcacaactctttacacatttcttgtataggccattcttggcacacaccgctggggcttaaccacgtggcccacggtaaattcttttgcttttcactggacctatggactctgttccaagggattctgagtcctctttgagaattcttgcaccacgccctatgatacacatcccttttgagtataaaagggtctttgctttctgagttaccacggaggcacctgtggaaacgttctggaaaataaagtttttaataaattaccacagtaatatgttggtgtacacactccaaacctgtccccggcacgccacgtgctctctgtatagggccactaatggaaatttctgaagaaatccttggggagggaaggggagttggaacacaatgtctgtttccctgagacggccacgctcccacgtgctcacgacctttagagactccttgtaaggtgcccccgcccacctgagacccaagtgctgtgaatagtccatgaagtcgcgagcagcctttaagactgactgcttaacctcttatatataatatgaaaaata

SEQ ID NO: 625020 - DNA, 209 bp, Homo sapiens
tcgtgttttaaagatgaaaaatgggtcatttcaggttgaaatcttctagctaacaatacgtaaattacttctagactgggcggcaaaacttccccagccatcaaatgactgtatgtgtacaaaccatccagtgttacctcgctccattaccatcatggcagtagcagcattgcttaaaatgataatacgtgcagacaatacaacacaag

SEQ ID NO: 625021 - DNA, 225 bp, Homo sapiens
cggggggccccttggggcaaaggtttgatttttttttattatttcaaaaaaaaaccccggtaattttcccctcctttcctgggaaaaaaccccgtttcccctttggggtttttggggggcaaacaaattttacggattaaccccttttgcggttttaaccccggatttttttttttcctttgttttggggaaaagggggaaaaaaaaaaaaaggggggtttttta

SEQ ID NO: 625022 - DNA, 611 bp, Homo sapiens
aatggctccaccgagggttcaactgtctcttacttttaacccagtgaaattgacctgcccctgaaaagcccgggcattacccccgccagacgatgaagacccctatggagcctttaatttattaatcccacaccagtacctcaccaaaccccccaggtctcctataactatccccaaaccctcgccatttaaaaattttccggtttggggcagacctccggacgccagagaccccaacctccggacgccagtcaccatagcttaagactttccacccagtccaaagccgaacattactataactccaattgatcccaataacttgacccacgggaccagttaccctagggataaccgcgccaatccttattttagagtcccataatccacaccaattagggtttacagacctcgatagttggatccaggaccatccccaatggtcgcagcccgctattaaaggttcgtttgttcaacgattaaagtcctacgtgatctgagttcagacccggagtaatcccggtccggtttctatcttacttccaaattcctccctgtaccgaaaggaccagagaaataaggcctacttcaccaagcgccttcccccgtta

SEQ ID NO: 625023 - DNA, 279 bp, Homo sapiens
gccatcaccttcatccgccacatcagcgccagtgtggcccctacttagggacactctgctccagaggtggctttctccacctccaggatgttctgcagggtccggaactcggctgggttggtgtcgtacacagctttgattaactgaaatggcgcacacaagatttccccttgggtcagctgcccccatagacatctggcccgcacgctgggtgagacgcaccctaccggcatctcctgctccttcctgccctccaggagcagcatggaaagacagggg

SEQ ID NO: 625024 - DNA, 446 bp, Homo sapiens
  misc_feature (3)..(3): n is a, c, g, or t
  misc_feature (101)..(101): n is a, c, g, or t
  misc_feature (263)..(263): n is a, c, g, or t
  misc_feature (278)..(278): n is a, c, g, or t
  misc_feature (286)..(286): n is a, c, g, or t
  misc_feature (288)..(288): n is a, c, g, or t
  misc_feature (298)..(299): n is a, c, g, or t
  misc_feature (301)..(301): n is a, c, g, or t
  misc_feature (305)..(307): n is a, c, g, or t
  misc_feature (310)..(310): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (345)..(345): n is a, c, g, or t
  misc_feature (358)..(358): n is a, c, g, or t
  misc_feature (374)..(374): n is a, c, g, or t
  misc_feature (376)..(377): n is a, c, g, or t
  misc_feature (393)..(393): n is a, c, g, or t
tgngaccacaggcatgtgccaccacaccaggctaatttttttcttttattgcagagacagggtctcactatgttgaccataccggtcttgaactcttgggntccagcaatcctgggcttcccaaagtgttgggattacaggcatgagccaccgcacctgctcacagcatataatttttcctctgaggactgaggaaagaatgaatgccttgggcatgacaagaagcagccctgcttcctctggagctctgcctcaaagggaanaagtcccaccacttncctgaacnangccctggacnncngggnnncanacccntntntggctggagcattctataatggtggncacatgcagaaanattagaagcaaaatantnngagttgctatgggcanagagttggagagaagtatttccaaatattcaagaggatgctggggtgggtcga

SEQ ID NO: 625025 - DNA, 1243 bp, Homo sapiens
ccgcccacgcccctcaagtggttgttctcccgcttcatttcttaccagattgttgttctggggtgtcaagtatgtgtttgggagagaaaccccccccactaagagtgattcctctggtgggctcaataccatcatatgctgctcctcttattgagatgcgctgctaatggttgtttgtccgtaaccgtgttttcgtcgtcagtatcgtcaagtggccactacctagagtgtaataagaggtggggtcttcgccccaacaaggagttgtacccactctgtggtgtgatgttccttctccactattgctgccttcgtcgctgatttatcatcggcccccggcaacaccacctattgatgggttggggcgccgccacaagatggtctgcccgtcatagtaggatgcgcctcgtccatcaaatggggggcgacagagaaacacagagcgtgtgtataaaaattggacgtgttgtctaataagtggaggatagcctccccacacttgggggccgcaactcgtgttgcctctgggagcaattgcggctcacgtgtgagccacctggtagcacacacacgacgcgtggcttggctgtttctgagagctttgtggacactctctgttgacactcgccccctcgggtgtattgtgagagggctcttctctcgttctcgtgttggttgcgagaggagcaccccaagagagagtggagagacaagaagacccctcttgttcttgtccaccactctcactggggggactcgtgggggtttgtacacacctgggacacacagcggaggcacacaccgctggaaggcacacccgcgtgtatccacacctgtaaatcttgggggcctcgggtctcgtataccccgtttctgggtcacatgagccccacattataggtatatggaagaaaccttgtggagagagaaggcacattgttcacacgtgctccacccacagcgaatctcacggacacttgtgggttgtaagggtgagagtcacatggcctcttttcttggcccatggggtgtggagaagagatacaccccccagatcctcttctacatccgtcccagacctggaatattgtaaatgacatctccccaacacccctttggccctggccaggccacccttttggactgggctgcccctgcttgggcagaattaaaggtcccccggaggaccatgggtgtggaaatcctgtcagcccagaaattaaagtttacctcagaactgcca

SEQ ID NO: 625026 - DNA, 875 bp, Homo sapiens
  misc_feature (60)..(60): n is a, c, g, or t
gtcagagaacattgggtcggttgagtcataggacgggtcggcccactctaactaagtggngtagtggtgaggaagtcgtttactccccacgcgcggaggggttcctcgtagcacgggtgtcgtctgctctgatgtaagtctggggcgccagtagttaggcgcgcgacgatagttattatttttgtagtcccaccgagggcggctaatatttcctggggcgaggagtgttcttcgccccgccccctcggggttttttgcgggcgttatgatatagttgtggcccgccgtgtttttccgtttcaagagggacgcgccgccgctgcccccgcgttatgcgcccacaaggtcatttagggaatttcatgctgggccgcaaaaacacacagttttttcgtccagctcataaagtaatgttttttcgccagacacagggcatgtgggggtgcaccccgccctccggggggagaattatttgagagtgggtgctctggggtccacgagcagcccccacacccggctgtgccagaatgattggagattttttagaatacacccccttttttgtaatctacccccctcttcgagaaagtttataagctttgttatctccccccagatatgtaataataaagtaatttgtccccttctcccccctatctcacccgcttaggagtttatatattgtatagctccctgtgtgtattacaggtgtgtaatataccacttttctttttaaaatatatattaattggagagggagataacacactctctctgtaagtgccccccccctttttttgggggaaacccttttccccccctttttgtggggggggttttttcccctaaaaaaagagaatcaaggaaaaagggga

SEQ ID NO: 625027 - DNA, 360 bp, Homo sapiens
aaagtaaagaagttgcagctcagcacacgtaaagtagagacagagatggagacataccagcccacttctctgtgcaacatgaaagatgatacggggaagggaacacaggtcagtgtggaggacagcgcgtcacggatggacacgggggtgggctgtctctccacctcctcacattatgccaacaggaacgcagacacattcagatgcctttgcagaacgagatgccagaggctcttgaagtcacaaaggagaggtgtgaagaaatcctgcatctcagtcccacacaggcagctgtctcaagctttacacgcgatgagagactcatcagagacctgggcactgttgctggacgcagactga

SEQ ID NO: 625028 - DNA, 837 bp, Homo sapiens
tattatctttaataaaatgttattatgtcaaccagtgaggctgccctgaacaaaaaaaacaaaaagaaaaaaaaaaaaaggaaagaaagaaattgataaaaagaggcatcccagcccctatgtattggatgggacacaaagaaaaagaagaaaagcaatctcgcagtacatgttcactggtcgaaaaatttccgggacaagactaccctggttttatggtttcagtattctggaaaataccagtgtgttgggcagttctcgcagatgttacctaaaactggctgaattgaccgggcagaatgtcttggcccgttcttgctccctcgacacttgatgggagggctgtcgacctctcctccggggggggcttccccagtgcctatcttctcggatagtcagggagaggttacactaattcattggagatgtaagtgtgggttggtgggttggttcagaaaaatatatttaatatataatagatatcaatcgggtatagaataatggtataaaatgaggttgttaagaggaagaacaacaattcatgtttaaaatatattatgcatgaaaagtttccgctcgggcggaatttaaaacagaggatgttgcaagaccaagtgcaggacagggatgcctgaacatttagggctactctgagtttctcacgcggcatggcatatagtagggagcataatgtgagtctctagagaaaacgaagtatagggaatagcacggggttgtggccccaaactagtgatagcgcgaaatgcgaaatccaaaagggacaacggcaggacaagaatagtcacaaaaacactagaacagggcagtcgtcgtatc

SEQ ID NO: 625029 - DNA, 190 bp, Homo sapiens
cccccctcccacccaaagaaaaagaaatggtaactacctggacaaaacatttcacgtgcattgttttagtaaacagacacaaccttggcttcaggtcttttttgttttctgtcacccaggcggagtttgcagtgagctgacatcgcatcactgcactccagcctgggtgacagagcaatactccatctca

SEQ ID NO: 625030 - DNA, 1259 bp, Homo sapiens
cattccctttcccggctcaagtccttcctctctctttcctttctttccgcctatcttttttctgctgccgctccgggtccgggccattattaccgggaccgggacgcacataaggtgcgcgagcccgagggacccagtatatgacccgacgatcctgactatcctatcagcttaccccctgacccatgtggactgcggggccgcggaaggagctgaacacaatatggacccggaaagtagattagcaggaagcggaaagcagcccgacctcgacggagagctgggagcgacgactcagggcccgcaagaaaggcatgggctcaactcgcatatacacaaaaggaaaagcacatacctcctgatgaagaagaatccttagacatacactcacaggaaaagaaaacggggaaagatacagggctacacagcactggcaacccaggacaacactctacacagtggtggccatgggaactgcacagcaacacagcacaattccaccagccatcccttgaacacgaggaaacgaggagataatccaaccatgagcgacaaccataactacaaagagtggtaagacatacatacaagaggcgacgacaatcactacggcaacagtgagcgaaatgagccacaacaaatggcaaacaaagacacactgaggcacgaaacaaggaacaaagcaccaaccgaacacagacaccaccccacgacatcacccaacaaatccaggacaaacgcaccgaggaaaaccaatgaacacggattgatgaccccccaaacgacggcagggagggaatacaaaggacactcaccagaagaaagcacagcatagaaacacaccagaaaacccaaatgaacaggaaaacacaaccacacaacgaacatcgcaaccacaacaacaacacatcagcatagcaataataaaacgaaacacacgaagaaagcaacacacggcaatgacacaaaaccaacgcaagaaaccacgaaacaaacagacaagatgaaatcaacacaaataaatgaaagcgagcgagcacagaggacgcacgcagggagagcaacagcgagaagcgcgcacgggcgaaggcaccacgcacagagaaagacaagcaagagagtaggcaagcgagcgagacaaagaggaagacgcgcgacaacgggcgcgacacgaagaggacgacaaaacagaaaagcagcagagaagaagcgcgcaggcgagggagggaaaacacagcaccaacaaacgagagcgccag

SEQ ID NO: 625031 - DNA, 299 bp, Homo sapiens
accgttcccaaaccagggtgcagttcacgtgttacggaatctctttgtcctataccctatattgtggctgttatatatcgacatttcactttagatttcagattagtcatagctaatatccttgtgtcaaagatcatttattcacagaaagagaaacggttcagggaaccttttacaatgcaccctgggtcctcatcccaactctgcctgtagggtgccggtggtcttaggcctacaacttaagcctcttaagactcaccaccaacaagcaatgactgggttgattgggttgacgtcag

SEQ ID NO: 625032 - DNA, 154 bp, Homo sapiens
ttatctaggggcttccagaatcacctcattgaaagggccttatatgaatcaccaaaaaacagtcatttcatctttaaggctggagctatttcaaaagctgggaacaggagtcccccttgttacgggttcccaccataacgaacctgactagtat

SEQ ID NO: 625033 - DNA, 147 bp, Homo sapiens
gattaaggatctcgtacgagcgctctacagcgctcgtacagcctcgtacgagcgcttcgtacagcgctcgtacgagcttcgtacgagctctacgagcttcgtacagccttctaacatcctcgtagaccctgttcacaagtgggtcgt

SEQ ID NO: 625034 - DNA, 414 bp, Homo sapiens
  misc_feature (30)..(30): n is a, c, g, or t
  misc_feature (57)..(58): n is a, c, g, or t
  misc_feature (74)..(75): n is a, c, g, or t
  misc_feature (103)..(105): n is a, c, g, or t
  misc_feature (183)..(183): n is a, c, g, or t
gatgatcctgattctcatcatttgcgcgcngaggtgctcggcctctacggtctcatnngtcgccctcatcctcnnccacaaagtagaccctctccgagcccannnagccacagaatattatgtaaagaccacccctcctcattccagaacgaacagcctgacacatacgcacggggccgccgnccccagtagttggtcttgtacatgcgcagtgtcctagtgcccatcgtctgtgccccgcctcactccgcccgccccgtgccgtggacatctgggcccactcatcgcccctcaaggcccccggggcccaaccctcaagaagtgccctgtgtaatgccggatgaattaaaaattgcaattccccttactggatgtttattaataaagatctgggccttgtccctgcggtcctgc

SEQ ID NO: 625035 - DNA, 346 bp, Homo sapiens
gggattgctccgcctccgccgggctcggctgccctcggcagcttccccgccgtggctctccctcgaccctcctcccctcccgctcccggttcgcgatggactgggcctccccgcgcggccgagtcgccgtcgcccgcagcaccgcgcgggcctctgagttgcagggcctgaggagccgcgtgctggggactgggacggtccgctggctgctgacggacgcgagaaccgtctcgcttcacctgtcaccgaggtcctcgacggaggaaggggagggacgaggcgcatgttaacctgtgccgactgccggttcgacctgcgcggctgcgggttcttgggaactctagga

SEQ ID NO: 625036 - DNA, 547 bp, Homo sapiens
gcttcaagtcaactcccggatggagccagaatccatagaaatttgtccttataaccctcaccaccgaatcccgctcagcaggttccagtaccacctggcgtcatgcaggaagaagaaccccaagaaagccaaaaagatggccagctgtaaatacaacgcctgccacgtggttcccatcagaaagctggctgaacatgaagctacctgtgtcaacaggagctccgtggaggaagaggacacattaggccctctgcaagtcagcctcccacagccgcagaaccaggacacactacaggttcgttggctttccaaccctgacatttggaatgttgacggcgccaactgtcacccaatgttcgtccttaagagttttgttccccaaaaacttgtttgtgaaagtgacatccaagagtcacggggaggagaccaatgcccagaagatcctcagactaggaccaggaaggcaaacttctagcaggaggaagagggctctcaaatgcgtggatggatcgcgcatctcatctgaataaaaacctgcaaagtgaaa

SEQ ID NO: 625037 - DNA, 1164 bp, Homo sapiens
tctcccgaaacagggtcttgctcgttggcgcccaggctgtggagttacagtgggcatgtgatcttgtggctcactttcagcctttggaattggggcctcaaggttgatccttccttaccgtgagcctttcgtgagttaacgtggaactacgaggttgtgcactccttcgcctgtgggctaactttttaaatttttgtgtacagggcaggactcttgccacctgttgccacaggctgtggctctttgaacttccgtgaggctcatgtgccattcttgcctgtgccttataagtctcccaaaatgtgctgtgggatttacagggagtgtgacgccaccatgtgcccggctgtggacagttgtgcatgtggaagaagaacaccttttttttagtggtctttaccctttttagaaaattttcataattatagtggtgtctcgtggtgtgaaaaattttgtgggttttttgtataaccgtttttattgtgacaacaaacagaaagagttcgaggttttgtgaaacacgaatattcttctccgtggtattcaccgtgtgtgtacacaattgagtgactaatgtgtgtgtccatgtgattgttttacatatagtatttttcatttcagaaaagaaggtttattatttgttaaattaacatttcttagtttaaccatttcatttcttgggtttttgccgtgtggaattgcacttgaagggacagtgtacttgggggtttggaatttgaccacaatctaaaaggtttctgggtaaataaacatttgtgtacttcgtttaaaaaacactctgttgtttgtgtgtgcaagacacaacatgtgcgaagacggtgaacaattcttcttctttggagtggggacaactcctttatccttttgcgcacaggtcgggcaaggtccactgtctaaagaatcatcttgtctttgtcaagaacggagaaatcaccctctgtggggagtatgtggttccaacctgttgtttttgcgacacccacgctatttgtctggtttgtgaacaccaccgttttctggttgtatgaaatcaagccctgggcatttctcctccttcaaatatcgggctgtcgtcaatactgagcacaccgatgtccacttcgccacttgtttgcgcaaaccagttcgagtcgtcggttctca

SEQ ID NO: 625038 - DNA, 468 bp, Homo sapiens
atatgtaaaaaaaaaaaaaaaaaaaaaaaaaaaaaaaaaaaaaaaaaaaaagggggggggggttaaaattttccctggggggggcccaattttgcgtgtccccagtttttttggtaaagggggggccccaatggggggggtttttttagggggggggggggggggttttaaaaagggggagtaagtggggaaaaagtggtgtgagagggggggacatttggtgggaagagggaaccattactgctggggggggggggaaaatataatgtgggaaaacacttatcctatacaggagaatttaaaaggtctcataggggtaattataatacaatttttcacgggtgttattagggtggtggtacaacaaggcgggataataattgagtggctggaaggtaaagagttgtggctcatacgggagtttatttattatataaaaatttttatcacgggggctagatgtaaaaa

SEQ ID NO: 625039 - DNA, 664 bp, Homo sapiens
  misc_feature (111)..(111): n is a, c, g, or t
  misc_feature (126)..(126): n is a, c, g, or t
  misc_feature (138)..(138): n is a, c, g, or t
  misc_feature (140)..(140): n is a, c, g, or t
  misc_feature (190)..(190): n is a, c, g, or t
  misc_feature (199)..(199): n is a, c, g, or t
  misc_feature (342)..(342): n is a, c, g, or t
  misc_feature (426)..(426): n is a, c, g, or t
  misc_feature (468)..(468): n is a, c, g, or t
  misc_feature (521)..(521): n is a, c, g, or t
  misc_feature (537)..(537): n is a, c, g, or t
  misc_feature (539)..(539): n is a, c, g, or t
  misc_feature (564)..(564): n is a, c, g, or t
  misc_feature (578)..(578): n is a, c, g, or t
tcgctattgtgatcgggtattgtaacagcactggacacgagcccacagcatgatggaacccccaacaaattttactgtgtgtagcaagtgtttttcttggaacgctgtgtncttttgccgccatgnataacatccctngntatgaccaaataactcaatcttttcgtcagtccacagcaccttattccanaatgaagcnggcttgtcaactgtgcgtttgattacctcaagcgactctgtttgtggcgtgtgtgcagaaaaggcttcttccgcatcactctcccatccttgtgcaaagtgcgctgaattgttgaacgatgcacagtgacaccatctgcagcnagatgatgttgtaggtctttggaggtggtctgtgggctgtttttcaccgttctcaccatccttcgcctttgcctctccgatatnttacttggcctgccacttctggccttaacaagaactgtgccngtggtcttctacttcctcactatgttcctcacagtggacactgacagcttaantctctgcgatagcttntngtagccttcctcaaaacacaatgtngacaatctttgtancaggtcatttgagagttgttttgaggaccccatgttgccactcttcagaggagagtcagagagaatagcaacttgcaatgggcacc

SEQ ID NO: 625040 - DNA, 1874 bp, Homo sapiens
  misc_feature (613)..(613): n is a, c, g, or t
cccaactctgatcccatgttctgctcgcaccagcgcctaccatggggacagggcctctgcacgtcgtacccatataccgctagagtttaccctgagttcccggagtacgagatcatgtatctacatatccacatcgtagttttcatcgcagcctcatcaatccacatgggacttcgtgacctccaggttcagttgagcagaataatgagcgtcgtctatccttcccatgagagtcccatgccggacccatgtggatgaaccgtcagcgctgggtgtcactagatataccagatgctttagatacggccccatagcgcctcctagatagaccacacaggcttccttcgcttctgcgtagagcccagcttgctagcacataacgaaggccaaggacccgacatcgggttcaccttccatgcggacgtacccctacactccacggcgtatggttacgcggaggacctcgaggggtgttcaaccgcactttatttggcgcgcgagagggaaggactaccatggggtttcgctcaactcctctcacagtgccacccgaggacagagcccttgagggaatcacacactagctagggtctccctctgatacggagagctnatacatttttgccacggcccgtctgtggcgaagtcacatgtcacgcatcaattactttgggaccgaaaatacccctaggaaagggctcccctccattgggctcgcacaagaaaatttcacaaccttttggcacggcagttcgccatgggtctttccccaagaaatactatctcggggggacagaagcttccgcttaacggtgtggggcactccctacctcgttggtgcgggggataagttcggccggtaagatttctgggggtggaagcaaccaaagaaagccttgcccggggaccccccgcgacgttccactaattaggaagcacactttcgctttggccaaagacccctccgtcgccccatttcactgatgctcgttgggaaccgtgaacacaacttgtgtggcaccccccgggagggaattacaagaaacggcgagggcggaagcacttccacacccatgtatcccaggtgaaacccactgttccttatggggggaaaaagccgttacccacttaagagcaacgcgattcccgctaagagcggctcgaaatcccttctctgtgtacgaccaattcgccccggagaacagggcacatcactctgttgggccactgacgtggtggttatcatcacgccaagcaatagagcaaggcttgtaaacgcaacaggaacagtccccatacgaaatcaatactgttatccccggtgctgatcaggagtatacacgattacgcaatgtttgtaaaactcttcaacgcacagtgtattcgccatactagaacaaacgcggaattgcaacattacgcacttactggtggtttcagtaccacccatcagccacaccacagcacaggcaagagggggagaggcgccactcgtgtagtgatttatcacacactccagacatgggcagcccccaagcacattggccacaccacccgacaggcaccctaggtgatacacacgagtggggccccactataacggaagaaccacagagaaacacagcacacaacgccgcctagagagataccaacacccggacacgggcgaacaaccgcagcagaagtggaacccccgcaaagaaccacaacacatctgatgtgctaggccacacactcgtggcaacacacacccgaagacaataacaacgccggcgaaagtaagaaagcacgagcaaaaacagtgaagcacgaaccgctatctagcagcacacaaaggcaaagacagcatctaaaacaacgacgaagccagcaac

SEQ ID NO: 625041 - DNA, 142 bp, Homo sapiens
tatatcattacttaattcccaccttaatttaaaatatcacaaaaaattgtgggtgtcatgaaatttttgtaagagaaattggttgtatagtgacccaaaagtataataaaaaatgtaaataatttgtgtttcacaactaagt

SEQ ID NO: 625042 - DNA, 109 bp, Homo sapiens
catgttaggagacaggccacgccttgcaatgtgcatcagttcactgatttcatcctctagtttccggcacagtggccaccataagtatgtcaacaagcctcgcagaagg

SEQ ID NO: 625043 - DNA, 796 bp, Homo sapiens
cgcagtggctcacgcctataatcccagcaatctgggaggccgaaacaggtggactgcttgagagtccaggagttcaagacgagcctgggaaacatagtgaaaccctgtctctaccaaaaatacaaaaaattagccaggagcggtggtgcatgctaatcacagttacttgggaggctcaggtgggataatcccctgagccctggaggtggaagctgcagtgagctgagattgcatcactacactccagcctggggaaccccagtgagacaccgtctctaaaaaaagaaggaaaagaaaaaaaaaaaatcagccagttgtggtagcatgcacctgtagtcccagctaccaaggaggctgaggtgggaggattgcttgagcccaggaggtggaggatgtggtgagctatgatggcatcactgcactccagcctgggtgacagagtggaaccttgcctcaaactcttatgactcaactacaaaaaagcagcttaggtgggggtctggctcaggatctctgggcaaggttgaaatcataaagaactctttttgggctgggcaacggtagcctcacaccctgtaatcccagcacttggggaggccgaggcaagcagaacacttgaggtccggagttcgagaccagctgaacaaccatgaaacccgctctcttccaaaaattcaaacttaccggtgtggggggggccctgtatccagtactggggaccgaggagagatcgtgaccagggcaattggggccattgccatggtcctggaaaggtccccggacagacggttcaaaa

SEQ ID NO: 625044 - DNA, 482 bp, Homo sapiens
aaatctcttcggcatatgcagatagtatattacatgtagctcaagagtaatcttgtcctttatggattccaattcataaatggtttatattgtaagctaaatattccaggagtgaaaagaaaaagaggaaggaagaaaccccgtctcaggcactcatgtacagccacccgaagacaatgaaatgtaatacattcataagacaagtgagagaagagcatggcagacacacagatgcaactagtgaaagttcctttccttaagaaatgcatggaagccggacttcttaattacttacttgaagaaatattagacagcgttcattcaattccagaagaactcatggatgagactacttcagaatcagactatgaagaaaatcgggagtgcactttttgactgtcgattgttcgaagacaccatttgtacatttgcaagcagcaatagagaacaacaattcatgcatctcaacaaatagtccgcag

SEQ ID NO: 625045 - DNA, 300 bp, Homo sapiens
tacctgcgtcgctactaaaaaattaaaaacaaattaatcgggcatgcttttccatgcctgtagtcccacctacttgggaggctgaggtgggaagactgcttgagccctgaaggtggaggttgcagtaagccatgattgcaccactgcgctccagcctgggagataaagtgagacattgtctcaaaaaaaaaaaaaaaattgcttcccttaattaaaaaaatttttatggctaaaaattgctaacaatcatctgacccttcaaagagtcatatccctttggctggggaaaggtcttgcctg

SEQ ID NO: 625046 - DNA, 1018 bp, Homo sapiens
  misc_feature (1)..(1): n is a, c, g, or t
ngcatcgccataagagctgtatataggggtatttcttattaccacctgcgggcttctattgcgtgccctctacccggtggtccgaatatgactgttcttgccttattgtttgatgtgtgcgctgtaatgttcctctacgttggtgattgtgtgtgccttcgcgtatagttgtgctcttcggtgccccctatcctgggcctatcatttcctatcttctggcctgtcctgtagatttcatagccgcgtactcttaccggtctctatggccacccatccctgtgtctaatggttggcctcaggagcgtgtctttgtaatgggtgtcccgtcattgatggcactctggccgcttgaagtctttaaggtgttaatttgtgactatgtaaaggactcctctatgcagctgtaatgtgctgggtcgcacttgtttgagaccgttgaatttgttgttcttcttcctatcaactacacatagtaggcttgtagaactgacttgtttcatttacgtgggttcttcgtaattctaggcgcccagacatactgtgttgagtagtatacttagagggaggtagtaggttttgtagaggttgatggtggtggggagggaaggcctctgatattgagtttgatgcagagctttttagccatgaagatatctttctagtctatagtactatataattatattttcagtatttaaaaagacaaagtattttgtccatttgagtattctgctactcctatgtataatagttctacttggacgcatggggccaaaagctgttgattttccccagttgacggttgtctatatatcgaactgttcccaagttagtcaagtatgtctcaacactagcatgatataaaagggacactgcaggcctgaatgaaaaaggaatcaaaatccaacttgaaacataagattaagtacatactccctaggaaacgtacaaaccattatgattatagcgaagataaaattgataatgtttaagtcaggctatatcgtacggaaaacta

SEQ ID NO: 625047 - DNA, 519 bp, Homo sapiens
atacacctacgtaatgccaatccaaggttcccaaatcgcccgcacatccaaacgagggatgaatcggaaagcaagtaatacctatttgcccacaccaagctcgccaccaccaccaccacaaagtccagatacaaacacaaacacaaacactcccaacagaccgcaataatactaactgagaatatgtgcatttaagcccggacttggcttttccggtataaggtcctaaaccttcgttaattccagtatcgtgaaggtctgcactgagaaacttcctatataccaaacgctataatttttaaggaggactagccacctaggggagggttgtggggcgtaggggtcactttagaatagccgggatccgagaacccctggctcctcccggactaagtctaaaatatggaggctatagtttcgaggtcgtccggtaacgagccgagaggtaagcgtttcttcggccgtcgatagtttcgtatccccaaaccccgccagcctactttccgactctcttaatgc

SEQ ID NO: 625048 - DNA, 369 bp, Homo sapiens
gtgagctgcagtgcacctcaggaatatctcggacggagagatcggagtgaaacagtaggggcacgcagaactcatgatgacgttccaatcgacgcattagatgaagcgggctgagcgagccagtccagaagggggtccatggtggcgagagtctgcgaggtgaaggccgcatcctcccgcaagagctcgttccacgcatcaccattgggcacgaagtagggcgccccgctgtggggggccagcgcacgaacgatctccgggctgcccaggacaaggcactcgcagcgtcccgtctccaagggaatgtcagtgacaacgatgcgcctgccccgggcatcggggtccacctgcactgcagctaaccggtgc

SEQ ID NO: 625049 - DNA, 503 bp, Homo sapiens
ggtcgacagagtcacagaattaactaaaaggggtgagtagcacccacccggagaagcccgcagcaggatgtttgtttggtactttttcaagaacaatgcccataacagatgatgaactctagtagccgaacttgcacaaccaagttttaaggctcagattgttttagtcatttgcagtaactgtttgagcgtttccctcagcctgagtcgaaatgcttatctcagcacgcattttctccctttcctccttttgtgcctcatttctgtttttttttttttttttttgagacggagtttttgctcttgttgctcaggctggagtgcaatggcgcgatcttggctcaccgcatcctctgcctcccggattcaggcaattctcctgcctcagcctcccgagaagctggggtaaaggcatgcgaccaatgccggctaatttggtattttaatagagacggggtttctcattttgggtaaggctggtctcgaaccccgactcaggtggt

SEQ ID NO: 625050 - DNA, 281 bp, Homo sapiens
  misc_feature (138)..(138): n is a, c, g, or t
  misc_feature (171)..(171): n is a, c, g, or t
  misc_feature (204)..(204): n is a, c, g, or t
ggatcgcgcacagtcagccagcgaatgtcatctcggaatcagcgggagagggctgctgtcatcaccgcgggcgtaaagcggcatcagccgttctgtttcctcagccgccattgggcggagctcaacttcgggcgcggngaacgccaatgtaccttcctgctggatatcgancgccaccaggccgacgccgcattcctgcatcancatcccaggccgtttaggcgtcaaaccggcttccagcagggcgtgggcggtgcccagcgttgggtggccggcgaagg

SEQ ID NO: 625051 - DNA, 896 bp, Homo sapiens
agcggagaagtcctgtagggagatgggcagttaccttctctccgatctctctactcggggactctattagtaggctggtggagctgtctaaaacgaaggagaaccatgagcaatgaatcttgtcataccttattacacagcccacaggtacacttcaatgagtgcgttcacaaacctccatgggggacctgcaacgacaatagtacaaaagaggagagtacaacattagacaagtatgcaccaatgtgtcagaggagataatataatatcagataaaacaacaaggggacagaaggtgcactagatgataacacaaaccatgatcccgaaataggtgacagatgggacaatcgaatctgacaaccagaaacaccatcactcacaccaatgacctgaacgatccatggcttctaggacacaagacaacattaagacacctgatgaacccagcaatgatcacgaaaatgaggaggccaggatataggcacaacaagggaggcagaagggatcgacaaaagagacacacggatgcacaagacacatcgttaaacgacctccacagaagaaactagacaacacccgtaagacacaaaatatcgtgacacagcatacaacccaaggacaggaaaaccactgaagaaccaacaagcaagcatgacgccacttgacaacactcgacgcaacaaggaccagacaaaaagaaacaaatcaacacaaacgaaaagagacaccacagaacatggaacaacaacgggaaaagaaacataaacaaagcaaaaagagaaacaaaaacagaaataaacaaaactaacggcccaccaaggaaaaaagaagaaaacagcaagaaacaaccaaaaaacaagtaatcaggaggaaaacaaccacaacaaagacaa

SEQ ID NO: 625052 - DNA, 149 bp, Homo sapiens
actaaaacaggccactgtctgtagtcttccgttgaactgtctaccctgtatgaggttcaaaatttctaagatatataagcctctactcttcatggatctgtggatgaaagaacactcgctggcagtagaacgttcctctggcatgacat

SEQ ID NO: 625053 - DNA, 111 bp, Homo sapiens
agccccccctggggtgggtttgtgggcccttctgctctgctagggaaaagcctgtgtggggcccccctcttcaagggagcgtggcctttataaataaaccagttctgttta

SEQ ID NO: 625054 - DNA, 654 bp, Homo sapiens
cggctgctgtaggacggttgctccgaggcgtcgagttgcccgacatgtgagtgccattccttgtgggcatttcttgccacgtgcagaccctcagtgcctgcctgccatgttggaagaacgagcttgagcaaatttatttgtgttctggttccagtcaaagcaaaattattcagcaccaagttccatcatgccatgcacctgcttgtcaccgccagggcaattgtcatcgcactttattttctaaaccgggtgctaaccaacggcccatggttttgctcaagacttgggccagacaggatctccaacaaggaaacaccatagagagcccctttgacatggaaccttttttaaccagtggtggcacacacactaattttcggggtggaccatttattccatttccttaaattcccccgtgtgtgggggaagttgtgtcaaccaccatatgtggattgatgtgtttgcagtaaaccagtgaagacaagtgtggatactgggcatgtagtgtacaggttggaaccaaaaagggcgatacagcacgaacaagttttatagtaagcccggtcaagagtggggtttgggaaaaagccgtttgggaggttgtaaaaaccgggattatggggatacgggaacaaaagaggtccgattacaatg

SEQ ID NO: 625055 - DNA, 150 bp, Homo sapiens
atacttccagacaatagtgtgcttcaaaacattaatttgttgaagcatttcaagatgagctattagtaactgaagtatatgatctccccaacgacctaatgatgttcagctcttttagggagcatgtgaaaaattatcttcagtatggga

SEQ ID NO: 625056 - DNA, 425 bp, Homo sapiens
  misc_feature (353)..(353): n is a, c, g, or t
  misc_feature (381)..(381): n is a, c, g, or t
cacgaggggagatctcgccggcgggtgccatggcgagacgggacgagaaggatgccgaggcgctggcgcctccggccacgacgagcgtgcgcgtgccgtaaggcgatgcgaccatgaccgatgtcgactgcgacgactcgttcgtcaccttcgcgatgacgacggccttgccggccacgcaccgcgtcgacgcctcgacgccgatgcccggcgtcaccgtgactgtcgccgtcaccggcatccgcgattcgtcctgcgccaccccgctcacggtgaacgtgccggcgttcgcatagtccgccgggtccacgccctcccaggagacggatgcggtcttgaccgcgccgtcggtngtggtcagctgcgcgttcggcagcaccngtgcggtgcctgctcgcgtcgtcaccgcgatcggttcgacctgt

SEQ ID NO: 625057 - DNA, 279 bp, Homo sapiens
aacccagacattcctttctattggtaataactctcaactaattgccaatcagaacatttttaaatctacctataacccagaagcccccactttgagttgtcctgcctttctggactgaaccaatgtatatcttgaatagatttgattgatgtctcacgaccctctaaaatgcataaaaccaagttgcaccccagccacctcctgaggtctgtgtcatgggcgtggccactctatttggctcagaataaatctcttcaagtattaaaaaaaaaagcccga

SEQ ID NO: 625058 - DNA, 170 bp, Homo sapiens
ttaatatgtgtcgggagtggtactgaatatggggttatagcaacattttggccggggacacttgggaggtgggctggggctttttggtggttggtttttgagacagggtctcactccgtcacccaggcgggagtgcggtggcgtaagcatagctcagcaggcggcaaaca

SEQ ID NO: 625059 - DNA, 565 bp, Homo sapiens
  misc_feature (67)..(67): n is a, c, g, or t
  misc_feature (101)..(101): n is a, c, g, or t
  misc_feature (134)..(134): n is a, c, g, or t
  misc_feature (207)..(207): n is a, c, g, or t
  misc_feature (284)..(284): n is a, c, g, or t
ttctgaaatatgccggagacgccaattgcctgggcagggagtcggtaccggtgagcgttgcactgtnacgtgtacaaaataataaaatacgtgagccaccnccggtcttacaggtagcgaggtcggggcactcnggccatgaacaaatagcttgtgataaaaatatattgtgatgccctcaagtctctgcgcataaatcaaagcatnaatggcttgagtgtagggaaaggaagggttgtttagtaatttttccccctgaaaacaaggaaattacagagaaatanatcaggcgctcggtggctcacccctgtatccagcactttggaggctgaggcgggtagatcatgaggtcaggagatcaagaccatcctggccaacatggtgaaactctctctactaaaaatacaaaaattagctgggcgtggtggcgtgtgcatgtagtcccagctactcaggaaaatgaggcaggagaatcgcttgaaccaggaagttggaggttgcagtgagccgagatcgcaccactgcactccagcctggcaacagagtgagactccgtctcgaaaat

SEQ ID NO: 625060 - DNA, 273 bp, Homo sapiens
agacacttacggaatgggagaaaatttaagtatctacccatccaacaaagattaatatcagaacttacaggaattaaacaattacagaaaaaaaacatccattaagaagtcaggccaggatatgaacagacacttctcaaaagaagacatttatgtggccaagaagatatgaaaaaactcaacatcactgatcatcggagaaatgcaaaccaaaagcacaaagagataccatctcattccagtcagaatggcgattattaaaaagtcaggtcg

SEQ ID NO: 625061 - DNA, 324 bp, Homo sapiens
  misc_feature (313)..(313): n is a, c, g, or t
catgttaccttagggaatcaagccgcaatccttttttagagtccatatccacaaataggggttcagggacttcaatgttggttcaggacttcccaatggtgcagccgcctataaaaggttcgattgttcacagggattaaagtcctaagtgatatgagttctaagtccggagaaatccagggtcgggtttataatatagttcaaaattcctcccctgacgaaaaggacaagagaaattaaggctttatattaaaaaagcgccatccccgttaaaatgataacttgtaaactttagtattttaccctcgcccancccggggttta

SEQ ID NO: 625062 - DNA, 298 bp, Homo sapiens
tggtacgctacacttcgatcgcggagaatgagagcaaagagcgagtcgcttcaacttgatggaaaagatgcttcagccttgtggaccgccagccgacaagcccgaggagaactgagactctgccttaccaccgcagtgcggggcaccatctcaccagcgtttcatccggtttcgccaactccatcttaagtattccgtgtctccacaaggaccggtttctccatgcgctcctcgcgcctcgctgcttctccgcagatcgaagtgggggatacctctagcagtcgcacctgcagcgcat

SEQ ID NO: 625063 - DNA, 184 bp, Homo sapiens
gtggagtcagtctgaggttgtgggggctcgagaacacaggcagattatttgggagatgtttccaaggaactaggatgcttggggagatgggggagcccagtccttgagaaagggggccctcatccccattatctgggatttttcaaaaatctgcttttagacttgcagctttctgtttgccttt

SEQ ID NO: 625064 - DNA, 851 bp, Homo sapiens
ggtcttggtcagtgaagcaccctcggctgggaagtcagcacggtctcgtcctctcctctcttgtgtatgaccatggtgcggagtaaggcagacgagtgtcaccaggcacttacagcaaacaggggtgggatgttcgagccccacagaaaaggtgcttggtatcttgccaagctcgtggccactagattgctgacgactcggtttctcagtcgaggcaaaagctggaagacatcacccatattgcaggagggaaccccggtatggcatgcgccgcaaactccgaagatgggcaccagaggaattggagacatgcttgtaggttgtaccacctaaaagactctgagagagaagagaatccgattcgtgaagaggtgggaaggagatggttaggaaaagtataagagaaaagcatgtccttgagaagctgatgacaaaatgatgatccagaatagaatttctcattcagtcttgtgaataacgtctccttgttaacctggtattctagaatgtaatgtggataaatgtgttgtccaagtaagcttggttgaaccaggtatttaattacagaaattgaggttaaggatagatgtgcacaggtagttgtgaaattgagcactttgtcagataattatggtagcttaggtagtattcaagtactgatggttgggctttgcaactagtggcaagtctgggaaagtagcatggttggtctaataccagtatgttgatttgatgctaatgttgatgtgcaccaatggggtgagccggaaggaaaagtgagcctaagtccaagaaggggttgggtaaagggcaaaattttcgttgaggaaaaatagggggggttaaaaggg

SEQ ID NO: 625065 - DNA, 358 bp, Homo sapiens
ttacaacagttacacaccacaatactatggcttcacacacctccacacctcactcatccaaccccaaggttccacgcgcaccgtcccatgaaacagctccacttctggacacagttccgcccagccccatgcaccatcacagtgacacacaatcaaaagtcaatcatagtcacctatcactgatccagtgccacactgtccaccacacgcgcgcgcgcgcgcgcgcgcacacacacacacacacacacacacacacacactaacaggcagaaagacaaccacatccgcacagcctcttgctcaatcacacctaattctacaaccagtttcactctctgccatgaagacagctacacac

SEQ ID NO: 625066 - DNA, 466 bp, Homo sapiens
  misc_feature (10)..(10): n is a, c, g, or t
  misc_feature (31)..(31): n is a, c, g, or t
  misc_feature (86)..(86): n is a, c, g, or t
  misc_feature (208)..(208): n is a, c, g, or t
cttcccctcntcccattaatttccctagacnaagagtttttaccaaaaggcagaaaaagaaacagcccttgactggaagtatccgnagatccctaagggaaaagaatgccctgctttgaacccctggagataaatagcacccacccccctctttaaaacctaaacattagggaatgtcctcatgcctgtaatcccggcacttaagagnccaaggcgggtgaattgcctgagtgacagagctcgaaaccagactgagcaacatggtgaaacaccgtctccacaaaacaacaacaacaacaaaatacaaaaattagcccggtgtggtgggtgcaagagcctgtagtcctagatactcaggagtctgaggcgggaggattgcttatgcccagaaggttgaggctgcagtgagccaggatggtgccactgtacaaccggtctgggtgacaaagggagatgctgtctttaa

SEQ ID NO: 625067 - DNA, 847 bp, Homo sapiens
cgcttgggaggtcgaggcaggcagatcacctgaggtcaggagtttgaaaccagcctggccaacatggcgaaaccctgtctgtactaaaaatacaaaaattagccagatatgatggcaggcgcctgtaatcccagctacttggaaggctgaggtatgagaatcgcttgaacctgggagatggaggctgcagtaagccaagatgtaccactgcactccagcctgggcaacagagtgagactctgtctcaaaaaaaaaaaaaaaaggagaaaaggaaaataggtggcccctgaaaagggggtgagagtagttcctgaaacctcttgagttacctgtaagtcaaggggggaatttgtcttataggcaagttcagttggctaggggaccatggtggggacaagtaatataccattggggtctggctctaatagcttatggaggcttactggtagtgggtgcacttgggggtcctggtggggcatggtagctcacacctattatcccagcactttggcaggctgaggcaggcggatcacttgaggtcaggcagtttgagaccaacctgggcactgtggtggaaacctgtgcgtgtactaaaaataccaaaaattagacagatctggagggcagggaacctgtaatcccagacactcgatagctggagaggcaggggaaattggctttgacccggggagggcgggagtttgcttgagcttgaatggggccattggcatcccagcgtgggaaaagagcaagaatcacctcaggtttaagataaattaattaaaattatccatacacttggccaccaaaaaaaggcggcggcataaaatacccgagggcgattatg

SEQ ID NO: 625068 - DNA, 274 bp, Homo sapiens
tctactcaggaggcatgggtagcaagaattaaaacgagtgggtttatcacaatgagctgtgtgacctgtcctggccagcatggtgaaaaccctgtttctactaaaaacagccgggcgaggttgcattgggccgagatcgcgccactgcactccagcctggcgacggagcgaggctccatcttaaaaagaaaaaaagttatttttgttttgggggcagtggtggcatgcacttgtggtcccagctactcaggaggctgaggtaggagaatggcat

SEQ ID NO: 625069 - DNA, 867 bp, Homo sapiens
caaaacgtgtaaccgatgccgttgctcctggtccccatttttaatatttgcccacgatcttgggtctcactgtgtgcttttaccgtctccgcactccagtaaggcccattggccctgttggtagaaacgatcgaatggttggccgctcgtgttgtttcttgtttgtcaagagaaccgcacatctctgttcgaaacaccgtctaatgttgccggggcacacacctgtgtgagtaatgtaaaaagaaattatgtgttgtgtggctttctgaccgactttaacgtggtagagatattaccggggttttatgggtggtccccccccaaagaggtattttgcgccaagcatgttgttttgtgaaaataataaattttgggggccccaatataaaacgttaaaatataaataggccctggcccttttccccaaaggagataggtagggtttaccccccatggaaaaagtagtgtggaataatatatctcctggtttagaaaaaattttcgcggtggatcgacaatttatggagcccactgctggtatataatgtgaaacccgtgggatattatcgcgtgggtgccaacactaatagattgtgttgtggcacacatctttttttggggaatgttggtgggtgagagtgttttaccacagaggagtttaaggtagtcctcaactcgttgtgtaacaaagaggtaccaccaaagttaaggggagtttcccctgatgacgtcttcactgtcccaacgggcgctttaccacatattaagaggcccccgcggcttttttacaaactggatccccaaaccccctttttccccttttgggaccccccggaaaaattttaaattccccccccccaaaaaaaa

SEQ ID NO: 625070 - DNA, 161 bp, Homo sapiens
cggccctgggaattggccccctccatgtgcatttcatacactaaaggccatttgtggtggtgtggtgggttttcccaggttttctaaaatccttttcaggtacatttcctgccctgtcccaggcccggctggccagcctcagccatagcacctcaccgccc

SEQ ID NO: 625071 - DNA, 308 bp, Homo sapiens
gtattctgtagataatttacttctgcagactgtaatctgccctatcttttccagcagaatttactcttccattcttaattcttctgtgaaatatggggtataatttaacatgcctttataacttcatataacagtatcactgctgtggtaggagggatattattttctcccaaaagggttccatctttgctatctgttgatcagccttagaaaatctaagtatgatcaataaattttaatggtgggggtcatcctgtgtcagctgtagtagttggttgtgaatattaaaacctagtactattttccct

SEQ ID NO: 625072 - DNA, 481 bp, Homo sapiens
  misc_feature (29)..(29): n is a, c, g, or t
agccataggagagtgaccacgggattccntgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaagccggtatgcattgcagtccgcaccatcccccctgttcaacctcgggggagttggagtcagggaacgtccccaggaggccaagcatgattgctcagggaaaggagaaaggatggggtgtcatcaggagcacagcattggtttccagtcactgataggtgattcacagggtcagggatgccccgggggggggaggcaaggccctcacctctttttatatgaggtgtcacatgtcagttggtcaggattttccccacccattagtatttcgtccggagc

SEQ ID NO: 625073 - DNA, 324 bp, Homo sapiens
taagacagagattcactcttattgccaaggctagagtgtaatggcatgatctcacctcactgcaacctctgcctcccacgttcaagtgattctcctcaaccttcaaagtagctgggattacaggcatcagccaccacgcccagctgattttggtacttttagtagaggcagggtttcaccatgttggtcagtctggtcttgaactcctgacctcaggtgatccacccgcctcagcctcccaaaatgttgggattacaggcatgagccaccgtgcccggcctacacattcatttcttatgctgcatctttttcctcaaaactatc

SEQ ID NO: 625074 - DNA, 211 bp, Homo sapiens
tgtggattgaccacatttggcttctccattcatagttgatgatggccatatgcattgttaccgcttatgggctattaggaataatgctgcgctgaggctaacatttctgttgggtgaatacctcggactcgaactgccgcgtcaaatagtagctccatgttttgaacgactgtcagatttatccaaatcggctacaccattttacattctc

SEQ ID NO: 625075 - DNA, 129 bp, Homo sapiens
  misc_feature (79)..(79): n is a, c, g, or t
tacctggcctctcaggtgtaatacgatgtacagcaaagcgcacctgggtcatagatcagacggaaattctctcccgtcntgtcaatgctgatgacatccatgaatccagcagggtaggttatatcagtt

SEQ ID NO: 625076 - DNA, 492 bp, Homo sapiens
catatcatattttgagttctaaaagtaaacttcaaagggaggaaaaataatgctccaatatttgagctccagccttaccatgaagatcgtctcacctccagctcatgaacttgactttaagctacaaactgaggaatcctcaataatgttttcctttttgtgtagaaactgggtccaatatattccccaggctgctctcaaacttctgggctcaagcaaacttcccacctcagcctcccaaggagctgggactagatgcatacaccactacacacagctggtttttaacaatttttagtagatgtgaggtctaactatgctgtccaggctgatcttgaaatcctgggctcaagcaagttctcctgcctaggcttgccaaagtgcttggattataggagtaagtcactgcacccagtctgaccttcccttttttgttgatggggctgagcagcttcatcacagcctttttcattttttatttttttgaaatgg

SEQ ID NO: 625077 - DNA, 1085 bp, Homo sapiens
tttttctccttcttttgtcactcccctctttgttgctctaatatatagtccgttctatcctctctctttttattttattctccctttattatttttttttatcttccttttaattttctcttctatctcttttttgtttttcttttactaatatcttgtttttatattaatctgttttttctttctgtctattttttcttttttttttttttttctcctcttgtttgttgggtccccctctttttttgtttctgctgtttgctttcttttgttgtttttcttctctctcctctttctcgttcgttgtcttttgtgttctgtcgctttgttttgttttttttttgtctttctcttttgttttgttctgttttttgttttttttttgtttgtttttttttttcttccctttttttgtttgggtgttttttttcttgtttctttatgtgttgtttgctctctcttttttttttttttttgtattgttttgttttttctcctccttctctttcttttgtgtttctcttttttttttttcttttttctttgtttttttttttcttccgctgtttttgttttttttcttctcttgttgtggttctttctccttcttcttgccgcgcggtgtttttcttctctcgctccgtctttggtgtttttgtgttctttttttttgcctcccccccctcttctgtggttgctgtagttttgttttctcgctcttttcttctttttggtgtcgtctctttcttttttctctcccccctccctcctctcctcgtttcttttctctcctcacgcttatctctctcctttttcctcccggttgccccccccctctcttttttttctcctctctggtggttcctcccctcctcttctcctcccccccccccccgctttgtgttgtgtgtcttggataatatatttttctctcccctcccgcggttagcactctaggtgtttgtgtgtcccccccccccccccccccggcgggtgtgtttcttttctttggtgggggtgtgtgttcttttttcttttttgttttgcatccttctctcgctcgcgcgcgcgcgcgcgcgcgcata

SEQ ID NO: 625078 - DNA, 946 bp, Homo sapiens
ctgcaatgttaaagaatggcgcagatgagccgcaaataggtacgaagcacgcttgcttccggtactgtagcatactctcatgttattcctgtcggcgttgttacagtgtcgctcccttactaggtgtgcccgccttctagcgtctttttgtgtcgcacaactcattgcggttttgaaattttctcagacccctggctatttttttgttgaatccctcaacagttatgtttgaataacggcggctctttagttgttccatcctggcgggagttcttttcatcaccacgacagaaaatgggtctgtttgaaaaggtcttccccaacagtgggttcgccatgggaagctcccccttttttcaggcccaaccccgtggttgtcacatgaattgccgtggcccaaaccagtgaggtgtcctgctgtcccgcgccgttgacagtcaaacgtcaccagcggtttgattatgtcaccccacggtggtgcctggccaagaacaccgaacgattactacgtctgtccagactcaacgacagggtattacctgtcagacaacctgtattatctctggtcccgagacaccgcacacaccgtgtgcctttaagcgtacttgtggagcagacccccactgacgggcgtccttgaactttttatttttgtgcgcgcccttctctccccaaagatgcatgttaaattccggaacagagtggatctctggtatgactgtataattgctgcgagccctcttcttaccgaggaacttctaatacgaggattgtcaaagaacagctgtgctacacaaagagaaggcggcaacaaaactaccaccgggtgtctttacttagtgaaatcataatcgaagtcgccactctactattaatacagaggcttactcttgtgcaccaccaaaagggacaacttcaaaaaccgttctcccccgccaaaaaagac

SEQ ID NO: 625079 - DNA, 137 bp, Homo sapiens
cagcgaccaggattataattctccacggaaggtgcacttggtaacaaatagcaccttggggtccatgtggatggcttcatcgtctaatgtagctacacacttatatgtaggtatgatagtaagctcaggagacccaa

SEQ ID NO: 625080 - DNA, 89 bp, Homo sapiens
  misc_feature (39)..(39): n is a, c, g, or t
agaatccccacccctgctgccgccactggcttgtgcctnccccgccacctgtgtgttcttttgtttcatttatcttctgtttttctcaa

SEQ ID NO: 625081 - DNA, 309 bp, Homo sapiens
ccgttacaattatgcttggggatcttggtcatgcaatcttctaccgttcctatgtccagaagggtatagcctaggttatcttccagagttcacatagttgggggtttcacattgaagtctttaatccatctggagctgatctccgcatatggtgtaaggaagtggttcagttccactcctctgcatatggctagctagttctcccagtaccacttcactgcacatggggaattctttccccatggcgtatttcggtcaacttggtcaaagattcagatggtggtaggtgtgtagctgggttggctgggc

SEQ ID NO: 625082 - DNA, 161 bp, Homo sapiens
caagtagctgatatgggaaagaaggtgtataatgctgtggtgctaacaatttcagggccattagtatcagcggtatcagctgcagaaactgtagagacactagtcgcagctttctgtggttgtaacagcatcagctgagttgccttggataggtgactgtg

SEQ ID NO: 625083 - DNA, 821 bp, Homo sapiens
gcaaatacaatggagtaacatcacttggaccagactgggcttgataacgcatgatgtgctgtgaacttaacagatggggatgtgactgtataactaatgatggggccaccatcttaaccatgatggatgttgatcatcagattgccaagctgatggtggacaactgtccaacgtctcacgatgatgaaattgcgtagcatggatacgcacgagcgagtggtattgtccgtgggccatggttgccattgttcagcaagaagcggcaagcaaatgtgctagacacgaggccattcacccaatcaaaaatagccgatggccttatgacgctacgggttgctcgcgctggtctcattgtaaacacctgcgtacgaagatcagccgatagtggtccttgttgacataagaggacaccgtatacccctgaattcacgaacatgcaagaaaccacgctgtggctccaaagtggtcaacagtggtcaccgacagatgggtgagattgctgtgaatgccgtttctcactgtagcagatatggagctggagagacgttgattttgagccttgtcatggtagaaggcaaagtgggcggtaggctggaggacactatggtgatgtaagggcgtgatcgtggacaaggatgtcagtcatccgcagatgccaaaagaaagtggatgatgccgaagtattgcaagttctcacatgtccattagtaggcatgccaacaaaaaacaaagcataagctggtgtgacctctgtcgaaattataaaggccctcgaagatacgcacaggccgaatttgcacgagatgattccccatttcggg

SEQ ID NO: 625084 - DNA, 1088 bp, Homo sapiens
cagtcaaaggaagtcatggtggggtccatatacggactaccgtacgagccatgggcaaaggaactagacgcacaattcgttacgcaaggtaaccaccatggcgatacgatcatcaaggcgacttcaagacttgaggcaactcgcatcggagttcattgttgagatcactagaacacaaatcgttccagacgacgcttctgagacgtcacgtagtaccatcgtttccatcgatcgagactatgtccacatatcgatctgctgtggaatgagtggtgacacagaccatctggtgcactcattacatccgaatatatatgcatggacatgagatgattatggctcagaggcatcatggaatctcatgtcatggtggacaatgatatcctcatggactgcgtggggtggcgcagtggggatgtagtggtcgcctgtacgcatggctatagaccacccgtgcacagcttgaagaacgttgtgtatctccaaaacaacttagggaaatgtgcgttcacttgggtagttgtgagataccgaggggagaaaccttggttagtaagcaaaggtagagttctcttcgtgcctttagaggagatagcgaacaaaaacacttgcaatcaaagaagtacaaaccccgtcgccaatgagcgagtctatgtgaacctgaatttcatcgcaaagagttagagtaaccccttggccggggagttaccccttatttcggcgaggggtacggcattcgaagacactttgtaaggtctggattctttaggtcgaagcaattaggattcttccaagccaggattggtgtgtgccatgttaatagcgcctaagagaatcggtgcgtcacttttactctaccaggtcctttggtaacgtggcttgaggaacgtgcgtgcttcaacaatgtaagggagtcaaattgaaagcccaagggctgggaaaccgttcaccatttgtggagcccattagcacacaacaaaaattggggacccaagaaaattacacctttttctgccccagcgcgttttttgggaacgagcatgtgcgacccaaccagcacaaattttccatagtgggccaagatccac

SEQ ID NO: 625085 - DNA, 254 bp, Homo sapiens
caaaggggtggaaaacaatttttggttttatttttgtttttaaaagggggcctggacccccagcccccaaggggcctttcctggcccaaattttttgccccccccagggattgccattccagcacttttttccattttccccgtaaaaagcccctttctgaaaggacccgagggtttgtatttaaaaagcctcccctgggcctcaaaaaatttttggctttgtttcccataaaaaaaatggttgaactggtcca

SEQ ID NO: 625086 - DNA, 242 bp, Homo sapiens
gctatgacatgcagaggcagcgtaaaacatacagcactacagtcctgtgcccgccgtagagatcattgtgctcagagcattgcgaccgacagactgtctgggggtaaccaagaccctctcaggtagcccagtgagtgtcaaaatatcctaataatactaagatgttagtatttgtaaggaaatatttacttggtaataatactaatataaaagatgtttgcgtttttcatctctacagaaca

SEQ ID NO: 625087 - DNA, 200 bp, Homo sapiens
tatactatactacaaagcacacagtcatcaaaactgctggtactggcacaaagacagacatatatgactccgtggaccagtgagagaaagcccagaattcaacccacgcactacagcaacactcatctacgacaaaggagacacagactatacaatggagcaaggacagcttgttcaatcagtggtgctggggaaaccgt

SEQ ID NO: 625088 - DNA, 271 bp, Homo sapiens
agaaaagaccaccaccttgaacaattcttcctgagaaataatatgaggaaaaattgggttgttaggggggggccaaataatacagggcctgcacaggaacgcagaggaatttggattttacgtgggagtcaatgaagctttataaaatattgtatcttggatgaacaggtttccctgctgctggatacaagacaagtgagacaatctcatatcaccctacacttcacacggttacagtgttacagggaggatgcaccacgagtcacatgcc

SEQ ID NO: 625089 - DNA, 122 bp, Homo sapiens
  misc_feature (20)..(20): n is a, c, g, or t
  misc_feature (65)..(65): n is a, c, g, or t
  misc_feature (76)..(76): n is a, c, g, or t
  misc_feature (120)..(122): n is a, c, g, or t
gatcatgaccggaacatggnctgggtttccacccagctccaggccacatgcaatgtccacaagtntgccttcaatnactggttcagtggacacctcaacttccagattgagcaccatctnnn

SEQ ID NO: 625090 - DNA, 152 bp, Homo sapiens
tagtatctgcattcatgtgggagtgctgatgtcaccatgggggctttctgtttgagtgtcaatgtgctcgggatgtgtgtctctgtcagaaggtcagtgcctgtttgtatctccgtccctccctgtgctgtccagctgtccacctcctctgt

SEQ ID NO: 625091 - DNA, 336 bp, Homo sapiens
caggaaggcggtggcaatccatccaggccgaggacgagagcgccaagctgtgcaagcgccggatcgagcacctcaaagagcatagcagcgaccagcccgcggcggccagccgctgtggaagcaggcaagcgcactggatcgcattgcactgcgctggagcacctgctgccgttgcggccttactaccaaccaccggcctcctcccagcctggccgcgcctgcagccgcccattcgagcgaccttacctgacattatcggaccactgtcccccagcaccgggcccaaacacgcaggctgcgcaccgccgctcccctgcgcccaacccccctgcacca

SEQ ID NO: 625092 - DNA, 443 bp, Homo sapiens
  misc_feature (1)..(1): n is a, c, g, or t
  misc_feature (92)..(92): n is a, c, g, or t
  misc_feature (114)..(114): n is a, c, g, or t
  misc_feature (125)..(125): n is a, c, g, or t
  misc_feature (133)..(134): n is a, c, g, or t
  misc_feature (137)..(137): n is a, c, g, or t
  misc_feature (159)..(160): n is a, c, g, or t
  misc_feature (242)..(242): n is a, c, g, or t
  misc_feature (247)..(247): n is a, c, g, or t
  misc_feature (267)..(267): n is a, c, g, or t
  misc_feature (278)..(278): n is a, c, g, or t
  misc_feature (281)..(281): n is a, c, g, or t
  misc_feature (284)..(284): n is a, c, g, or t
  misc_feature (288)..(289): n is a, c, g, or t
  misc_feature (319)..(320): n is a, c, g, or t
  misc_feature (324)..(324): n is a, c, g, or t
  misc_feature (340)..(341): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (364)..(364): n is a, c, g, or t
  misc_feature (366)..(366): n is a, c, g, or t
  misc_feature (374)..(374): n is a, c, g, or t
  misc_feature (407)..(407): n is a, c, g, or t
  misc_feature (433)..(433): n is a, c, g, or t
ngttacaaattttgttctcttcagtttttcattaagtaaattctaatagatgatatacatattactgcagataaaaccatcatcagaaattnttaaattaattgcatattttgngctactctttntgggaagnngtnaaatatttaatacttgtaaggnngcggggagttggtttagaaactctcagctatttctataaaaatagaatggttagtaaaaatagctttcggtgttttttcctnaaggnggctatttttattgaaatcngtgactcagcngcngcnggcnntgaagtcccttcaagaacttagtacttccnnttcnattgtaaaaaaaaagnngttttanananctcgtgtttganangccgcccnccctggctgccctgggctccttcatttgtcgcntggcatgccgcccgccgccggtcccncggctgtccc

SEQ ID NO: 625093 - DNA, 235 bp, Homo sapiens
caccacggtgtgatccatattgagctcagctgggaacagactgaagtgaggtaagtgccgcccacagggcatgatgcctgaagccagtgccaagtgcctttagtttcttgagtggctctgtatcaggtcatcttgactgacatcctgggcgaacttgccccttcccttcgagcgacctggtggatgttgttcctccaatatgttcagtcgaggacctccattccgatgcttcagg

SEQ ID NO: 625094 - DNA, 256 bp, Homo sapiens
ttccctggtcatcgtcatcgctctttgccgagtgtgatgccctggccggcctcccgctcgtagctcttctccaggtacgagctgtaatcagctgtggccatctcttgctcgaagtccaaggatgatgtaacacagtaactccttactgtcacgcacggatttcccgatcgagaccgtgatgatgaagctatagaccgagctcggtgaagatctatcatgaggtagtcagtcaggtcccggacagccaggtcccaga

SEQ ID NO: 625095 - DNA, 1917 bp, Homo sapiens
ggggggaaaaaatgttgttgaattattcctctcaaatttaggcttgtgttacatgcacaaaaatccttgttctgttttcacttaaaaaaactaaatatgtataactttgtgtatacacacacacacatctatatatataattattagcactagagggatatagtccagttatgtagtatttaaatctccagtttcaaattataattcacctccaaaagaatagttttttaatcacacacataagaaattttatcacaatatttaaaactaatatttcattatctaatgctaataaattattgtggtactgccagtattaaatatatggcagatggtattaactactgatcaatagtaagcatacagaactggggattatggattttataaactatgagacagtcaccccagtttggactgggactaatccccagtactgatttgtcatccactgagtagactttatgaatattttgggtaatttgaaatgatctcattattgaaagatgatttcatatgtagagaagataatatttctttcttgaaaaacaagtcaggcttaccatgatgtgtgcaaccaatgtaggatctttggcttgtcaaatcagattctccattgctatagtgtacagtgcacacagctcatattgcttccttcctgggtgctgataaaaataagagcatggaaattggtttcttgaatataagctttaatttttaaggcttaaaagtattcatagaggtagactgtatgataaataaaaacaaatttaattcacaaagttatctgtacactgcagttttaaaatataccaactaaattatgggtttctggaagtgaatggagaaaacagcaagggaagaaatcgtttttaagataagtaaataattcccatggattgataaatattttccttttaaaatgttatggactgatattttttattcacctttaaatttcttatcaagaagtttatctttgtttttcagatttaaaaatgaaatacaggtattcgtcactttcctgaaaccatgctaaccaaaatcagtagccaaaccaattcagatagatgtgtctcatctaattaaacccattggtttttatgggagggctgcattaagagcacccaaccaccacatgtaagttgataattaccagcatggcaggtgattttatctgctgaccaagcgcatagttttgttttgttttcagaatgttctagggaacatttgagattttatgtgaaataaaattttaagtgccaaagccaaaaaaatacttaactcttttcaaaggccctctttcatccttgccttcgtcaactttcctttgcacacaggaagcaaaatctacttcaagacatttattttagaggaatccattaagaaaggattgttttacttaaatgaaatgctgtcttatttttgctgtgtcttttgacacctcttagctttaacattcttcttttaaccaagccattatgcaaagttatcaaagaagaggagaaggaaaggaggacagatgaaagtgacgggaaatgagaaagaagaggagtgaggaaacagttatttccttatgaatcctgtgtgtttctttggaagaaagagctgttccgaggaagtttggtccagctgtggttgataagaggtatatctcttaaaaaagacacctaatgaaagtgagagaaaagctaaagaaaatttcaatgtgaccactattatgtgtcaaaataaaacttagattccagtggttggcgggggggcgagacggtggcccgcgtgacccgtgaaggggcaatctgcccacctccagggacctgggagaaaaccccaatcttatggaagggtgccacacgtggagcaaccggcagcggggccacagcacggaaaggcccaacgccgtgataccccgcggga

SEQ ID NO: 625096 - DNA, 394 bp, Homo sapiens
cgtcgacgaagccgtacttcaaccactcctacactgctgagtgttcaaactgttttcaaataaggcaaacaccttatttgcctgtaaccaattcagttgtaatcaattcagttgtttctgcacctcacttctgatttctgtatgtcatttacatttttttgtccataaatgtgttctgaccacgaggcatccctggagtctctctgaatctgctgtgattctgggggctgccagatgagtgaatcgttcattgctcaattaaactcctttaaatttaattcagctgaagtttttcttttaacagtatcttcaaattcttagtgttctttcttcatgagatgaagcttaatttgttgtcgacgcggccgcgaatttagtagtagtaggcggccgc

SEQ ID NO: 625097 - DNA, 253 bp, Homo sapiens
  misc_feature (136)..(137): n is a, c, g, or t
cccccaggccccaaaaataaatgggtccctgttgataattaaaagaaaagaaaaaaagatattatttttgttaggccaaacccttgtaggattttaacaatggggatttgtgtgtcccccaccccctttcccattnnacctttttttcccttttttaaaaaaattatgggctaaatttttagtttccaaccccccaaatattaaaaaaatttaatttttttaaaaaaataaaaataaatgtttttaaaagtta

SEQ ID NO: 625098 - DNA, 573 bp, Homo sapiens
  misc_feature (527)..(527): n is a, c, g, or t
taggttttatcgtatatcatatccatcataagatcagctgttttcatcttgccataggtatcattttcggtaaacatttctttaatgtgcaggtgtgtcgtagcaatagaccttgttaacagtgtatgtgctcaaggaattttcagtgcagattctgtgagttcgaattcctgtacgtaatggtcattattccctcttgtctacctcagccccactgtccagtagaaaaatgatccagatttagtcttcaatatgtaatctatcttcttcttggatgtgcagaagggtttgtattatattgtatttaaggcttaacatctcatgccaagtaattttttcttctgaatcacagtaaaactgtgtggaaatcagttcaagaaaaatttgcttggtggtagtgcatgatggtaagtggggcattgggagttcatcctgagtaaaggaagagagcctgtttctcaagcagagtccattctgctagtgaattgcccacttctccaaatgaacataatgcagttaggtcaggnagaatgacacaggaggctcagcatcatttctgtctcctcacttttc

SEQ ID NO: 625099 - DNA, 431 bp, Homo sapiens
  misc_feature (128)..(128): n is a, c, g, or t
  misc_feature (132)..(132): n is a, c, g, or t
  misc_feature (135)..(135): n is a, c, g, or t
  misc_feature (166)..(166): n is a, c, g, or t
  misc_feature (182)..(183): n is a, c, g, or t
  misc_feature (204)..(205): n is a, c, g, or t
  misc_feature (343)..(343): n is a, c, g, or t
  misc_feature (373)..(373): n is a, c, g, or t
  misc_feature (391)..(391): n is a, c, g, or t
  misc_feature (402)..(402): n is a, c, g, or t
ctttgcaggacggccctacggggcttacaggaccttttgtgtgcctggtaccaactatttctgttccagccacattgccatcactcttccactgcctgccaccgcggaccgaggctggtgacaggccncagnagntggaagaaacaccctttcatctcagagtccnctgtggcactggccanncctccccagtacaggggtgcnncaggtggcagagtgaatgtcccccatcatgtggcccaactctcctggcctggccatctccctccccagaaacagtgtgcatgggttattttggagtgtaggtgacttgtttactcattgaagcagattttctgcttcnctttttatttttataggaattagaggaagnaaggtcagatggcgtggnccaggtttttnaacccccaatcttttggtgggggaagggt

SEQ ID NO: 625100 - DNA, 171 bp, Homo sapiens
ttgttagggtaggataatccaggcgcctgtactacccatgatggaagccaaagacgtaccctgtagccgcctacccgatgcaccctataacctgcactgtccacatggacacaactacagccgatatagacttcctactacagaactatagtctatgagcaaagggattaa

SEQ ID NO: 625101 - DNA, 450 bp, Homo sapiens
  misc_feature (404)..(404): n is a, c, g, or t
  misc_feature (411)..(411): n is a, c, g, or t
  misc_feature (442)..(442): n is a, c, g, or t
gaaactgcgcggcccctctcaccagtcaaccccaaactggaaaagtctgatcagagctccacagaagattcaggcaagcccacaggaggtaattctggcaagcccacaggaggtgattctggcaagcccacagaagctggttcgaataaggccacagaagatgattctggcaagtccacgaaagttgatttggacaagcccacctccaaaatctccccagataccggagactttcgaagacttgacaaagtccagccaacttgaaaaaggacaaaaacccaacactttactttccaaaacttgaatcttgggggaaacacttgggcagggggactctgacttctcttttaaagccagagaaaaggagattaagtctttcagagcctacttgaagacgtggaaanccaaggngattgaagaggggtgacacagaagccggaangaaaggct

SEQ ID NO: 625102 - DNA, 399 bp, Homo sapiens
acggttatgatgcaccggactctttcaaggcaggtctggtggtaacgaatccttcgctttgcttctctgaaaaggatataatttattcttgcttagttggctgaatatgaaattcttggttgaaatttttcttctttaagaatgctgaatatatgaccccaatattttctggctcatagggtctctgctgaaagatccactgttagcctaatggagttccctttgtaggtgacctggcccttttatctagttgcctttagcattttttctttcatttcgaccttggagactctgatgactatgtgtcttggagacagtcatcttgtgtagtacctctcaggggttctctgcatttcccgaatttaaatgttaaccctactattgtggcatcgataaaca

SEQ ID NO: 625103 - DNA, 1217 bp, Homo sapiens
tgagctgtgggacgtgtgctaccgtggaccgaacactgccactgctgtgatgtgtgtgctgatgctgtcatgtgggactgcctgtgatgtggtcctgctgtgcaccggatggtcactcctgtgggtgcctctgctgtgtgcatgtgtgcctactgcttggacgtgatgcctgaccttttgacctgtgtgtcactgatacttgctctgtgactcaatatgtaccaacctgtgtgtccctgtgtgactggatgtgtgactctgtctcttgccagtcttacactggcatgttacctggatgtgctacattacactgaaacatgaagctgttgccgagctcgagaacgagcgcgtatacagtataccttgcgcgctgcaaggcccagcgagcaagcgcgtttaacaggcgcctgggtgaccagtcctatacgaaatacgcgtacgagcccgttggctcagctgacgtattggttggcgcttcaatttgcattagagaacagggccgttagacccctctgctgcccaggcgcgcatacgatcgaacgccagttacaaatgatgcgcaccagacgtggtggccgcagttataacgcatcactgaacgtccgagaaatgcacagcgacagatgggctacagttcttcgccttcggcgtggtcgcccccgaacgtgggctatcaactttcgtcgtatcgtctgtgcgggacgtccatgcttattcccgcgttaatttcaagcttttggcttttcgttcgtcaccttggggtgaggaaatagagatattagccgacgaacgcgagggtcgaacgcaaagggatgcccgctttgaactctagcacgtcggtcaaagccgtgtatgtatcgtaccatcggcaaacgcattcgatcgtacatcaccccaaacggtgcaaagccagccggtattacgaaaacggttactccacccgaaagatcggacgaggctttcataaaacgcacctatttgtggatggacaactcaggcgggcgttatacgagtactgactggggtcgagcagttttcccatgttattggcgcagtgtgcattatcgagaacactgcagtattttgagcattatggctgggctatccgagtgttaacactctcaggtcaaaaaaggtgagccccgtatttgggctgtcacatctacatcaccccgttcaccgactagatttacacgatatgacgtatgacttcaagg

SEQ ID NO: 625104 - DNA, 475 bp, Homo sapiens
  misc_feature (464)..(464): n is a, c, g, or t
acataccaagagattgatatcttaaaaaaaaaatgagctcggtggcttacctgtataatcccagcactttgggaggctgaagcaggaggatcacttgagcataggagttcaagaccagcttgggcaacatggcaagaccctgtctttacaaaaaaattcaaaaactagctgggcatggtggtacacacctgtagtcccagctattcaagaggccaaggtgggaggatcacttgagaccagaaaattgaggttgcagtgagctgtgtttgcaccactgtgttccagcctgagtgacagagagagatcctgtatcaaaaacaaaaaacaaagcagaaattttggaattaaaaaaatgcactgaagcaaatacagaatacatttgaaagctccaataatagacttgaccaagtaggagaaagaatctcagaacttgaagacaggtctattgaaatcatccagtcagncaaaaagaaaa

SEQ ID NO: 625105 - DNA, 1250 bp, Homo sapiens
ttgctgtgggctcgggttcttggggcgtgttctgctggctgagtgttatggacctcactgctgtacatgactggtttatgtagtgtgtgtgtgcctatcccaacatccccctctcttctcccttacctgtgatgtacccaatgcctgttttttgctacatgtttgatgtgacatgtgcaaactgttttgaacagccggaaagtcaacccaccatttggcatcaattggtgcttctgctgcttggcccatcttccacgcacatacatgttttgtgcaccatgctttttgtcaccatgtcagtggcaatttcttcatccacattccatgtgcatcggcagcatcattgcacatgctgacaatcacccttcagcttgtgcacatttgcgtccacgttttttgtgcacacacacatttgtgccattcttccgtcttcacttgcctccgcattctttgacgagcgcacaagcattgcaacaattccttgcgttcaccatgtcatgggccaacacatgcccacttggccgaggagtcatccttgttgcaccttggcccaagcacacattcccaaatgcaggcacaccccaccccctagctcatttgctttgttgtccttggcttgaatcaagcaaaacaggtgcctcttgtgcaccccacttctggtttgcggattttggccccttctcaacctatgggcctcggccattaggttgtggtttctgggcgaggccaacccctgtgggcgtcacaaccagcattgcaacagcaccaggtctgaacgcaattgcacctgcctagtgcaatttggcggccggtcgtccgccagaggattacttgagactgccattttgtgcacgcggcaaccctttggcacagccctccttggctctgccgagcccttggagactctccaaagcaaagtccacacgttttcattcccacctcttgaacggcatttggcagtttcccacttctgagcactcgcccgggggccttactaacccattggagggcagaggaccaccccaactcagtgacttcttggtccgcccccatcccacaaccccccgagctcaatcccttctgaccccacccaaatccaatcggacagccagcaaagctgagttacatggacacagcaacagcaatttcccaacccccctggagctaaagtgggtatgccatatggcgcatttcccaataactccctttggcgctatggaacaactaaccttcatagcagcgtatccgcc

SEQ ID NO: 625106 - DNA, 302 bp, Homo sapiens
gaggagatacagaagtgttaagagtatttgaacagagccaggtgcaggggctcatgcctgtaatcgcagaactatgggaggcaggggggtggatcacctgaggtggggagttcgagaccagcctgacgcaacgtggagaaaccctggtctctacttaaaatataaaattggcagggcatggtggcacacgcctgtaatccctgctacttgggaggctgaggcaggagaatcacttgaacccaggaggcagaggttgtggtgagctgagatcgcaccattgcactccagcctgggcaacgaga

SEQ ID NO: 625107 - DNA, 120 bp, Homo sapiens
ccccgggctgcaggaattcggcacgagattgttgtttgtgtcctgttcaaaaatttcgaagttgtatccattctatatgcgagcagttctataatctgcgttaactcatcaagtatatcg

SEQ ID NO: 625108 - DNA, 962 bp, Homo sapiens
gacttcgtgtcgctggcactgcgggaccgccgcctggagttccgctacgaccatgggcaaggtgggcagctggtcatcagtgagcatgggagccagtcacacctggtgagccatggaccaggtgtctcactgcgagctgaaactggccgcacaggtgtgccctgacgatgtggtgctgactgtgtcacacccgtgctgttgcggtggacgtcccactggtctccgcaaaaaccagatcctcaaacccgtgacacgtgagccagcatctaccagtacgaggcgtgcagctccacgaccttcacgcaaagcttggccctgtgctgcatgccgatgtccatctgtcgcttcgactgtgtcgccatcgcacgcttgtgtctctcctctgcgagtgccctgcagcttgcttgacccctgagagcactgtagctgccggccacgtgtggcctgtcactgtccttctgcagtgtcaaccaccatgtaacctctgggcgcctcagggccacccgccttgccctcacatgcgcgtgcctccttggcggtcccagatggcgatggctttgcctactgtcgtcgccctgtgtcacccgtgtgcggactttcctccaacggcacctgcatcctgacgaacgcacacggggggcctggcctggaccgcaacgtccagcccgagcggcgcaccgtgggactcaccataatgcgccccattatggacctgcgagctggccccacttttacgtccgacgatcaccctccatcacggccttgctgaaccctgcatcgacaccggaagaaccgcgccacttgggctagacgccacaaccaccatatcagaaacttgatgtcccttgcgccccacttggacgcgccccccagcaaccggggaccttggtttcgctccttgcgcagttgccaacacggcctcacagagataaggacaaactcactaattctgcgaccatgga

SEQ ID NO: 625109 - DNA, 475 bp, Homo sapiens
  misc_feature (1)..(2): n is a, c, g, or t
  misc_feature (182)..(182): n is a, c, g, or t
  misc_feature (186)..(186): n is a, c, g, or t
  misc_feature (214)..(214): n is a, c, g, or t
  misc_feature (219)..(219): n is a, c, g, or t
  misc_feature (224)..(224): n is a, c, g, or t
  misc_feature (275)..(275): n is a, c, g, or t
  misc_feature (278)..(278): n is a, c, g, or t
  misc_feature (465)..(465): n is a, c, g, or t
nngcaacctctgcctacccaattcaagtgatttttgtgccttagcctcccaagtagctgggaccacaggcacgtgccaccacacctaatttttgtatttttagtaaaggcagggttttgccatgttgcccaggctggtcttgaactcctggcctcatgcagtccaccggcctcatcctccgnaaangtaggatagcaggcatgagccattgtgnctgtnacttngataacttgattaaagtgatgttctgcactgtaaagtgactgttgttctgnttnttaattttacttgatagaacctagaaatgagtcaccaagtcatatccatattctgggggaagggaattaagctccaacccctgaggggaggagtatcaaagaatttgtgggcatgtcaaaattcctaaagtaattagttaatattttgggggaagataactctgaggttatacagaatctgatttcnccttaaaaag

SEQ ID NO: 625110 - DNA, 258 bp, Homo sapiens
ggattcactggcatcctaaaagtgctagaagcagactgtgatccaccatgcccagcctccattctttgttctaaactttttcctgaagggcctggaggaagtcacacccacaggccagaccccacattcttttctgctgaacccaagtcttttgacaaagcttcccttctttaaccaattgcaaatcaaaaaatctttgaatctacctatgactttgtaagccccccacttcaagctatctcacctttttaggccaaa

SEQ ID NO: 625111 - DNA, 100 bp, Homo sapiens
cactgtattccttaggtctgcttcaggtttgttcaagtcatatatgcgtaacagtttatcctgtcccccggttacaaataattactatcctgcgtgaaat

SEQ ID NO: 625112 - DNA, 383 bp, Homo sapiens
  misc_feature (28)..(28): n is a, c, g, or t
  misc_feature (80)..(80): n is a, c, g, or t
  misc_feature (142)..(142): n is a, c, g, or t
  misc_feature (144)..(144): n is a, c, g, or t
  misc_feature (174)..(174): n is a, c, g, or t
  misc_feature (181)..(181): n is a, c, g, or t
  misc_feature (193)..(193): n is a, c, g, or t
  misc_feature (200)..(200): n is a, c, g, or t
  misc_feature (204)..(204): n is a, c, g, or t
  misc_feature (217)..(217): n is a, c, g, or t
  misc_feature (247)..(247): n is a, c, g, or t
ttttccagctttgcaatttggagttganttttgaaaccgatgaaccagttacaattacttctgatccgataacttttttnttggcaaagcatggtcctgttaattcctttcttggcacctaggatcattgtttcaacatctntncttttagaaaacaagtttaaacagcccctngtttttntaatcttccttntattttntttnttcatgttctttntctgttaggttgggttgctgctggctttcnggtccgccgctttgggctttattaggctttctgaggtgcttcccaaccccagctctgtggtcaaggaactgttaagagtccttcttttctcttttccttctcctacttttatttcagtttgttgaattcctcccat

SEQ ID NO: 625113 - DNA, 878 bp, Homo sapiens
atgaccccaatacgcaaaattaaccccctaataaaattaagttgaaccgacatcacgtcatcgagctccccagcactcaatcgcaacatctccggcatgatgaaacttcggctcactccttggtcgcctgccggatcctccaatatcacctacatggactattgctagaccatgcactactctaccgagacgccgtacgaaccgcgcttttcatcaatcgcccacgatcacgtcgagacagtaaatgatggctgaatcatccggtaccttcacgccaatggtgcctcaatatttcttgatctgcctcttcctacacagtcgggcgagggcctatagttacgggatcatattctactactcagaaacctgaaacatcggcattatcctcctgttagcaactatgagcaacagccttgataggctatgtcctcccgtgaggccgaaatatcatgtctgaggggccgacagatgaagttgacaaaacttactaatccgccatcccatacattgggacagacctagttcagtgagtctgaggaggctactcagatagacagtcccatcctcaaacgattcttgacctttcacttcatcttggccttcattatttgcagccctagcagaactaccagctcctatacttggcacggaaacgggatcaaatcaagcctcctaggaatcacgtcccaattccgataaatcaccttcacaacgcttactacataatcaaagacgccctcgtgttacttctcttactgtctctccttaatgagatttaccactattgtcagcagaactcctaggagaagcagacgattattacctaggcgaacccttaaagaaccgttcaccagatgaagccgagtgatatagccatg

SEQ ID NO: 625114 - DNA, 196 bp, Homo sapiens
acgtcttagatctgcatatcgagggtcctgtggttctgatgaggggagatcatcctgcattgtggagggtccccgaggttctgatgagtgggagaccactccatatggtggagggtctctgcagttctgataaagggagatcatcctcgcatggctagaaaggtccagagtatgcctggggattcctctagacgtc

SEQ ID NO: 625115 - DNA, 190 bp, Homo sapiens
gccggcatagcccttgtgacaccgggttgtggaatgacgcccaggtggcagcgtggcgcacatcactgacgctgtcacgagcttggcggcacgattgctgtccagttggtgccacgccggcgggaaagcctccacagagaaatggtggccgggtttccatggcggggtgattcctcccgaaaagggcggg

SEQ ID NO: 625116 - DNA, 580 bp, Homo sapiens
tagtctgaggatcccgtatttgacgcgtctcttctgtgcaggtttcgtggcggtctgtgcttgaggactgctgttcttcgctgatttcttggcctatagcagtcaggaagggcgcgcaggagcagtgggaagaggggattacccagcaccctagcccatcccactaacaggagatgcagctcgatcctttctgccgccctccacaatgtttgaaggtgctggggcaggatgggagaggagggaggacccagtgtccggtcctgagtggatcgtggggttcttggagcccaggccccattcagtggaggaacagcccccttcactcctcctgcccagcagtcctgggctgtggcttgaacactgcctcctgcaccaggagtacggtgcccttacttgtgatgaagggcgtgacagagagaagaacacggcgctgttcgtactttcccctaagaaggcaggcctgggtgaggggcaccagcacgtgggccccaggcactcagtctaggtgagactctggattcaggccacattgcctgaatctccagaagggtagagggggtacagggcccgcagcaccaca

SEQ ID NO: 625117 - DNA, 475 bp, Homo sapiens
ccgcagatttgcagcgaatctgatggctcccaggctcgctgccacgtggttggtgctgacgtgcggcgcaatgcggtggcggctgcagtcacagctggaaccagcgtgactttccctgggagcccagcaggtgcctcgcgtcgctggcaggtggtagggtgcccttgaagggggctggtcgtgaggaacgaaggaaaacccgggccagggcttccaaggacagcggccctggagggggccggagccgtcaggttactctgagcaccggagaaaaagccgcttcagcagaggtgtaaacgcatttaatctcccaacaggacatatacagagcggagggctttggcattcagatatattgaccgggcaagatggtaatccaagtttcctccccttcaaggtctcctgctgtatttgcctgggctctgatctgtcgtcaccgcttgggccaataaatcttgataccagcctccagaaa

SEQ ID NO: 625118 - DNA, 821 bp, Homo sapiens
ggagaagagtgtctggaatgcttgggagacattttaagcaggacaaatccagccttaggctagactgcacctgtccacagcccagcccaggcccatggaaaagaatagtaaaaccttgtctttaagcacatagaatatgtgtgaaacccagaaggctagaaaagaaagggaagtggaggagaaaaggcactgggactccagctgggagtatgaagactacgggagtgtacggaaaaggaaccttacagtgctggatggactctacagagaaaatgacctggatcccaggtactgggccaagggacagcatcagccctacagaaaaagggattgtggatactgggattttgaacagagtgaaccaagctatatggactgtggggaagcacatgaaagtggaaagggctgtgtgtaccacggaggtcatgatggttataggagtccagaaaatgtagattatgagagtctcagccctgggacgaaggataattcacctacgagaagcccagatgtgacctcgaaagctggtggatacggggaggcaaatggctactcagactgtaagaatctgaattataatcctgaggactctaaaaaagctgaacaattgactgactgtaggggtatggatgattcttcagcgaatttaggtcaacctcagttgtggtatatagaacatgagaatgttaaccataaatcttgagggatggtggggcaactaaatttttaattgtaagaggaacacaggcaatttatatcaatggttcctggggaaggttatctggatggctcaaggctgtgagcttttcagaattcgaatg

SEQ ID NO: 625119 - DNA, 161 bp, Homo sapiens
taggtgcattcattagcactttctattatattttactttttccattttgtaacttcatgtcaaaatgagccacaatagaatagtcatttctagtcaatattgctaatcattgtcatgttacactttcctgtctccccttatgatgcatttatgagtggtta

SEQ ID NO: 625120 - DNA, 394 bp, Homo sapiens
tctcttagacaatttgttcctgtgttgccaccatcagatctatgagataccagtgcgctcttgcgtagtacgtctttcaacgcacttaagaacttgcactttatgtttatcatcgcgtcatgatgtctctcctgtctccatagcctctccgagtgagcagcagcacattacaagtatggtgtgacatcactcatccatttaactgtgatcagaccataatgtttagttaataagtttcagggccaaccatgagacctttcatcagtgtatctgagcttgcaccttagacttttagtaagtgacgtgttgaattcctagttggagttaaaacgtctgttcaatttaccatattcgtgctgtctcaggcaaaaagaatctctggctgctctcaaag

SEQ ID NO: 625121 - DNA, 203 bp, Homo sapiens
cgttagtagtacttttgttctttctttttttctgttgccttcctttgtgatttgatcactttggaaatgatatacttggattcctttctcttaatcttatctactacaggtttctacttagtggttactatgaggcttacataaaatattttatagctataccatcctattttaagccaacaacttcaaacacatacaaaact

SEQ ID NO: 625122 - DNA, 107 bp, Homo sapiens
  misc_feature (35)..(35): n is a, c, g, or t
  misc_feature (95)..(95): n is a, c, g, or t
  misc_feature (104)..(104): n is a, c, g, or t
gaggaaagtttgttgaaaagcaaaatgtttttctntcctgcccgccccccccgttggttgttggtggtcagaattattgtgtaataaataatagncattttttntta

SEQ ID NO: 625123 - DNA, 244 bp, Homo sapiens
  misc_feature (1)..(1): n is a, c, g, or t
nccggccatgttgatcagcgcatggcgcacatgggcactcgaccaggccctgctcatccacgagggattgccgccctggtctcgtcatgccagaagccccaggtccgcgccagttccacggaaaccttgcgcacttcggccaccttggccagcgtgtcggcgatctgctgggcattgttcacgtcgagcggcagttgcagccaggcctcgggacgggcgcgccactggcccaggctttccagcg

SEQ ID NO: 625124 - DNA, 196 bp, Homo sapiens
aaaggggaacccaaagcccctttgttttctgccccccggggtttttccccgcccagccggggggggcccaggggggggtccccccccccgccttggggggcaaatggggggttttttatgggggcctggccccccaattttggccctcccggtggttttggtacaaggccctgttttggttatggcctgcctttta

SEQ ID NO: 625125 - DNA, 264 bp, Homo sapiens
  misc_feature (54)..(54): n is a, c, g, or t
  misc_feature (80)..(80): n is a, c, g, or t
  misc_feature (83)..(83): n is a, c, g, or t
  misc_feature (107)..(107): n is a, c, g, or t
  misc_feature (112)..(112): n is a, c, g, or t
  misc_feature (117)..(117): n is a, c, g, or t
gcaccatgcgcgcagagcccatctccactccaaagttagacaaaatgccaggantgttcttctctgctaacccaaagganttnaaaggaaccactcattcacttctngacgncaaantgcaaaaaaggaggccaaagactttttgggattggatattaaagcataccttagatctatgatcccacaacttggatcttggaattaaatcttcccaagtcccaaggatgtacttcttcttctgaaggaatcaatgtcttaaccttt

SEQ ID NO: 625126 - DNA, 849 bp, Homo sapiens
ctcagaaacaaaaaacaaaaaaaaaaaaaaagagagaagaaggataattaccaggggctgggaagggtagtgggggacagagggaagtagggatggctaaggggtataaaaaaaaaaaaaaaaaataaaaggaggcaggccaggggggcccaggccggtaaccctagaaactcggggaggccaaaggggggggatttgtttggagaatcaggagtcctagggccaagcctggggcaaactatgggtgaaaccctggtctctagtattattacaaaaaattaagctaaggtgtgggtgggtgtgtcgcctgtagtcccagctcactggggaaggatggggcaggaaaattagcttgacaccccgggaggtgggaattcgcagtgagctgagatttaataccaggtgcatctccacccggggtgtgacagaagctataaacttcattcttaaaaaaatatattattatgtattatttttaaggaaaagaagtgaatataaagacctgggtatttggcgatatgccaaaacaagggggtgacttggtaattcaaaaaatttaattataaggttgtgtaccactgttttttataaattaaccataaaaagaaggtggtgagtgtgggattgtgttgtgtggtaaacacacaaaggggatataaaatgtggtttggagggggaattatacaccaagaatatagtggattacattaacatttatttggtaattgtccttgaaattacaaaatattttttcggtgttaaccccaatttaaatatttttatacggttttttattgtttttacccccacaatgatgttataaacaggtttgaaataataataattttg

SEQ ID NO: 625127 - DNA, 771 bp, Homo sapiens
ccctctctcctctttgttttttttacgataccacacgggcggtgtttttttctgtgttttgttttcgcccccttctctgttgtctgtttctccctgctgttctcctcgattttttttctcttcccctcggtgtttttttttgccccctcctctctgtttttggccacgcctcactcctctcttcctcccttttttttctccccttctgtgtcgtcctcaactttctcctgggtttttgttgagaggagcgccaccgcctcttggcgctcccgcttaatctctcgcgctctcctccccacagaacacccctcccccctcctccccctcctcctctcccgcgctcttatatatataggagggttattttatattttattttttgttgttttcccgtggggtgttcccctcctcctcttttcctccccgcggcccacacgaggggcgcccctctctccccccctccccccccccccctcgtgtccctccgcgggtggccccgccggggtgtttctctcccacaaacacctccccgcgtgctttagagagagttgtttttctttatttcctccctctctcaccaccctctctcaaccctccttggagaggggcggctcctcctcctcgccggccccccactaccccccccacttctcccctttgctgccccccccccccgccccgcgcgcgggctcccccccccccccccccccccctgttgtttttgttggcccccccccccggccccccctaatcatttttttttttttttta

SEQ ID NO: 625128 - DNA, 1322 bp, Homo sapiens
catgcttgcccgtagtaagttaactcttgattccttatagttcgtgtgacattttcgttaaagggtttagtgttctttcatttttgttttcactttttttatttattttagggcttggtttggatgtaattagggtaatgggcagcaataaaaacatatggcacagcattatgttgataaagagggttcttggaaattaaaaagtctatctagttgaagaacccgtggaacatcataggggatggagggagacaattaattgtaaaactcgagtgagtcgttacatctcaggatctcatttctcaagaaggcacttggtgtgttccacgtggacgttttataaagtgaatcggccagtcttctaaccgtggtgtggtgagagtggcgtattctacatttgggggggtattgggactgtgtgggatctttactgcgtgaagtgggccagatgtatatgtattgtaggacattatcttttcccagtgggtgttctactatggggtgtggcatatagaagtggtttcctctactatgtgtggagaaaaaggtgtttcgtggtcatcaaatatatctctgtgtcaaacacacaacatttttttgggaagtgcgagagatactgagattagagcggtatttatatcgcattgtgtactaaaaaatttggggtatgcgggaagattctccacgtgtgcgtaagaaaatatcggtggggactaattattaaggcgcccattttgtggggtcgaagaagttgaacgactaagaggtgtgtgtggcacaaaaaagttgtgttgttctattccagcagcgttgtatgccgttgagtaagagggttggtgtaccccgttgtgttacaagcatccagtgtaagttggaccaaggtatatcactcccttatttgcggggcattgggttgaccaagaaaaaacaggcctgtggggtgatatagagggtagtagaaacaatcataagagaaattcccccccaagtattggggttcaccaaagcatatttattggcgggacaacttcaagtgggtgtctggacccacacagtgggctcgataatagggagcaggaggatcaacatgaaaggacaacaccacatgtgcccagtgtcaccccgtttggacagcccccaaatggcgcactaatatgttgccaccgtgcacacaactgggaggtactagtggcaccccatacaaggagtgtgagcccatctcaccaaagggggggagtaatgacacactgcacgatgcatacgagcgagcgccatacaaaaccagacaggactcaaccgccccgtaaacaacgacaacccat

SEQ ID NO: 625129 - DNA, 152 bp, Homo sapiens
cttaattaagagccagtaaaacctcagatgcttgatgaggtagcttcaactgttgtcacgaatgtggctcctttttgcttgtgcctgcttttggtgaaagtttctggtgtttagaatgccaaaggatagaaatatgcacgcagaaagataga

SEQ ID NO: 625130 - DNA, 1049 bp, Homo sapiens
gcaaaacaccaaatggcggatgacgccggtgcaagcgggggggccctggtgggtccctggtggcccatgggatggggaaccgcggtggcttccgcggaggtttcgcgtcagtaggcatccgggtgccgagggtcagcagtgccagtggacggggaccagggtgcacgaggcctgcggagctcggcggaggcaatgggccgagtgataaggagtggatgcccagttcacctaatattgggcctgcattggttcacatggcacatgataggatcaaagttccactgcgaaggcagatctatcgtcttctccgctgaccttaattaaggcgaagtcacgacgactccaatctgaagttatcctatacccttgtgaggagccgtcgtcctcgcaaggagcagtgagggctatattatgcaaaggcagttagtccgcgagactcgccagagacaagacaggaatccctgtgtgacctgggccgaggcaggcttccgacgggtttccaaggagccgacttactcgtgatggcctacttccggagggcgaagccgtaagcgaaaatgcgacccagcgggtccggatcccttgtggcattggttctagaggattggcgtcccaaaggtgtacagcgctgttggccaaacccctgtactaatgtcccagctgggaacgacccgagtcaaattcccatgtggagcacaaaaggtgcgtcattgcccacaatacggattcagcccccgtcgatgccgggccaagtaagtaggcgataacccttagggtgggctgaaagactcagacacgaattccgcgtggcaaaaagttagactccaatcagactttgtatcaccacgtaatgccaagaacgtggttggaaagcaacggtggctaccgcgtctattgaccgaggccgtaccattgaatccgccccttaggcgagtcaaacacgccccacgtacagagtccgcccatttgtaccgaaccccacagaggtggggaagaaccaacttataggggagcaagttaccggtaacccttccagcagcaaaatcact

SEQ ID NO: 625131 - DNA, 199 bp, Homo sapiens
gtacgcagcgcgacttggtagtcgcccttagtgtcttgctggatataatagtacagggacttgctgtacttactcttgacttcagacctaattttcaacatgtccacttcactgcggaagaccatgattctgatcaggaacttatctcgacggtccccttgcctatcatgaggtcataccagccgcatccagcaaaata

SEQ ID NO: 625132 - DNA, 305 bp, Homo sapiens
  misc_feature (32)..(32): n is a, c, g, or t
  misc_feature (57)..(57): n is a, c, g, or t
tttatggaaacaggtgtcaagagcccacttcnttttatagggccaaaaggaagcgcnaggatgacgagggcctttgtttagccgatagatgcccatccaggagcatgccatcacgcctggctaatttttgggatttataggagagacaaggttacatcatgttgaccaggctggtctaaaactttggacctggagtgatccatccatctcagcctcccaaagtgtagggataacaggggagagccaccgtgcccggccttccctgtcattttcaagcaatcctaaaactcccctcgagccgaaat

SEQ ID NO: 625133 - DNA, 1076 bp, Homo sapiens
gcccttgctccccctccgcaaatgtcccctccccggagcggagctgcaccatagggtccctcttcctgtccctcccagtccatgtacccgttcagaccatcagcctacgagggggcagcccccctgccaggctgtctccctcccgctcagccctgccaggcttccccaagccgatgaatctcgttccgattcctgtgtgagacctctccacacctccgtcgcacactcatcttgactactgctcacaatctggaagtcccgttcgatgcgccggaatgttcagaggaagagccaggtcctgtattgctgtggtgtccactgcccgatatctggaccctcttcaccaaatacatctcaggtctacaacacgtgtaaagaaggtggtctacatagcctgctccgttcaccacgtgtctggttgatttactacgccaactacaacagctacttacgatgggaaccagtgacacgttcagagtgcagttcctggtcgtacccacatgccattctggcgatccatgggtcaagtcatgacgtacagtccctcatggagatcctcttggaaacttctcacactcatacctggaagacaatgctggcccactactaggactgcaatgcatgattcacatggcctgcactgcaagaaaccggcacggaggttcggaaagaaccaatccacccaagaccacgtaacctctgatctcgcagatctaaccgcgattaaacccctgggactgcctcctaacttctcgtttcaaaacatgggcaatcctgggcgcgtcaccaactactacagaggagaggattccgattccgagaagccagtcacatcacgccccaatacgtctgcgcgcacggccatggggttcccatgaacgacgtagtcctaccatacaactggagaagatagagtgtcgtaacccaccgaaattctatccacgacgagggttcgatacaacggcgtcgaaagcacacctctgagtcgttttgacggtctatataagcccccagagttcgcgcgctaaaatatcttctagacatatgtgctccgatatgcctaagcgcatacgcga

SEQ ID NO: 625134 - DNA, 315 bp, Homo sapiens
tgtgacacggtcgctgcagagacacagtcaatcacatccttgctagtttcaaacactaccaggttcttcattggtgaagacatgaatccggatggcatggttgctctattggactaccgtgaggatggtgtgtaccccatatattattttcttgtcaggatggtttacaaatggaacaatgtttacacctgtggcgtttatttcggatctatcacctgtcatcctgaccgcgttactgctctgtcatccacaaccagaccaggtcttctgacgtctggcgagtgatgtcgtcttgaggttcatcatatgtcactg

SEQ ID NO: 625135 - DNA, 352 bp, Homo sapiens
tcaggactgatacttatctatctatgaataaatgtacattatctttcttcaacatagcagcaatcataagatccatgatattcatcacacatgacaacaaaaggatcatagaaatctactagctcagagggcactcatttgtcaattgaaagcaagtaatgcctctattagagcattataaggaaatctcgtcggtttcgacatcggccacaacaaacttaaacctctttttctctttaagtccaggacaagtaagacccatttggttcatggcccacaataacagtatgccatgtcacgtcaccatctgtcatcattcaaatataccaaactacacacatagagcattaac

SEQ ID NO: 625136 - DNA, 510 bp, Homo sapiens
  misc_feature (56)..(56): n is a, c, g, or t
  misc_feature (64)..(64): n is a, c, g, or t
gtgggggagtctgccccctcccaggtgggcctaagcaggaagggggtggggggggnagccggcngttgaccgtgagaccacgctgcgtctgacccctgggcccccacggccatggatgccccacgggcctactgctagctgcgtgctctccagtccccgggccgaggctccagcgttgcgcagaagcgtggggtgagctgacccagaatccctgccctgctctccccagcgctaggagaccaggccagcccaggaaccagggaggtgacctgctctctggcctcctggctgatgtcacagcactgagctcagcccaggccttcgtccactcatgtccaagaggcggggcatccccacccagccagagccctgacatgggctgactcgctgaggccagcagcctgcggagaggagcgcagagtgggtgtctgcggacgcgcgaggcaagtgtgtcggggctggggtgtgaatccagcttgtgagtcccggactatgtgggtaccctaccct

SEQ ID NO: 625137 - DNA, 351 bp, Homo sapiens
  misc_feature (295)..(295): n is a, c, g, or t
  misc_feature (311)..(311): n is a, c, g, or t
  misc_feature (336)..(336): n is a, c, g, or t
  misc_feature (348)..(348): n is a, c, g, or t
atcactgccaatagatatagttcttcagacacttctggcctttgcagttacctgttatggtatagttcatattgcaggggagtttaaagacatggatgccacttcagaactaaaaaataagacatttgacacattaaggaatcacccatcattttatgtatttaatcatcgtggtcgagtgctgttccggccttcggatacaacaaactcttcaaatcaagatgcattgtcctctaatacatcattgaagttacgaaaacttgaatcactgcgtcgttaagatttttacagattntaataacagggcaggncacagagctggaatattagagtttnggggtataaaanact

SEQ ID NO: 625138 - DNA, 398 bp, Homo sapiens
  misc_feature (15)..(15): n is a, c, g, or t
  misc_feature (122)..(122): n is a, c, g, or t
  misc_feature (135)..(135): n is a, c, g, or t
  misc_feature (145)..(145): n is a, c, g, or t
  misc_feature (329)..(329): n is a, c, g, or t
  misc_feature (366)..(366): n is a, c, g, or t
  misc_feature (383)..(383): n is a, c, g, or t
cggcgcacccgcgantttactcaaaacactgggatttttgctgaacaatttacgcgccattgatgcccaactggcaacaattgaatcagaacaggcccaggcactaccccataataatgacnaaaatgagcctcnctgatgacancccgcacggttgagtgatatctggctgcgtcttagccgtcacttcacgccggaatccgccctcttccgtcatgcggtaagaatgtcgctgttgttgtgcttcggctacgcaatcattcagataacccggaatgcatcaccgggtattggatcttgcttgacaagtttgtttgtctgccagccanaactatcacgccacggcgcaaccgcctggaagttaangaattaattggtacgcnggtaggtatcgccaa

SEQ ID NO: 625139 - DNA, 1436 bp, Homo sapiens
  misc_feature (67)..(67): n is a, c, g, or t
ttgcgtcctctgcgctccgttgttgttcgttcgttgactctttcttgtgtgggtcgagcgatcaatncgttctgtggatggtgactcatgctcttggatgtgttgtttgggtgtgtttgttgtggagcgtcgactgcgttgtggcgtggtctcgggacatgtatgtgtggttgttctcgctcgcatcgatgtcttgtgtttgtgggagtgagtgttcgctcgccgttgctccgggttcggattaatagagacagtgctgtggtgtgtgtggtttgtggctgtgcgctgcggtcctcacccccttcgtcttttgttcgtggatgtgtgtgtaggtgttcttctctccccggctgtggttgttgtttgtcgtgggtgtgtgccccgtcaactcctgtgtggtgtgggtgttcccttgatggtgtcgactgcgcggcgccgtctctgtctttgtgtttttgatctgcccctggaggtggtgcgctgcttggcggcgctccgatgggtttaatctcgtcggcccgcgcggtggctttgtggtgtggcgacacacgcggctcgtgtgtgctgtagtggtcttcgtttcatctcttctgctgtgcgcagcggcgcgctgcttctggttatagatcaggtggtccgtcggtcgagtagtgaggtagggttgtcatttcgtcactgctggggtggtgatgtttgtctcgtgtggccgtgggttctattctatttgtggtggcgtgctctctgcgggtgagtgggagggatagtgttcattgatgtctcgcgataaagtgagctgtctggggggatgacacaccctctcatacaaggtgctggttggcttatggggcaagcacaagaaattgctgtgggggcccccaccggacaggttggtgtctcttcctgctagatagtcgtctcttgggtgtgtctatctttcattataagcccctctctcttttttaacccgctaggtatttcttcgatatttttctctcactagagtgattctcccatactcactgtctataccctcttgagagtcttgctcgttatatagaagagcgctccctctcttatccacaagtagtgactcactcacacaagattagctcgcgttagagtttatctctctcggaccgcccggttgtctgtctatacaagccgcgtgtgtagaatggtgtatctctctgtcgccacatatgttcgcccctctaacgtctggtgagaacacgcagtcaaaatgtgtgttagataatatctcactaaaacaatggccccaccagttttttagaaggcgccaccctccacacatgggatcttatcgaccttcggtgctaacttcttctctcccctgatggacagaaaattttttttcccccccccatttttgaaaaagggagttttttaaaaaaaaaaaatatattttttcccccaca

SEQ ID NO: 625140 - DNA, 259 bp, Homo sapiens
  misc_feature (205)..(205): n is a, c, g, or t
cttgatctcctgtgcttaaacaatcctcccgcctcataggtgtgagccaccatgcctggctaatttttgttttttaaatgtttttgtagagatggggtctcattatgttgttctggctggtctcatcctgggctcaagtgatctttctgctttggctgtccaaagtggtagggtcacaggcatgagccactgtgcctggcctganaattttttttctccttgaaaatttggatcatcctattagtaatattttttcaag

SEQ ID NO: 625141 - DNA, 1500 bp, Homo sapiens
  misc_feature (914)..(914): n is a, c, g, or t
cttccgttcttgtttctcatactgggtggtgtgtctgtgtgtgttacaacatgctcttggtaccgttggtgtgctccgctactatgtatacgctttttacagggggctttttgtttacttttttatggcccccccgccgcttgggttttctgtgtcggcacactatctgaaggctctcgccccatggcggtcttccccactgttggtgttactccgttttttctctgcttctctcaagcctcccctcgggcgtacacccccgttggtggtgtgtagcccgcagccacgtcgtgtgggaagctgttgtttttttgtataagaggcccccccccacgacggtgtgtatgcgtccctttctacgactcttggatgtttggggagttggtggtggcctccccccctccccccgtttgtgccccgggcggagaatgatctgtcgttgttcgtccgacaccgggagagttgtgtttcgcccccgaaagagtgtgacccaattgcgcccaaagtgctgttcccccctgttgggggagaaacagaccacccgctgcctgccgcagagagcacaacctcaccccccctccggggtaaattatttatatagaccgcgttgttgtattcctcaaaccctggttaatcttttagttaagtgacccctcagcatattgcctcctgttggaaacaccccaatatcgttcaccgcagaggaaatattgtagatgttcttctggcgcgagagagccctcttataggggttgtgagaaaatggtttaatagttcgcagcccccgcgtcgtgatgtggatatatcccccactctccccatcgggtatatacccccacaggtatgtcccccgcgacggaaccactattcttgtccaccccgcagtgtcgctccgcgcacgcgcacacatgggncgacagaaacgcgctttcttcttatccctcgtatatttatatcttttatattgtcactcttgtgggtttttagcgcgcacaatatatagggcctctcccctctctaacaccctcgttagagagtgttatatattttgtatattctcttgggaaatatattttttacactgttataaatatttggatatagagtcacacagcagtttttctcttgtgtatacactcaaagagatatgtgtaaatgtcccgcgatagaaattgtttttttttatgggtctctccagtgcaccaagggagaagtataagtgaacacaaggtgtgacacctgaggcgtaagtattgcgctgtgtgatcttacactcttataaatgaggagtgagtctctatttttttgcgtagcccatctctcccagctctgccagtgtttccaccgtattccaggaagccataaagtagtatgaaaggtttgaagaatttttttttaccagactagttccttaaattaaccagccttattaaaaatttgtcttaaatttaataattagtataaggatatgacctaataaatgtttccttacccttaaga

SEQ ID NO: 625142 - DNA, 760 bp, Homo sapiens
  misc_feature (335)..(335): n is a, c, g, or t
gcaggtgtcgtgaaaactagccctaatagccaaagatgggaaaggaacaagactcatatcaacattgtcgtctattggacacgtagtattcgggcaagtccaccactacgtggccatctgatctataaatcgcggtggctatcgacaaaagaaccattgaaacaattagagaaggaggctgctgagatgggaagacgggcgtccttcaagtatgcctgggtctaggataaactgaaagctgagcgtgaacgtggatatcaccgattgatatctccatgttggaaatgtgagaccagcaagtactgatggtgactatcagttggatgccccaaggnacacgagaggacgtgttatcgaaacaacagtgattacaggggacatctcaggctgactgtcgctgtcctgataggtctgctgctgggtgttcggtgaatttgaagctggtatctgcaagaatgtggcagacccgagagacatagcccttctggcttacacactgggtgtgaaacagctaattgtcggtgttaacaaaatggattccactgagccaccctacaggcacggaagagatatgaggaaatggtaaaggacagtcaggacattacagttaagaaaacttggctacaagcccgacacagtagcagtatgtggccaatgttctggttggaatggtgacaactatgctggagccaaagtgctaacatgccttgattcaggggatggaaagatcaccgtaaggatggcaatgccagtggaacca

SEQ ID NO: 625143 - DNA, 208 bp, Homo sapiens
ggtcgacatagaggaaaacgtgctgacctaagtaactttagaaatgagtgggccaggcgtggtggctcatgcctttaatcccaggactttgggaggctgaggcgggaggatcactggagcccaggagttggagacaagcctaggcaacatagtgagatcccatctctacagaaattttaaaaaattagatgggtgtagtggcgcatgc

SEQ ID NO: 625144 - DNA, 649 bp, Homo sapiens
  misc_feature (1)..(1): n is a, c, g, or t
  misc_feature (30)..(30): n is a, c, g, or t
  misc_feature (178)..(178): n is a, c, g, or t
  misc_feature (394)..(394): n is a, c, g, or t
  misc_feature (420)..(420): n is a, c, g, or t
  misc_feature (437)..(437): n is a, c, g, or t
  misc_feature (488)..(488): n is a, c, g, or t
  misc_feature (501)..(501): n is a, c, g, or t
  misc_feature (512)..(512): n is a, c, g, or t
  misc_feature (555)..(555): n is a, c, g, or t
  misc_feature (576)..(576): n is a, c, g, or t
  misc_feature (578)..(578): n is a, c, g, or t
  misc_feature (630)..(630): n is a, c, g, or t
  misc_feature (649)..(649): n is a, c, g, or t
naggatcggacgagggaaggtgagcagggnctttgtttaatgtgctagtggctcatcatcaccagtgacctggttgggcctactctccttccagaacctgcattgcttcccagacctccccactgagatgcctctaagagccaaaggagtcaacacttgagcctagggtgggctacancaaaagattctaatttaccttgcttcatctaggtccaggccccaagtagcttgctgaaggaacttaaaaagtagctgttatttattgtattatataagctaaaaacatttatttttgttgaatcgaaacaattccatgtagcaatcttttttctgttcacggtgtttgtgataggaccttaaattccgcaagcatcagttttttgaaaaaatgggnattgaccggatagttacaaggaaagnttataaatagggtccancatcatttaacttttgtaaacatgccttctctcctatttgaaggcatctgntatttttcctggnaagttgggccntcctgaagaactctgccatggattcctggttcctgggtccagnaaaaggaaggtttcaattctngncataaaggatgctttcagattgggaattttcaaaataaggggggattatttnttgtggatgggaacttttn

SEQ ID NO: 625145 - DNA, 682 bp, Homo sapiens
  misc_feature (10)..(10): n is a, c, g, or t
  misc_feature (72)..(72): n is a, c, g, or t
  misc_feature (112)..(112): n is a, c, g, or t
  misc_feature (165)..(165): n is a, c, g, or t
  misc_feature (181)..(181): n is a, c, g, or t
  misc_feature (184)..(184): n is a, c, g, or t
  misc_feature (187)..(187): n is a, c, g, or t
  misc_feature (210)..(210): n is a, c, g, or t
  misc_feature (229)..(229): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (288)..(288): n is a, c, g, or t
  misc_feature (361)..(361): n is a, c, g, or t
  misc_feature (383)..(383): n is a, c, g, or t
  misc_feature (389)..(389): n is a, c, g, or t
  misc_feature (416)..(416): n is a, c, g, or t
  misc_feature (439)..(439): n is a, c, g, or t
  misc_feature (441)..(441): n is a, c, g, or t
  misc_feature (457)..(457): n is a, c, g, or t
  misc_feature (472)..(472): n is a, c, g, or t
  misc_feature (482)..(482): n is a, c, g, or t
  misc_feature (488)..(488): n is a, c, g, or t
  misc_feature (497)..(497): n is a, c, g, or t
  misc_feature (499)..(499): n is a, c, g, or t
  misc_feature (509)..(510): n is a, c, g, or t
  misc_feature (529)..(529): n is a, c, g, or t
  misc_feature (531)..(531): n is a, c, g, or t
  misc_feature (533)..(533): n is a, c, g, or t
  misc_feature (542)..(543): n is a, c, g, or t
  misc_feature (550)..(550): n is a, c, g, or t
  misc_feature (553)..(554): n is a, c, g, or t
  misc_feature (563)..(563): n is a, c, g, or t
  misc_feature (568)..(568): n is a, c, g, or t
  misc_feature (579)..(579): n is a, c, g, or t
  misc_feature (589)..(589): n is a, c, g, or t
  misc_feature (617)..(618): n is a, c, g, or t
  misc_feature (630)..(630): n is a, c, g, or t
gttcattaanaacataaaaagacacttgaaactgtataaccaactagattccttaataattaatcactaganaaagacccaaagacaaatattgggcaggaaatcaattctnactgagcccggtttccatgtaaaatctcatgttatggtgggcataggtggaancatctaaagaaaagangtnttnttttttgtttaaaaaagtttgtngggaggaaagacatctgtntatcacttcaaaatattgatttactgataaanatnaatctnaatttatnatntngatantaacttcataaatttatcggcattgtccaaaatattttattctttaatggaaaaagccattaatattcaaatnaagggatcacattaaaaaaaanccatanataagaaacagcactaaaagaacatanaagcagcagtaaaagaaaaaaanantaagaaaaacaagttntattaaaaatattangtaaaagaanaaaaancaattcaangnctacaacaannaataaaattatatacaaantnancttgaaatnnaaaaatncanngttgcagtnttttnaaatgaccaancaagtactanttcttggttaaaaggccactggtagaannatctgagtgtanagaatgtcccttcactgctggaaaaatccactggctcccaagaaaagaaaat

SEQ ID NO: 625146 - DNA, 109 bp, Homo sapiens
gtgagagagtatctggccttacatagaagaagaacatccatagaatttctctttcaaagaataagtgtacaattatctttcttgaacgaaaaggaaaaaaattagtatc

SEQ ID NO: 625147 - DNA, 822 bp, Homo sapiens
  misc_feature (24)..(24): n is a, c, g, or t
  misc_feature (113)..(113): n is a, c, g, or t
  misc_feature (219)..(219): n is a, c, g, or t
  misc_feature (229)..(229): n is a, c, g, or t
  misc_feature (235)..(235): n is a, c, g, or t
  misc_feature (262)..(262): n is a, c, g, or t
  misc_feature (274)..(274): n is a, c, g, or t
  misc_feature (306)..(306): n is a, c, g, or t
  misc_feature (328)..(328): n is a, c, g, or t
  misc_feature (334)..(334): n is a, c, g, or t
  misc_feature (339)..(339): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (355)..(356): n is a, c, g, or t
  misc_feature (365)..(365): n is a, c, g, or t
  misc_feature (387)..(387): n is a, c, g, or t
  misc_feature (392)..(392): n is a, c, g, or t
  misc_feature (404)..(404): n is a, c, g, or t
  misc_feature (440)..(440): n is a, c, g, or t
  misc_feature (460)..(460): n is a, c, g, or t
  misc_feature (469)..(469): n is a, c, g, or t
  misc_feature (481)..(481): n is a, c, g, or t
  misc_feature (487)..(487): n is a, c, g, or t
  misc_feature (492)..(492): n is a, c, g, or t
  misc_feature (496)..(496): n is a, c, g, or t
  misc_feature (503)..(503): n is a, c, g, or t
  misc_feature (511)..(511): n is a, c, g, or t
  misc_feature (516)..(516): n is a, c, g, or t
  misc_feature (561)..(561): n is a, c, g, or t
  misc_feature (568)..(568): n is a, c, g, or t
  misc_feature (571)..(571): n is a, c, g, or t
  misc_feature (579)..(579): n is a, c, g, or t
  misc_feature (649)..(649): n is a, c, g, or t
  misc_feature (663)..(663): n is a, c, g, or t
  misc_feature (687)..(687): n is a, c, g, or t
  misc_feature (707)..(707): n is a, c, g, or t
  misc_feature (744)..(744): n is a, c, g, or t
  misc_feature (780)..(780): n is a, c, g, or t
  misc_feature (813)..(813): n is a, c, g, or t
taacatagaagaagcttggtagtngacatgtggcatttgacgtttttatgactaagacagttcaggctcaatctcttacagaatgtaaatgtacccctatgcatgcatatgtnattcttatcaaaattaagcttaatcactaaaagaagattcgctatctgaactttcttctacagttttctcactttcgccatcaggcactggagcatctggcctctnaagaagatcngggtcnagtccttctgatatcattttgtttctnattgccatcacnggtacacccacttgaaccattttgagatatcnggcatatctgggatccttggcnacagtnaaganatttncngcngatacnncactttccngtagtccagagtcttgtgtccngtccngcggtggttgcnctgaagtggcttcaggatgtcccccatttgtgaaantggtgaaattaaaaggaganacttcaacngtaaaaccaccnaggccnggganagangaaaacnttgcatcnaaaanattgagagtggtgtcaatttgtgggatacgaaggaaagggcggcnagtgtcnccncacaaacngtagaaaagcggttgaggaactgtacagtgtgcaccacaaatgggttcagaaaagccaccgtccttttcngtcgaatagctggnaccttggtcaggtctatgcctgancccatgagaggtagcccgtnctcatccatcttctcagcgggcggtggaccccgagtncacccacaaacccctcccagatggggcccgcccaanccggtaatcacgtttcaactttccccccaagtncccgcctcc

SEQ ID NO: 625148 - DNA, 834 bp, Homo sapiens
atctcttgccatgtcgtccttttgacacagttctttacttttctactactgaacgccaggtcagaaaacgaaccaagcagattttaacagaatgctggagctcttccatgaactgcttcagccacactttcctagcaactttttgctttccctctggctgtgtcagtagactgctgggcacgacatccctgtgttgtgactggtgcactgttctctaccatgttggctctacttaacttgctctgtgatgactggctgaatgtgatctcacacaatgaatgtgactttccgtctgtaatgatacttggacgctagccacttttcaactggtacagcaacgaacggtgtctgctactctatgcttgactgctcctttacagtaaacttgcctttcgatggtatccattctccatgtggcagtcacttacactgacttcacttgcgaacagtaacgatctcgtgaccaaggatagctgcttcaaactatgcgatctatatgccaggcaattctgtaaagagccattccctgcacacttgacgcttttccccagatcatacagcacaatcttaattcctcacagaggctcagtcccagttccagaatgaggaacgctgcctcagggtcgccctgttcctccccttggacctgagacacgagttctgtagtctgggtggaacgctatgatgatattagaacactttcccctctcagagctgatgaccgagatcagtactggtgtggcacactactgccactagtagcattcactgagaatctacactcttggaactgcagtcctgtcatcttcattcacctttaacccggattattcc

SEQ ID NO: 625149 - DNA, 366 bp, Homo sapiens
gaggcaggccggtggctcatgctgataatcccagcacttgggaggcgaggtgggtggattacctgaggttaggagttcaagaccagcctggccaacatggtgaaaccccgtctctactaaaaatacaaaaaaaaaattagctgggcatggtggcacacccctgtaatcccagctacgggggaggctgaggcaggagaatggcttcagcctgggaggtagaggttgcagtgagtcgagatcatgccactgcactccagccgggccaacagagcgagactctgtctcaaaaaaaaaaacatactcaatatgcggttaaaataatcaaaatgtgccggggtggtcacgggcagaaatggatgcttgaag

SEQ ID NO: 625150 - DNA, 723 bp, Homo sapiens
agcatttatgcccccagcacctatgcccacctgtctcccggccaagacccctacccccaccagctatgattcccatgggccctgctacaacgggtaccctggaggataccctgtggatgacgtcgagcaggaatagctcagctggtggccaaggctcctatgtacccctgcttcggtgacgcggacagcagtgtggcctctgaagtccgcagtggctacaggattcaggccagccagcatggacgactctcatgtcgggtccgtgatactacatgagagaaggagtctggtcgcaatcgttcgagccccttctctatcctggcccccccagtggccgtgtgtgagcgggccatgaggtgaagtcacctccctccacaaggacgactggcgatctcgtgccattcccggggtccctgctcctcactcccgattccgggatgagggagtgtgtgtggccatgtcgccccggagtcccagtgtgatgggatcctagtagccctgccatggtgagcaggccacggccgggggctggcgggcgcaggcggccccgggcccgcgtccgtgggacgcccttggacgagccatcacctccgtcgagcaccgcactgagtcagggagccaggtcgtcccaagaggtaatggtgggaggagaagcctgggccgtatgatgcaccgcgcggagccgcagcagggacgactctatgagcgaagaagactcgaagg

SEQ ID NO: 625151 - DNA, 201 bp, Homo sapiens
gggccccctaacccttcctttgaaaagccaattggttttaaaggaccttgtttttagcctaaaagttgggcctttttttaggggttggatgaaaacctttgtggtgttttgccttcctttgctttggttattttataaagggcccttttttttccggatgccccccttttgttttgccccattaatttttttttaggttga

SEQ ID NO: 625152 - DNA, 317 bp, Homo sapiens
cctgacggatcctgtctcccatctggcatacctgtgcaccagccccagtcctcctttctccccacacaatgacccctcagaaggctgtggttataagaacaagcgggactggggatggacagaagaaagaggggatgcaagcaatgccagcttgggagcttggaagggcagtagtgctcttaacagaaagatcaggcagcggggcaaggtgaggggagatggagagaggtaagcttggttgggtatacacgaggtttgcctgtgtctgcagaacatctcacatatatgtccagggagtagctggagggggccgcgcg

SEQ ID NO: 625153 - DNA, 127 bp, Homo sapiens
gatgcaaatgtcacttgagaactgcagacaactgtgtcagtgcaggacatcaaaacccctgcacctgcctgctctactcactgtgacgtgccagctcccataagcttttgggtttgcatggtcctga

SEQ ID NO: 625154 - DNA, 528 bp, Homo sapiens
cccccgacgaattgtctcgggagatcagtggctcggcttgcccgcgggatatatcacttaaagctcaagtatgtgaactactctgaggtttaccacccttgccatctcagccacatgctttgggccttaaacgctcagtcttgtggagttcacctctgtcaaacgatgggacagggcatccatttccagatcgtgtggcattaaccctcgacgctgactctatgatgatcctacaactgtggccttactcaagctcagctgtccctgtagtatatgaggaacacgggtgagggaatgtggaggccacaaaagaacagggacttgcaagaacaaaatgtcacttcagtctccctttcacgaggtagcatgcaggaggacgttgctgcgtagaaggaaggggatcctccaggagctctctggagcccatctaggaaagctagagtgttgttggcccgccaggagctcaggaaggatacatgcacttgtcgacaggggaacaagtgtaggctaccccgtgaaagccaagcg

SEQ ID NO: 625155 - DNA, 304 bp, Homo sapiens
gtcgacgtggtggcgggcggtgtgtacgcgcatcagggccctgttcaactaagcactctactcccagtttactgctaaaatccacttcgacccctaagtttcataaaggccaatgtaagtttcctggggtagaaaatgtagccaattgtttgcaacctcatgggctacaccttgacctaacgtcttaacgtgggtacttgcgctaactttgaagccttcatcagggtttgctgaagatggcggtatataggctgagcaagaggtggtgaggttgatcggggtttatcgattacagtcgacgcgg

SEQ ID NO: 625156 - DNA, 140 bp, Homo sapiens
ggcccccatatgcgctggaacaaaggaaccattctaaaagcatcagcggagtacatcaagtggctacaaaaagaacagcacagagcccgagaattggaacacagacagaggaaattagagcaggctaacaggcgacttct

SEQ ID NO: 625157 - DNA, 465 bp, Homo sapiens
  misc_feature (126)..(126): n is a, c, g, or t
  misc_feature (133)..(133): n is a, c, g, or t
  misc_feature (136)..(136): n is a, c, g, or t
  misc_feature (151)..(151): n is a, c, g, or t
  misc_feature (155)..(155): n is a, c, g, or t
  misc_feature (158)..(158): n is a, c, g, or t
  misc_feature (168)..(168): n is a, c, g, or t
  misc_feature (179)..(179): n is a, c, g, or t
  misc_feature (183)..(183): n is a, c, g, or t
  misc_feature (186)..(186): n is a, c, g, or t
  misc_feature (196)..(196): n is a, c, g, or t
  misc_feature (437)..(437): n is a, c, g, or t
  misc_feature (455)..(455): n is a, c, g, or t
tgtaactgcagagagagccacccaactcatattaggttgtgatgagactgagacatgaacttttcttgtattaggctactgagctctagaggttgcctatcagagcagctgaggttgcttaccccnatggggnatnagcacgagcccttantttnttnagggtaaaanaaatggccttnaatncanttgacgtttnggtgaaatattactgagctacaaggtaagagacttgaacttctagcctaacatccaaaaactattcaagctcttggttttcagcaagtcactttctccttctgggcccttcagtttcttgatttccagaagggaggggagtaggaactacacttgcccacccatccatccccacattgctcttgaggacatcccacattgttgaaggccaaggggggttcagggccacccgatggattccntccacctgttatttgaantgttgcctaa

SEQ ID NO: 625158 - DNA, 476 bp, Homo sapiens
  misc_feature (29)..(29): n is a, c, g, or t
  misc_feature (126)..(126): n is a, c, g, or t
  misc_feature (264)..(264): n is a, c, g, or t
tcccgccgcccgcccgccacccgccagcncaggtgcccgcccgccagtcagctagtccgtcggtccgcgcgtccctctgtcccggagcccgcagatcgcgacccagagcgcgcggggccgagagcngagagacagtcccgggcgcagcgcggagctccgggccccgagatcctgggacggggcccgggccgcagcggccggggggtcggggccaccaccgcaagggcctccgctcagtatttgtagctggcgaagccgcgcgcncccttcccggggctgcctctgggccctccccggcaggggggctgcggcccgcgggtcgcgggcgtggaagagaaggacgcgcggcccccagcgcctcttgggtggccgcctcggagcatgacccccgcgggccagcgccgcgcgctctgatccgaggagaccccgcgctcccgcagccatgggcaccgggggccggcggggggcggcggccg

SEQ ID NO: 625159 - DNA, 346 bp, Homo sapiens
atcacataattttaacttataatagatccattggatgtatatgaggggcatgatccacacaatacataactcacgcatgtgggctaagtgatacgatatggaagacagatacgaagagacagttcagtattgctgagctgatgtgctaaacttagatccttaagagtattattattataaccgtaatattgagtctggggttacagcatgctggtataggtaaatacattacacaacgatgactgaatgcgaccagttgatcttagatgaacaagcccatgctgagatgctgtagcatgaatacattgagattatatatgcatagttgagggattgatttgactgg

SEQ ID NO: 625160 - DNA, 166 bp, Homo sapiens
aaattgttacatggtatatatacagagtgatcaagccaggatacttagagtgtcatcagcttagtacaatacatcttttgtggagtatagtcaccctactcgggctatcaaacattgaattgattccttctatcatactgtatgtttgtactctttaacccagttc

SEQ ID NO: 625161 - DNA, 122 bp, Homo sapiens
gcgtcgacgccaaagagaaggagaaaaccaaagaaaaggttgaatcccatcatctgtcccctttgagcccaatctgagggaggacaggtccctctctcagcctcagaaagtgaatgtcgacg

SEQ ID NO: 625162 - DNA, 124 bp, Homo sapiens
ggtgtgtgtgtgctgtttccctcccactctcttgagcagtgagtatagatctccttctgtgcttagtatgactatgctgggcagtgactcggggatagtcccctgcccatgacatagcccccta

SEQ ID NO: 625163 - DNA, 627 bp, Homo sapiens
gggaaacatcaatttcccccaaatctttggactcaaaaggaaacggatacaacagtaaaactttgcctggttgcagcatccgcccaattaagcttaagtcacacaagcagcttgtattatattttatattttgtaaatactgtataccatgtattatgtgtacattgttcatacttgagaggacattatagttttgttatgaaagtatgtattttgccctgcagctgtggtggtgttttgtatatatacagtggagatagtctaagtgggtgctaaggcacatggaagactgtttatttgcacaggtaccgaaatttttttaagaacagctgtcaaatctcaaaagtgaagatgtaactgtgaacaatttccttatgtactactgaaggtgaaattcggcacaatcactgtaatcatggagtctgtgttgctctaaattgacaacttgacttttaatctgcaattcctagaaagcttcccgtttttaccaaacttcatttctggatattggtatattgccattatggagatttaaaacacctctaattttaaataccaacaaaattggttgtaatcaaattttaaatcaataataataatttggcctccccccttttaaaaaaaaaa

SEQ ID NO: 625164 - DNA, 179 bp, Homo sapiens
cccgtggttgtgggttgacgtggcttgtgggtgaccgggctgtgagaatcttgttcctcaggtcctcaatggtcttgaagtagggactgtagtctttgatctcagcaggccgctgatgacttccgcaccaagtatgagacagagttgaacctgcgcatgagtgtggaagccacggtcaa

SEQ ID NO: 625165 - DNA, 183 bp, Homo sapiens
tatgaccagtggcggcagatggggctgtcgggctggtcctatgaagaggtgctgccctacctcaagcgcgccgagacacttcatggcgagccgagcccctatcacggctttgaagggccgttgcacgtgagatggggcgggctcgatcagcacccccttaacgccggggtgatcaaggcgggc

SEQ ID NO: 625166 - DNA, 394 bp, Homo sapiens
cacgagggcaccatgggcgtctacctgcacctgatgaagggctcggtcagcgtgcgtgaaggccagcgggtggaaaccggcagcctgttggcgcgctccggcaacaccggcaacagcaccggcccgcacctgcatttcgtggtgcagcgcaacgtcggtctggccgtcgagtccattcccttcaacttccgtcagccggtcaacagcctgccgaacttcgcggtcggcggcgaatagctcggcaaggcttgccggctgcgctccttctgcggatatcccgccgcaacactgtcgcgcgctcgcgcatttctggtgtttccgttgttgcgcagtggcgccggtgcgcatggcgcactttacggggcatgcgtgtaccgcgaacggggctggtgcc

SEQ ID NO: 625167 - DNA, 515 bp, Homo sapiens
aatcgtcgaaaggtggctgctaagaacttccgtaattagcccccagtaaatctcgccgcggtaaaacccccttatggcaccagcattccccccccctctataaagatgtataagagggcaaaacagcgcctcctctgtctaccaacagactcaaacgtcccgcggaccactttaggaataaagggccacgctggaacgcaagaccatctgtgcgaagcccacagttttgtggcggggattttcagcctggcgctcgcgggtagggcacgctttttcgcgaaccctggtggtaagccccgggtttttttgtagaccacagaatttcttgcggcgttgtgttccgtcagcgccaggcgctggaccccagcgtctgggaggttatgggcgacggggacgatccgtcgtcaacacccacggacggggccgggactcctcaacggctgcgggaaggtgatgcgcccgcgcccagaccaccttgggggcgcatgagcggcaattccccctcccacaaaaca

SEQ ID NO: 625168 - DNA, 364 bp, Homo sapiens
cacagcatgaagaatgggggtgtgaaaacaatccaatagtggaggcaaagggttgcacagtagagaatccgtcccaccaaactttgcagtgcaggggatgcccgtgtcctcgcctctgtgaggcgataaggcccattcttgaggagagaggaaagagacagggtttcttttcaggaaaacgatggagaagcagctcccttctctttgatcactcgccttttttgatgaccaggtacaagaaaattcagcatttctggggcaagggttgacgtcttgggatcacagagatggcagtctcgtgtgcgaggtcttatgaggctgtgcgttttgtgaaaagggagagtgtacagataagaatgtggag

SEQ ID NO: 625169 - DNA, 81 bp, Homo sapiens
acatctgtgtacttctgcgcgaccgggacagaattcccacgagcacagtactttgggccgggcaccaggctcacggtcacg

SEQ ID NO: 625170 - DNA, 1018 bp, Homo sapiens
actcgtgaccctccgcccttccccttcaagcatttcctcttccctttctcagggctgaagctcttccttcaagagtttctagatcttgtgttttctctaatccaacatgttcatttgggctttgcgttacttgaccctgtggagatccccacagccatatgggcatcctaggtgaattcggccttggttgggctctgccagagactaatggactagagatgtgaaacagacctcttgccctgtacctttccttcccattaggacatcctttagattataagcatcctttagaaaagagctactgaaggtgtatgagcccatccttttattcatggactctaagagtcagcttttctagtgcatatcctattgccagcataaggactgaggagggggaaagggtcttaatctctatgtacagcagagacgattaaacttgctgtgtccgggctgcatcatcttcctggactgtctcgtgtttgtcctctgtgttcccattgtatcctgcaacttttaaggctactgtcttgcttaaatagctatatgaacagcaaatttgggataccagtttgatcacgtgttcacaagtcagcggtgcaaattcctttcatccttttactagttaagatctttgcaatcttcaggtctgattggtgaacgtacggcgcaccaacagaacccattgacatcgctacatttctttgaagaaccttcagggtggtctactaacactaggtccttttaccctgtaggtccttctataaaccctaaagaccaggagttacttaggagcagagaccgaataggaactagttgttctggttcccggtatctccttgcggactgggtacctttaactcatttggcactcttcaagctatctaactagtaccctattaacttagcagggaatcagcttgattgttaacaaccgacgattctgggactttcatcacctgccctatgtaccgacacgagacctgttgcgacatcttcactttttctccaactcgccccc

SEQ ID NO: 625171 - DNA, 103 bp, Homo sapiens
gaatggtagatcctcaagcccaggtggttcatcccctactcaactcattaacatcacctactttttagagccttgctttccctctctctctcatctcgtcttg

SEQ ID NO: 625172 - DNA, 442 bp, Homo sapiens
  misc_feature (2)..(2): n is a, c, g, or t
  misc_feature (15)..(15): n is a, c, g, or t
  misc_feature (17)..(17): n is a, c, g, or t
  misc_feature (34)..(34): n is a, c, g, or t
  misc_feature (167)..(167): n is a, c, g, or t
  misc_feature (342)..(342): n is a, c, g, or t
  misc_feature (346)..(346): n is a, c, g, or t
  misc_feature (350)..(350): n is a, c, g, or t
  misc_feature (356)..(356): n is a, c, g, or t
  misc_feature (358)..(358): n is a, c, g, or t
  misc_feature (374)..(374): n is a, c, g, or t
  misc_feature (384)..(384): n is a, c, g, or t
  misc_feature (417)..(417): n is a, c, g, or t
cngggctgcagggantntggcacgagcatgatancttcaccaattagttaataaagatgtatatactccacttttgattacaatcagtgattatttctatttatttaatattttttttgcctctctatggtgcatacaggttcttagttccctgaccagggattgantacatgacccctgtagtggaagtgcagagtcttaaccactggaccaccaaggaagtcccaagtcagtgactatttctaaaggaaggcaagacatgagaaggaaaagaaatagaggaatctgaggaggaaaaatcacaaggagacacagaactcatgggtctggaatatgcatgcntgtntgtntgtgtntngggggggtgtgtgganttaggaaaangggtaccgtacaaaaaaaacaaaatatcctttncaagtggcctttttcttgggtacca

SEQ ID NO: 625173 - DNA, 441 bp, Homo sapiens
  misc_feature (25)..(25): n is a, c, g, or t
  misc_feature (312)..(312): n is a, c, g, or t
  misc_feature (359)..(359): n is a, c, g, or t
tggtggctcacacttgcaatcccancactttgggaggccaaggcggtgaatcacctgggatcgggagttcaagaccagccttgccaacatgacaaaaccccatctctactaaaaatgcaaaaattagctgagcatggtggtgcatgcctgtaatcccagctactcggaaggctgaggcaggagaatcgcttgaacccaggaggcggaggttgtagtgagtcgagatcgcgccattgcaccccagcctaggcaagactctgtctcaaaaaaaaaaaaaaaaaaaaaaaaataggtattctggctgggtgcagngtgtcacgcctgtaatctcaacagtttagggccaggcacagtggctnatgcctgtgatcccagcactttgggaggccgaggtgggcagatcacgaggtcaagagattgagaccatcctggctaacacgg

SEQ ID NO: 625174 - DNA, 206 bp, Homo sapiens
gtggatttctcatgctaggtgggaggtggctggatcatggaggtggatttctcatgcatcaggtttagcacctccccttggtgctgttctcttgacagtgagttctcgcaagatctcgttttttaaaagtgtgcggcacctcctcccttcgctttctcttgcttctgctcccactatgtgagacacctcgcccccactttgccttc

SEQ ID NO: 625175 - DNA, 536 bp, Homo sapiens
  misc_feature (396)..(396): n is a, c, g, or t
  misc_feature (482)..(482): n is a, c, g, or t
  misc_feature (523)..(523): n is a, c, g, or t
ctggaaaaaaaagttaaaagtaaaaagtatatgagaggttgtgcataggttatttgcacatactatgccatttgacatcagggacttcaacacctgtggattttgatatctgcgggggtcctggaaccagtctgctggggctgccaaggaacaacgtgtaccttgttattctgctctacctacatcctttattttgtcacattggcattgaattgagatacatcagaagaacctgtggccttttctttcccatttatagcatgtaatattcacccagaaaagtgcagatcataaacatacactcctgaactttcacacaatgaacacacttccatgagcttcagtgccaaagaccggattctaaatctgccttaccactgtgtaacttaggttaancttggggcctccatttctcacctatcaaaggggagaaataatagccttcaaggtgttgtaaggagtgaaagattacactcattacnggcattttcttcctttcctcggatgcagagagctttggagnaccctgctgggat

SEQ ID NO: 625176 - DNA, 320 bp, Homo sapiens
  misc_feature (78)..(78): n is a, c, g, or t
gggaaacatctctaatgtcgatacaaatggggaacatttagaaagttatgaggctgagatctccactagaccatgccntgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttcctgtgcttccctgctgtaagccctgaaaatgtaaacctgttta

SEQ ID NO: 625177 - DNA, 366 bp, Homo sapiens
taacgcttctgctggcgctctaaacaggctgcagaagcacagcctactgcatgggtcaacctttcacctgtgtccttgacagccctgaacactgacagatccaccgccaagtggggccctctcgcgtatgtataaaaaggctctatctcagttcctgtgtggggcgcacaaaaaaacactctctatctcctgggcaactataaggtcctcagtttttttatccacacctctgagtccatctgttgagacaccacacaactggtttaactggtttctttccaatagctctcaatctttttacacgcaacttacacaagtgcattcctcttgattcatcaacttccacatggcccagggacttaaccg

SEQ ID NO: 625178 - DNA, 809 bp, Homo sapiens
gtgtcatatgtattgggcatcagcactgcgctgtcgtgaactgcatgtgatgtatacatcaatatagatgccaagtattatggggtatattatcctaccggaagattaggatgatatctggaactagctgatcacggaggatccttaactgtgatcctctttgctgaagaatataaaccccgcacagggacttcacacacgaagctaaggtcttgcgaagctcgtgtctcaggagtcaacccatgctcgtatccttaattgctccaaagcgagattgctcctattcccagatgtgcgttggtgactctcttcttctaatgctctgtataaagtaattatagctagctcttaacatctggagcgtgaagttgtctggaaaatgcttctctggccttggaggcccactaccgtcctttcctatttttacatcaatgcttgtattgttagacatttgttaagaagttctgaagtgatccacgggatattgacctaaaggaagtggatagctagtctagtgaaggtactcagggtctaaggaatacctaccgacgtgtgctctcctgacctgctggaatacgagaagctgcgcttttcctacacattaccattgcttcttgcactatgaggcggaaaatccggacaacctctaatacatctatgcgtaaagtcactccaagtggagcccggggcttgtgagagctgagttcggccggaactttcgatccctagacccatggctgatcattgtggcgctttaaatagtgaagctgattaaccaaggtcgtggtatacttagatgtgtgtgtctg

SEQ ID NO: 625179 - DNA, 220 bp, Homo sapiens
tgcagttagtacgcgtgccgcgctcagggcaaccagatcgtcgaacgttgccgaattcttctcgtgcggcaggaacgaccgtgacgcatatgaccctcggtatgcgtcgtcgcgaagatatcggcaaattcctccccgtccacctcgagaagggcattctgaagaacgacccgttccagatcctcgaccgcacggtgtgggacactctgatccgcgaggc

SEQ ID NO: 625180 - DNA, 320 bp, Homo sapiens
cagaacacaagatgttctggtcctgactttcccctgaataaaatctgcactaactaacaccgaggcatagccaaacctcacctccagatcaaattggctgaaataggcagggttccaatttgtgatggtcatttatttttaatggcctttctattccctgaaatgtagacaaatttgccctttgctgcctcattgcagtggaagagcctcatacctgtgtgcagagctgatgatgaaaggcatctatgtgtgtatgtgtgttgtagataaatagtgtattaactatgtgtaattccttatttcaaagtagcattttatgg

SEQ ID NO: 625181 - DNA, 783 bp, Homo sapiens
agcgggcttctgttcgccggctcgtgccgagactagaagacgctgcgggaagcagggtactgtggagagggcgctgggctcgttgggctacccatatgcgtggactatctgccgtccgtcgtagttcgctagcgaatatgctggtagctccagaatcagctaaagcggaggtctccagcaccactgtttgtgctggatcgcagcgctgtctttccttaatgaagaacgaacacaaacttggattctcactggtcatttactcttcaggctgctcctatttaatcctctcgctccaaactgaagggatctgcaggaagtcgtgtgactactagatgtcaacagagcgtcactaaatatggtggcgaatcttccgtgcctgtactacagtgatataccctcaaatatgtccctggggatggatgtttggccaaggtcattgttggataaagcggagatgtgtatgtacaagtatgtcgagaccaggcttgattgatcttctggagaatgctgttcgcgatattatctgataggcttgatgtaataattcgcagtcatagacaaacttgttgaagtattactgggatagaactatgtgggagctggcggtgaataggattaattgccatcttggagattcgtgaaaactattctttgcatagaagctgctagagtctcaggtctactgtagttcctgaaagatatgtcttgagtaatttctaattagatccctttgagggggtcagggaactttgtaggtggctggtgaggtagtgagagggtggg

SEQ ID NO: 625182 - DNA, 656 bp, Homo sapiens
gtgagcgatgcagggcgtcacccctctggtacagggcgcgtctactatccccgtctctccctttcctctcctccatgacctcacgacatcccttacgctctcattctaaggggggagtgctaaagcggggagagatgttcacaagtagagagatgacgagtgatagtatatcatgcacagtttctaaatctattgatagttcatctggacttacccaaaatcactctgcagccctgccacgaggctagtaggctgcaacctggtccccaccctaacctcttgctccccctcaagccaatctatgcagcccagcaagaaggccctgcgggcccccccattgcccagcactgtctcatagaaggctctggtggtacctctgggcgcgaggagcatcagccccttgatcatatggggtctgtcatcaccatattttctgccgctgctgtatccgcaagccatgcccttctgaccatctgtatgggacgaaggaaatacaaaggatctaaaatctggggttcgggggaaggtatgtcagcactctcacaccagcatcctcattgcccacacaccctttactccccagcccagagagacgctgcttttaccaggaaagagctattgaaagatgtttatctatttttcatttacctttccat

SEQ ID NO: 625183 - DNA, 261 bp, Homo sapiens
gtggatcaggcaactgcagttcgacttccaggatgagaaataactgtaactggtcatggagtattacgtggggggggaaccatgttgacacatgatgagcatagtttggggagcggattcgtggacgagatggcgcgctgctacctggcggagatggtcatgggcatagactcggtgcaccggtttgtcttgcggtgcgacaagaggacgtcaaatgccgacaacatcctgcttgaaccgctgtaggcacatccgtcatgg

SEQ ID NO: 625184 - DNA, 242 bp, Homo sapiens
caatgtagcacattcacagctgcaggaggctccgcatacatgccatatgaaggaagcctcgatcacggcgacacaggctggtataatcactaggattgggcagcgatggcactaggaggttcatgcccgtgctcagctaagagcgttcaccacggaaggagagcttatgcagcaggttggatggcgcaggcccccatggctgcatggcacagatcactgaggaccaggccgggtgggcgcca

SEQ ID NO: 625185 - DNA, 190 bp, Homo sapiens
gaggatccccggtgcaagagcagtgagagatgcacggaagacagaagtcaaagcaaatgctgagaagacttcgggcagcaacgtaaaaatggtgaaagtaacgaaggactaatctacccggactaaagctggaaaggctacatttccaaggatgaagagtgtgtgggcacagtgtcatggcagggagtac

SEQ ID NO: 625186 - DNA, 1171 bp, Homo sapiens
  misc_feature (1171)..(1171): n is a, c, g, or t
agctttgtacacatgcacaggggtcactgacctaaaaagaacgaggagcgtgtagcccacagcagcctacggatgtgctcactcacagtgggtgggggtgctgcccttgactggccttggcttgtggtgggaggtccagccagtgccttttacactgcaggagtgtaatacagttttaggcataactgcccgctctgactccagatccaggccttaccctggctgtaggtctgcctctgatgggagaagcagcttctttctgctgctgccgccccaacgtgagcctctcatggagagttggtagagacagcccaccttggctcttgtcagcagggctgggcctgcacctggctctttggggagaacctatcttttgggtgtatggttagttagttgtttgtttctgagaaataacaacttgagatttaagatcaaggtgaactaaacccttagtgcctgccctgatcacctccttgcctcacacggcctgaggcctctgcttcagcccgcacagtagagcctccctctccctgtgctgtggtggttctcattcgtggaatcctcaccttcaccttctcattttcaagtatcaaaagacctggcccccactttttcaaggccagcacaagtgccaggcccttcttacaggtcttccctgatcagctttccagaaataatttcttggagctttctgttctggccggggtggggaccgggccgttggtgccgggattcccggtaacgggatcctgggatattccccgtgtgtgtttgtgaccacagcaaggtgggccaacgtgcagtaaggccacggggggaataaactgcggaccgcgggaacacaatgtgacaagggtgattgtcgtcgtaaaacatctgtatccgaagggacataaggcacggcaaataaggcgcacatgccctccgcatgcaaaaggccccaaggagccggcagacgtataaaaaacgcggagcgaggctgcgaacaccacgcgctccttcttacctcaagaagacagcacagaacgacagacgatagaggaagccagacaactaagcgacgacgtcacacgatgcctcacagacactactacgagcacaggaggcaagacgacacattaagatcggagagatcactacgacaataagataatatagaggagggttgtgn

SEQ ID NO: 625187 - DNA, 418 bp, Homo sapiens
tcggtaccagtgctactccacaaacaggttcaaacgattctcctgctcgcctccagagtggctgggattacaggcaggcaccaccacacccggctaattttgtttttttagtagaggtggggtttcactacgtattggacagggtggtctggaactcctgacctcaggtgatccacccaccttggcctcccaaagttctgggattacaggcgtgagctaccgcgcccgagtaagtatcatggaagatctagcatatatctgaactagtagataccatcaataggctgagagacttcatgggaggtaaatattcagtaaacaggtgagaaaagaaatacaaatggagcttgcgttagattatatttctaattgctatgtgtaacttgggaagtgcggaacggtatgtggaggtagcact

SEQ ID NO: 625188 - DNA, 351 bp, Homo sapiens
  misc_feature (247)..(247): n is a, c, g, or t
  misc_feature (274)..(274): n is a, c, g, or t
gctctttctttacctggattctcatgtgctagaacataaagacacgtgtcatttttggtgaatgatgacaagttcagcttggatatcatcagagtgtcagcaggaaatagttggtctacttaaaaagggtgatcgaaaccttaaaaatagttaaaatggtcatgttatgtatattttaccttaattttcttaaagaacataggctctattccaccttttagggaagggcatagctctctatttcttntcttcttttttgtagagacagggtctnacttgttgtccaggagtttgaaaccagcctggcaacataagcaagaatctgtttatctacaaaaaataaaataatta

SEQ ID NO: 625189 - DNA, 179 bp, Homo sapiens
  misc_feature (7)..(7): n is a, c, g, or t
  misc_feature (20)..(20): n is a, c, g, or t
  misc_feature (99)..(99): n is a, c, g, or t
  misc_feature (142)..(142): n is a, c, g, or t
acttgcncctgaccgtcaanatggatctctctcgccacggcaccgtcagctcctttgtggccaagcttttcatctttgtgtctgcagagctctgagcanctcttccgtcgcggggtctccctcctgttgctttcctaaaccnctgctccggggcgttaataaagtcttagcaagcgtcc

SEQ ID NO: 625190 - DNA, 375 bp, Homo sapiens
gttgcctccaagcagtttgtgaaagtatcagatcttgggatcctggggattgattcacctaatataaatatatttctgtcatgaacctcttattccgttgctgggggtgtaatcttcatcatctagggaaacgtgtgtctgtgtgctatatctttttccaagcagtaccccttgagtgtccatattttttgggtcatgagtgagctcatagagcgcgcaggtgtatacatatctctgtgtgtgtccacagaagtgttgcagagccacccctcttcatccagagtctgtactcttctacatatataaaggggctctcatctcccccacgggcctcttcgtcgtcatgagaggaactcttccacaacagagaccaca

SEQ ID NO: 625191 - DNA, 188 bp, Homo sapiens
ctgcaggaattcggcctactgaggagacacattcgtattactcgcattcaagggaaggtatcaatccacccttggagcttcagccaatgagtttaattaaggaaaaaccaaccgaaaaccaaataatttcaagccatcctgcttattacacaatttttatcgtggggtttattactctctctacaagg

SEQ ID NO: 625192 - DNA, 389 bp, Homo sapiens
ggataccattactacctttatagtattttgtattaaattagcatatgatatttatgttttctctatatacatgtgtatgtgcacgcatcatccactactatcatgttgtcctctaactccgaaagctcatatttcagatgcctggcgttataaatgtcaactctaaatctatgataaggtcagtaaaggggtaaaattaaaattgtgaaaacggtgttgcccaaacaatgaaaaaggggagctctaacctgccctttactctcttccttcagggtaatttctgtttcaatttcaattcaagaatattacatgtagtaatgaatgtattccatggtaacaaagtttaccttttcttctccttcatctttcagctagactttggtcaagat

SEQ ID NO: 625193 - DNA, 115 bp, Homo sapiens
ggcaaggttgattgtacacagcactatgaactctgctcggatacaggttcgtggctatcccactcttcctctgggttccgagatgggaaaaaggtggatcagtacaaggggaagc

SEQ ID NO: 625194 - DNA, 662 bp, Homo sapiens
  misc_feature (164)..(164): n is a, c, g, or t
ccacgcgtcgcccacgcgttcgggaaggtggtggctggagaggttgtggtgctagttctctctaagtccatccagctgccatcctcgtcgctgcagactgacatgacgctcatcgaccgtctgcgcagtggactcgtcgcaaggatgacccattcggttggcgnacctacatcacaaaggggagtcccgactaaaactgagctgcgggtaaatccccaagatcgcttgacttactcctcgcgagttctccggagactatgatccatctactcgctcgtcgtcagaagattaacgcagcgagtctagtcgactgctggataatcgtggaactcacgcaggcattgaggtagccaacatcgtaggtgcgatacttctcaccaagcctgtttgcttctggtcggcgtggttccatcttctcctacctttctaggtactagggtcgcactggtgggtccacttccttcccatgcgacgtactgggggcgcgaagttctgtgtatgcccccccttccgttccggacggtgatccctttccgccgttgggcagcgttgcccatttttcggggggcaaaaaaccccccgggcccggtttgggcccccgcgggggcccccacatttttccccttttgggcgggggcgaaaacgtttccctttggcctaag

SEQ ID NO: 625195 - DNA, 559 bp, Homo sapiens
  misc_feature (20)..(20): n is a, c, g, or t
ttttctttttttttcccccnaaaaataaagcacaaaaattggggttttttttccctcagggcccggggaaaaaaggggatccttccttattaaaaatttaacccagctttcctattggccttccccccaaaggtgcaggcacaaggggggggggctatttgcctggagggaagattttgcccattgggcaaaaaaactccctttaaaaaggggggtttgccccttgctttggggggtcgcccttgggctcccaggaccctagggggccagggggttctttttttatttcccctattcgcgaagaccggagggggaaaaacacgggggccttttattagggggaacattcccagggggtgacaggtgacaggaggggaaaattttttttcccgggggccccaccaaacttcatgatttgaaacggggcctttggcccggtttttcgtgggtaaccgggttaggacaaatttttataattttttttggaacaagggggaacccggggccccccggggaaaaaaaaatatttttgaccccctcccccctcccccctggggtg

SEQ ID NO: 625196 - DNA, 288 bp, Homo sapiens
ggtgttgattccactgggttttgatcaatacaataacaaaccttgttcctttgacatactctgaattttgttgcttggggggagggggtgtgtgtgtgtgtgtgtgtgtgtgtgtatgtgtgtgtgtgtgtgcgcacgcgcagtgtctatcagtatcagtgcctgtctgagataggaaaattacattcctgtctctgtattgaggagaagggtgtatagcgcaacatgacacattcgctctccttatattatagagactagtgttttttgttcttaacactggatcag

SEQ ID NO: 625197 - DNA, 180 bp, Homo sapiens
gttttcccccccctttgagtagttggaggtcacaaacacagttttttttttattgccctttttggcctttgaatgttcattttttgtcctcctttgggcaggggaggaaggggggccctcaggggccgacactagtatgatgcagtgtccagtgtgaacagcagaaattaaacatgttgc

SEQ ID NO: 625198 - DNA, 721 bp, Homo sapiens
ggggaatggcgaacaagcggtcgcgctgtactcgagggagttccgggtcgggggtgggtagctccgggtccagcgctggcgttggtcgcagagcagggcacggaggtggcatctgcgtgtgagggcctctattccccgcagccccgggtctgcgaactgcctctctggcacggatggaaaggcgcctccctggacctcggtcttcagccttgggccacttctaccgagggtgacaggagcccgaggggacgaaccctgtgggccttgactgtgtggccttgagccagtgcctgcctattttaggccttgggaaacgactggacgtgacagtgccctgcagactggttggaggtctcaggcaggccacacactgaatctgtccaagggtgtcaacctgttcgaaaatgctcgtcctcggtgctgtaaaagaaactagaacttaaaccttaacatttaattatatagtaaggccattttacttcctgcagaaagggtacactcgccagcagttttgccaggagagtacactgaacaaaggagacaggtcatttataacgtggctgcgtcaaccctaactgcttgtgatcggtttcctttgggtggacggggacctcacaattctgtatatgtccgagtgattagcacatagaacttttttaaaagaggcaaaggcagaggagaacaaaggaagaaggaaagtacttggtggaatgctgaggaa

SEQ ID NO: 625199 - DNA, 180 bp, Homo sapiens
ccccgaacgatggcccatggccaagagcccactcgtagggcgtttcctcctccagaggcctgcacgcggggtgcggacacaaaaggctctccatcgaaggcaacattgctgtgggacagtccacgtatgtgaagttactcaggaaaattaacccagattggcacgtagctacagaacctg

SEQ ID NO: 625200 - DNA, 968 bp, Homo sapiens
gtgactttttgaactgtttattatatggtggatgatgattttcatctcacgtgctggacgctgtactgtatcagtgtgctctttggactacattagtcccctgtgggagcagcagggctggagatctactgcagtcccttcccacgacccgacacctgccagaaggccaaggaggcacgtggaggtgtctccttcctgacaattctatccctctccagaagctcagggagggcttgcccagcacctgtgctcacagaccgtcccaggatgttagtgtgaggccacatgatgcgtctgttgttgaccctctgaagtgggccatggactagtgtgaggcccaccatgtgcttccaattgcacgtatcatatgtgaagaaggtgttgagacagacaacagcacattttccacattgttgatataatagtgcaaccatgtggacagttgaggcaatcttcagtcattgcccaagtagagtcaaagagtaccttcaaggaatctggtggactgaggaacggccggagcaagacatgaacaggtgtgaggcgttggttgcttatgagtacaacccaggacattggcacaaattgcccgcgattaaggagaattggcaggcccattacggccattgggatcattggatgtccaaaaacaggacatagatttagtgctactggacgctatggaaaccgggggggaccagtggaaaagaagcaccatcaaagactaagaccgtccccctttatgtaatacgtcacttggatgagcgcttagtagggtcgagacagaggagggagagagcgatggcggagaaagacgaccccgccaaaggcagaaaacaaaaagagggcaaggaaagaaacgcccaaagagataggagcctaaagagaagacgacagagagcacgatagcaatcatagacacccagtggtagaatggcaacaagaatagtaaccacagagccacaggg

SEQ ID NO: 625201 - DNA, 201 bp, Homo sapiens
atagagatcagcgtacgtcctattatctgttcgtgtataggttatcattctgtactcgaggttcagtaagcataagtccatagcttgggtcccttggtataaacggttgttgatgagatatatggaggtggggatcaatagagggggaaatagaatgatcagtactagcggcgggtaggcctaatttctctcggaccaatg

SEQ ID NO: 625202 - DNA, 129 bp, Homo sapiens
cgggacataaccacaaagtaattcctggtcagcaccagcgatgtccaaaggtgcaatatcaaggaagggcaggcgtgatggcttatttgttttgtattacaatagattgtaccttccgccatatcatta

SEQ ID NO: 625203 - DNA, 873 bp, Homo sapiens
  misc_feature (24)..(24): n is a, c, g, or t
  misc_feature (93)..(93): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (112)..(112): n is a, c, g, or t
  misc_feature (127)..(127): n is a, c, g, or t
  misc_feature (152)..(152): n is a, c, g, or t
  misc_feature (157)..(157): n is a, c, g, or t
  misc_feature (167)..(167): n is a, c, g, or t
  misc_feature (169)..(169): n is a, c, g, or t
  misc_feature (203)..(203): n is a, c, g, or t
  misc_feature (224)..(224): n is a, c, g, or t
  misc_feature (226)..(226): n is a, c, g, or t
  misc_feature (228)..(228): n is a, c, g, or t
  misc_feature (233)..(233): n is a, c, g, or t
  misc_feature (249)..(249): n is a, c, g, or t
  misc_feature (283)..(283): n is a, c, g, or t
  misc_feature (288)..(288): n is a, c, g, or t
  misc_feature (293)..(293): n is a, c, g, or t
  misc_feature (297)..(297): n is a, c, g, or t
  misc_feature (313)..(313): n is a, c, g, or t
  misc_feature (318)..(318): n is a, c, g, or t
  misc_feature (322)..(323): n is a, c, g, or t
  misc_feature (325)..(325): n is a, c, g, or t
  misc_feature (345)..(346): n is a, c, g, or t
  misc_feature (348)..(348): n is a, c, g, or t
  misc_feature (364)..(364): n is a, c, g, or t
  misc_feature (366)..(366): n is a, c, g, or t
  misc_feature (371)..(371): n is a, c, g, or t
  misc_feature (378)..(380): n is a, c, g, or t
  misc_feature (382)..(382): n is a, c, g, or t
  misc_feature (406)..(406): n is a, c, g, or t
  misc_feature (422)..(422): n is a, c, g, or t
  misc_feature (440)..(440): n is a, c, g, or t
  misc_feature (443)..(443): n is a, c, g, or t
  misc_feature (450)..(450): n is a, c, g, or t
  misc_feature (463)..(463): n is a, c, g, or t
  misc_feature (468)..(469): n is a, c, g, or t
  misc_feature (473)..(473): n is a, c, g, or t
  misc_feature (476)..(476): n is a, c, g, or t
  misc_feature (656)..(656): n is a, c, g, or t
  misc_feature (737)..(737): n is a, c, g, or t
  misc_feature (869)..(869): n is a, c, g, or t
aaaaaaaaaaacccaaagccaaanacaataaatacacacaacaaagggtgatgggcaaaaacgtcatggggatattgtgatataaaaatccanatgctcagaaacncnanangtcacgtgaccagcntccacaaaaattaaactgcaagaanatganttaaacccananatttaaaaaaaaagatttaagaaacacatcagcnaattatatatggacctatggnantnctganccaaacaaaaaaatanatagtaaataaaacaaaaatatttataagactgnaaganataanaaanactcattgaataacgnatganttanngnatgattatcaattattttanngnctgataatggtattangnttatntttttgnnngngtccttctctttccaggataatanaatatttatgggtganatgatatgatgtccagantcngcttcanaataatagggggnggggnngggngtnacagagttacaactggctgtgagctgataatggtgatgagcgtgatgagcgtattgggctgaaatatcaatccatctacttttgtatgtctacaatttcctataatgagatggtacactgtaaacagcgcaatgcatcgctgcctattcaaacaaaaaagcagttgaagtctcagcctgnatgtcacccatacctgtgctaatcttggatttgttctccacagtggtcatggcaggggcagatgccgaagtgctgcagatnggcaggagctttccttccctttaacaccattagtcaccgttacccctctggccattccagctaaaaggtcatcactgctcttggtcttcatatttactcttccactgttctttattccttcttgaaattttnttcc

SEQ ID NO: 625204 - DNA, 520 bp, Homo sapiens
ctcctaaagtgttgggattacaggagtgagctaccacacctggctgtctctttaaactttgtatagaatcgttcaatcgttcaatttggattgttttgagtctatcttatatcttatgttaaatgaagctgtaatttattctttgttattaccatgaagtattcctctgtattctgtaccacaaacttctgttctactttcatattatttccaattttgagaatactgcaaatcatgctgccaagcacagtggctcatgcctacaatcccagcactttgggatgctgaggtgggaagattgcttgaggccaggagtttgaaaccagcctaggaaacatagtgagaccctatctttacaaaaactaaaaatattagccatgtgtggtggtgcgcacctgtggtcccagctgcttgagaggctgaggtggaaggatggcttgagctcaggagattcaggttgcagtgagccatgatcacatcatcacactccagtctgggcagcagagtcagacactgtctc

SEQ ID NO: 625205 - DNA, 791 bp, Homo sapiens
cgacgctgaacggtgaggtgagcgcgtcgctctcttcgactttctgttggacgtgtcctgccagatgccatggaacgatcccaccgagcattatgaccgagctcatgactcgtcacctggtttactgcgtgtgttctacggatttttggctggaattttgacaggattccttggatgaggcctcctgtaggtgttgtcgcctgatatgggcgttgtccctgacgccggtatcccaggagcattttgtccaatcagacgactttgactatctgaaaacgctcggtgcttgtactccccgtggctcgatcgtcttgtggcgtacgaggctggtcgcttcctaggcccgccgcgcttgctatgcgccgtcttggctttgcgtgcttgtctcggcgtggcgtggtcttcagtcgtagttgatgtgtgtagtcttctttcatggtagtttaccgtacgtgagaagcggcatacaacgcattgagtcttgaacagcatagaatcatctaccatctgaaaatcgcgagtcgtctgagtcacttggtttgcatcgcctcacgtgtcttgtcacgaagcatcgtgcgaagtattccccgagctaagtaaacgtcgcctggggtagtcagtcgacgagggttgtcagacagaaaaaaaaataaaaaaaaaaaaagggggcgcggcacggcactagggagaagggttcccccaagaggggtgccccctcgtgattggcgccgcaaccccttttttttttgccacacatttttgttccccaaaagggggggccccgaataaaa

SEQ ID NO: 625206 - DNA, 934 bp, Homo sapiens
atggcacatgcatgcgcaagtaggtctacaagacgctacttccccatatcatagaagagcttatcacctttcatgaatcacgcccttcataatcattttccttatctgcttcctatctcctgtatgcccttttcctaagcactcactaagcaaaacgtaacttaatactacacatctcagacgctcgaggcacatagaaagccgtcgtgaactatcctgtcgcgtccagtcatccgtagttcctcatcgaccctaccatccctacgcatcctttacataatcagacgtaggtcaactgatcgccgtcccttaccatcaatttcaatgttggccacctaattggtgactgaagcctacgagtacacgcgactactggcggacttaatcgttcaactcgcatacatcacttcgcgcccgattattgcctagaaccgaggcgatcgtgcgactccgttgacagttgacgaatcgagtagtgactcccgattgaatgcccccattcggctaataattacatctcaagaggtcttgcgctcatgagctgtccccacatgaggcttgaaatgagatgcaagttcccggacgtctataccaaatcactttcacgcggtagactgaccgggggttatactagcggccgatgctcctgaatgtctgtgggagcagaccacagtattcatgcccatccgtcctagaattaattccccttaaaattcttcgagatagggccgtgatttgccctatagcaccccctctagcccgctcgtagaaggctctaggaaaggctcaccaaagtctgcccagaaaagctttgaagggctacttggctctgatacgttcttcctgccaccccattgtgagtgcggcgcgatgaccgtccacagcgaagtgacctggagcatccgttcgacaaggacggtccccaaaaaaatcg

SEQ ID NO: 625207 - DNA, 107 bp, Homo sapiens
ctgtgggttgccaatgcttagtgagtgacactagcagcctggtccggctccgttgcacatggcaggtgtgatggcccccacgcagtctttggcagtataacgcagta

SEQ ID NO: 625208 - DNA, 179 bp, Homo sapiens
atggacgccaacttcacagcgcgaggcctcgttagtctgcaagacagagagaagccggcaacacaaagcagtaaaccctactgggcgcctgttcttctttgcccgtcgctgtccttcaggcttgcttcctggttccttcccatctgcctcagaatgtgttcatccctatacctcccctc

SEQ ID NO: 625209 - DNA, 139 bp, Homo sapiens
cacgacacgggcgactccccaggtctatggagcggggtaacagatggcggaggcgtgagagcctggagacagcggctgatcacgatcggatcctgcgacagatcgagagcactgacacggcctgcatcgggcccacgct

SEQ ID NO: 625210 - DNA, 336 bp, Homo sapiens
aaagaaggtcttgctttgtcgccagccaggctggagtgtaatggcgtaatcatagcagctcaccacagtctcaaactcctaggctcaagtgatcctcctgccttagcctgctaagtagctacgactataggcatgtgccattacgcctggctcgtggcttcctttttttttatgtttttctggaaaaaacagggttttactctgttgccagaatgttctcaaactcctggccttaagtaacccttttggttcaacctcccaaaagtgctgggattacaggtgtgtgccacatgtacggtcatgaaaattattttctatctttcagaatcatagttt

SEQ ID NO: 625211 - DNA, 229 bp, Homo sapiens
ccacattcacagcttagtaacttcctgactctaactgacttgaccctgagcatccttatcatacaaaccctagtactataaagatacaaggtaaaatcacacaacaataacttatgatcaacggcacgagcttccaatgactagcttactgactaaagcagccactccaacaacctggactacttcttagccagcctaacacttcccctagactcactcactggccctt

SEQ ID NO: 625212 - DNA, 667 bp, Homo sapiens
  misc_feature (149)..(149): n is a, c, g, or t
tggaaattcaaagtttggcttaattaggcgtctgtgaaaacaaaagattttgcagacccagtcccgtctggtggtgacctgctgcaaagttctgtgaagttggaattcatcttgtagtgatttggagacccccagtagctgattatttnagaatacgggcccatttttcaagcagaatgagaggtgtgcgctattatggcccaacaactttttataattagccatccactcaagccgttcccccagctatactattttcgcaggttaaaatccacagtcttatactattctctcacatattgtggacccctcagcgcctctgggctctatggccactattgcaacatggtcgctgtctgtgtcctaatatatagctctggggatcctagagtcctaatagggaggcctggtatgagtacattatatcaaaccctcatttcctcttatgcaggtagataacactgcaggggggtaacaactcaagaagaaaaaaacctcctcgaggacactccaagggacaccataatctccctggtgggagggttaactcccattactgtgaagccttctcccgtgtttctctccacatttccgtgccgtggcttttcacctcctttccccggtcctctgcccagccctttttccttcccacccaaatcctcctttg

SEQ ID NO: 625213 - DNA, 161 bp, Homo sapiens
acagaaactaggaattcttaatggaaatattctaggctcacactgattgatagcttgtttaaattcgagtatttaaaaggaaaaggcccaaatgtagctataatatttccctgttgatctggggggtgtatcctaacagggaactgccaagccacggtcaa

SEQ ID NO: 625214 - DNA, 382 bp, Homo sapiens
agttcgacgagactctccaacacttcccctcctttccgttcccagagtctgttttgatcgaactgtttcgcctccactcttttgtatttcatgtggggattgctaccttggcagcatggctgcctctgtcagtggaaaggaagtggtggatagtaaaggccgtatgtgtaccatatgttaccagggcttagctgtgtccctgttggtagtgtgtgtgtgtcaaagagacgagagagaccactgaagaacatttgggtgtacttatttccctgtccctagaattgatacctatttctagaatacagtagagaaatgttgccattatacagatcaggataaagagacgccaatttccgtgcagttagagagtctccgtcgaact

SEQ ID NO: 625215 - DNA, 526 bp, Homo sapiens
gggaaccattcaccatttattgtaccaaaaagggggtagggacaggacccctaggactggccaaggggggttctaaaggccaactggggttggaaaacaatggtctggacacttcactggcggcaggctgtgttccaagttccacgaaatagctcaaaaagttaaccagttccgttccaaccttcttgaccagggggggcaactgctcctttgacttttcaaagaaaaacttggcctcggcctgaagctctgggttcttgaccttttccataaaggccttgccaaaaccaagcccggcctggaagtcccgaaaaaccaggctctccacacatggctcccttgcctgtctccaaaccaaacttcttcaaagctgcaaaaggtgaaggataacaaaattttctcgagcaacttcatgttggaaaacaaggggaaggaggcctcaccccgcgctctgtccctggggtccgggcctcccccccccaaatgcccccattcccgggtaccaacacaaaggccccctctccca

SEQ ID NO: 625216 - DNA, 487 bp, Homo sapiens
taataataggcatgctcagtgatattcagattcagaatatctagccactaccttctggttcacactaagttccctcatactggctggagtagtgaccatttgctatactctatttaaatctaaggaggctgtagtaaaagcaattgtaagattcttgaaggcgaaattttgaaaaacagtgaatacttctaagttgcttgtccttttattgcgagaactacaggacattgtgtccgcacttgttagatacacttaaccttgaaactgtcagactggcccggcgtttacaacagctctttgtgcatactactaggtcttacagaacccgtctgtaaatgacattacaagatgcaaatttaatatctagttcacagctagattacatcactgattaaagctgccttcaaaatactctttaacttcttttagctaaactggttgtctttcatttgccatagaattccaaacaatactgtcttataaaata

SEQ ID NO: 625217 - DNA, 1052 bp, Homo sapiens
  misc_feature (1)..(1): n is a, c, g, or t
  misc_feature (435)..(435): n is a, c, g, or t
ncgagtcgttgcgggagaattgttgtgtggtgccgccccacgagcttgtcggttggctatgcttctgggtgttggcaccctctcgcgtcggccatttattttcgaacgtgtctgtgtctgtgctgcaggaatgattgttccgtcggcgtctctctccccccgctctggtggtgcgtgtgtcgtctccgcgggcacccctctggagaccactagtgtccccgtggtgtcagactttccgtgcgtatcttcgtcggtttctttgccacccgtgcggagcgtgactctgttgactcccagcgggttgccctcagacaaattccccggcgtgccactcactgcgtggtctgagcgataggaagatgtggcgccgcgtcgctcctctggtgaaggcgccgcaccagttgtgttccaggctagtttttgttgttgacaggnccccccaagcgcgcacaaattgttgttaatggtgtgtttaggaacccacgcccaggcgcttgcaaccctgctttcatgcgggcgattactttgtcgcacacaaatgtatgctctgcctgtcagtacatcgcactggttgtgttaattcgcgtctgtttggtatatgccgccgctatgtttcgagcctcacgctgtcgtttggcacgagagtctgtctcgagagcacgagggccactgctttcatagcgaacataagcaatgtgtgtcagtgggagaatttatctcgcacacaaagacacagagagacaaacaatagtgggtgttgttgtggaatattgtcaggcaaagtcactattttgttttagcgcgtccacgctgggaaggctccgcgagttcgcggcaaacacagaatgtatcattttgtctgggctcttctcgtttgaaagtgacacccccacgactctcccctctgtcgtaacgccgcaatagtcctttcggctcttttgttcggaggcgcaattcgcggcgacgtttttatctccacatcattgacccaccgtctggagtactcgcggaaaatttggggcaaaaaaaagtgtttggcgaaaaaaaaaaaa

SEQ ID NO: 625218 - DNA, 1305 bp, Homo sapiens
agcgggcagccgcggccccacagcttctggggctggggccccggcagccggtgcatggccggcctgtacctcgagctctctcggcacgtgccgtggctcccgacgcggatgtagttctcatgcccaggtcgaggttcgcacggaccctggtcgcagacagtcctcatccctcgcaccttcgtccctgtgcccccgagcgccaggtggcgggctgtcgctcggatggcaggtggcggggccctcgagggccggtcctagtggacgcgtcgagggcgtcccgcgcggaccgggggtcccgcgggccgcctctctggtcttgaagggcctgcctgcatgtcgagaccggcttgaacgcgtcgagactgcgatggcttgtctgcgacggaatcttgggatgggaagtcagcgctgtcgtgacctaggctgtcgcggttgcgggcccgattcgtacagcactttggcttccgtatgtctccgggccctgctctttgacaaagccctttacctatcgtggcgaatccctttgtgtcctcgccgtccctaggttgggaaacttcgccaccggactttcccttgaggaaacttgggcgcacgcccactaaaacttcccttattttctacccctctttggcctttgaggcgagcccatgccggccctccggttcccaaagccgaggttagtggtttaacctcgagcaggcattccggatggccattcgaattcattcacataatcgtggtgtactctcaatacgcggtcttccaacaccgcacatgtatgggccaacctcgattaatcttggcggaactctatttcaccacgtttttttttactttggttaggccaccctggggcgaatatccttttttcagtctgaattgtaataaacccacccaagctttccaaccgtttggggaaactcttggcccttaactgtgggcatttgggcggcggacaaatacccagaaggcggtccccaagcggaaacagcggaacaacctagaaggaacgcttttccttcattgttttatcccccgcgccgtttaatatacaggtggcggtggaacggccatttccattttcttggcagccaccgatttttggcggccctttggcttgtgaacatgtaatattccctttttgtcacaccaacctacagtgagtaccttcggatcatcttgggcggcccaaaagtgttggggggaagggccctttttccatgacttttggtccaccgtggccgttccggacccattttacggccggaaacctttttacacttcgcgtgtggaaacctttggggg

SEQ ID NO: 625219 - DNA, 125 bp, Homo sapiens
taagatatggtatacatcatatgtctctagaccaaatcttattacaagtgaggacaagatattctttaattaaaaacacattcattatgcaggctaccatactaaaagtgaactcccaagaacag

SEQ ID NO: 625220 - DNA, 348 bp, Homo sapiens
agcctggaatgtcacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacccttgtggcccaa

SEQ ID NO: 625221 - DNA, 438 bp, Homo sapiens
  misc_feature (17)..(17): n is a, c, g, or t
  misc_feature (48)..(48): n is a, c, g, or t
gttaccaaaggcttggnaaattggccagttaatttcttaataggaacnaagttctatttggatgatgaaaaagtttggaaatagatggtagtgttggttgtaccagccattatgaatgtaactgatacccactggattgtacacttaaaaatggttaaaatgggtcgggcgcagtacgcctgtaatcccagcactttgggaggccgaggtggacggatcacaaggtcaggagattgagaccatcctggctaatgtggtgaaaacccatctctactaaaaatacaaaaaattggccgggtgaggtggcaggcgcctgtagtcccagctgctcgggaggctgaggcaggagaatgatgtgaacctgggaggcagagcttgcagtgagccgagattgcgccactgcactccagcctgagcgacagagcgagactccatctc

SEQ ID NO: 625222 - DNA, 861 bp, Homo sapiens
gcgagccccgactgccacgggccgggagacgggcctgggagcggcggcggctggcccgagagctgcgccgggagagctgtgccgcgagcctccgcctcttttttggcaccgcacagtggatccctggaggcctgagctgccactgcctgccctgggtaccctggcagatcgctgaggtggaacgggcctgtcagctgcgggggacagcgttccgagtgcagttggtccatctcctgggatgccgtagggcatcagcatgacctgtgcccagacccagcgatgacttacaagggggcacttgactgggcaattcactggcaggcatccaggccattgtcccgacttcttgggacgttggggaaagaacatcgatctgcgctgaggcgaggaaactactgcgagaaccacagtcagggcacgatgcaggcagagacggatgttggaggcggagcccgttgctgattcccttgaatgcctgtcccataccggccttacggcgacccgaagggggcctcgacaccaagtcccattcatttgccccagacggttaccaaccatcagaagaaaccttgaaccctacggcaggcatgggaagcatggggtccggttgcgatgactgggcgccaaggctggccttgcccggacgcacacgctacgacacactggaaggtgacattgccactgagaccgccaattggggacaaccttaacggcatggagtgaccgagacattacttgccacacacttggcatggtcctcttgggggaatctaatttgaaaccgccggacccccggatgagacaccaggctggaccacgggacacaggacagattggcacacacgagaaacgaacaagcgc

SEQ ID NO: 625223 - DNA, 133 bp, Homo sapiens
  misc_feature (113)..(114): n is a, c, g, or t
gagtaccccaacttgaccagttcacggagcacttcaacaacatgtcctactgggtccggtccataatcatgttacatggaaaatggcccagtgactggggaactgtgctgctnncttgaatgttcatcaatga

SEQ ID NO: 625224 - DNA, 562 bp, Homo sapiens
  misc_feature (154)..(154): n is a, c, g, or t
  misc_feature (182)..(182): n is a, c, g, or t
  misc_feature (258)..(258): n is a, c, g, or t
  misc_feature (297)..(297): n is a, c, g, or t
  misc_feature (303)..(303): n is a, c, g, or t
  misc_feature (313)..(313): n is a, c, g, or t
  misc_feature (318)..(319): n is a, c, g, or t
  misc_feature (348)..(348): n is a, c, g, or t
  misc_feature (355)..(355): n is a, c, g, or t
  misc_feature (436)..(436): n is a, c, g, or t
ccctcaaagccacagacaggaaatagaaagtggaaaagtaatatctccttttcttttccataaggagtttcaacactgtaactttaaaaagtctatcatattccagcaatatttttttctttgttcctttatagttgtaagttcgtgtggaaanaactactatacggtaagaaatgttactngagataacaacaagctaggctaatacgtgcatgtagattgctctaggttttaaacgtgactagcctgtacttcacnatagttatatgctacagccctccagtatgttcgcattantctcanaactcagggnacccnncacaggacaggtagaacaccctttctganaactgangttggaacgtgaaacggggtggtgaatcgttttggccacagcctgtcgggagggacaagtattgtattgcggagcaccctntgggaccaggcaagagggatgcccaggttcacactctggaccccttagacattttcagtgggtaaggtggagggccactgccagaagctgctgcagtgccctctgggaagtgccacgcgccctcag

SEQ ID NO: 625225 - DNA, 517 bp, Homo sapiens
tcgaggggggcgccccgcaagtatgggtctccgggacttggaacgccccggctgggtggtgtctgggctgtctttccccgcttcttcccacctcggctggtcccgtttcctcctgcgcccagtgcggacctgtctcggctgccctgctgcccatcctcacctgctcccactgcagtgatccctggcctgtgtcacctgggcatgtgtgatgcttcccgacttgccgcgtgggacatgctgatggcacacacatgggcttgtggccctgctgcctggatgtgccacactggtcctgtgctgagttgctcctggtctcccgcctctcccatggcgaccctggaggtagcatttcccaggatggcacggtcccccccatgggggattgggcactatgccaactgcccatgaatgtggactgaaggaaaagaacccaaattgaaatactgccatgaggcggaaaaatttgggccccctttgaatgccctttcaaccctctggaagcaatggtggtgcctgg

SEQ ID NO: 625226 - DNA, 277 bp, Homo sapiens
cttgaacatggacccctatgccagcgttgcatctgtcgtcctcacctcccatatatgcatccagaggaagaatgatgcttgcatttgctgagtgcgtaaaacatcatctccaataattcccaggtcctagccaggtactgttatgtgtcccgtatgacagatgtggtgacgagctcacttgctgactaatagtagtggaaccaggatttgagtctgtgtgactctatatcctgacttcttaacacccgtgcatttaaaaaaaaaattttttttttta

SEQ ID NO: 625227 - DNA, 319 bp, Homo sapiens
tcactaagagtccataatcatgaaatgctagatgggtcgcgagggtggtggcacacacctgtaatcccaggagtttgggaggccgaggcatgcggatcacctgaggtcaacagttagaggccagcctggccaacatggtgaaaccttgtcactacaaaacatagaaaaattagctgggcatggtggtgcatgcctgtagtcgcagctactggggaggctgaggcatgagaatcgcttgaacctgggaggcggaggttgcagtgagccaagatcacgccacgacactctagcctaggggacagagcgagactccaatctc

SEQ ID NO: 625228 - DNA, 150 bp, Homo sapiens
tttgaccacccgtggaaactgttacacagctgcaatgcgaaataccaaacctatgaaccaagtgtggttggagtgatgtgttggcagcatatagatcctctggaagttgcacagccacagcttctcagcacagagtgggactgcttcatt

SEQ ID NO: 625229 - DNA, 327 bp, Homo sapiens
  misc_feature (275)..(275): n is a, c, g, or t
gctggcaaacagccctatgatgtcatccagctgataaaagtgagtgaagcccaagtacacaagggggcagagagcttccctctgtgactcacttttccacagtggatctgaacaacctaggccaagggaaagcactttgttttgcccaagccctagagctaacttagaaagaggcttggagatgctgtgagagaaagataccagggaaaagctgcagatattttcccagacccaaggaatgaggagccagatgccattttttaatctggggtgcntacaaaatcagcctttgtttgggcaacctaggagtgtgggccacacaagctt

SEQ ID NO: 625230 - DNA, 1622 bp, Homo sapiens
attttgaaatatgcttctaaacataatttatataaaatctagtcatgtagcagttcacattagaatcttatgtacatttaaattggtctgtattatcgatgcacaattagaacttgagtctaacattttcaattacttttttcattgaactctactccgaaagaactaccagtatactgaattgagtttttttcccttgtccttcagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625231 - DNA, 488 bp, Homo sapiens
tgcccctggccttgaaactgtggtttgtggactccaaagcccctatccttccacagtgctttctgtcttgttatcacatttccttggaggagagcccagccttggtggaagagccctgctctggctttgtccctcggcatgagatggcaaaggatggtgctgctgggagaccctcacgtctgcacactgggggctgcttgccttctccattcctccttcaagtatctgagcagctcctgtgtgccagctgctggtctacaagatggatcggtccttggagatcatgctgtagcagaggaggcaggctgtagcccacacgccacaaccagccccctgcctgttcacacaaataaagttttattggaatacagccacacccatttcagtgcatattgtctgtggctgctttcctgctacaatagagagttgaatagttgggacagagacctatggcctgcaaagctgaactatttaccatctggctctca

SEQ ID NO: 625232 - DNA, 101 bp, Homo sapiens
  misc_feature (3)..(3): n is a, c, g, or t
tanaaaagctaaaggggaatttctgagaaaagaggaaataagaacataatatgatgcaggagacagaagtcttagaagctgatgatcaaaagaatagggag

SEQ ID NO: 625233 - DNA, 1139 bp, Homo sapiens
  misc_feature (731)..(731): n is a, c, g, or t
  misc_feature (752)..(752): n is a, c, g, or t
tcccttctgtgttaatagtaaagcatgttgcctaataactacaaccctgaccaaatttgggcctggatctcatgggtcacgtggagttttaaatacgatttttaatttacttgggtaattgagctgaatctttagttttcagattacttttttaaacagataggctcttagaacaaattattaaaaacataataccccattggaggggaatctggattaactacccactgttcccaccccccccaacttttgaaaaattttggccatatagaatgcatgaaaaatcagtatgatcttatgaggactttatagtactgtaaatcttaggagcactttagttgttttgtttgtttgtttgttttaccagtcaaatagcagtgggagattgtataccaactttagtgacactgatattagtaagttctgataacccactaccatcggaccagcctggagcacattactttggccagtggaaagtctcttggagagactttgaggtttgtgatgacaaatcatgctatcgttaaagttaaatacatatatatacacacctagaatataagcagaatggaaaagttggcagggatgaattcaagaacattagagtgaatttttttcattacagaattgttagttcctttaggaacttagtctcgtagatgtatatatttaattagcataacttggacagcacaagattaatgctttaacttgtttgcaggagtttnaaaagctggtttctgttgccnatagttggttggaagggaaaatggagatgccacaaataaaattttttggatgtgcaaaacagttttgattttatttcttacaaactataggactccaagccccctgatccttgatcagaactacattaacaccaaaaatcaagttatcaaagcagagaggagggtgctaaaggagttgggattttgtgttcatgtcaagcatcctcataaggtgagttgtagagtacagaaaattgggttcgtaagtattaggacttttctaaaaattttattttatatgaatttaatgtttctatctgagtgttaaacttggtttttaaaaagcattctttttaaggtttcaagctttatatcgaaaaacatatcttttggaagttgaagatttat

SEQ ID NO: 625234 - DNA, 2634 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625235 - DNA, 3014 bp, Homo sapiens
  misc_feature (161)..(161): n is a, c, g, or t
  misc_feature (800)..(800): n is a, c, g, or t
  misc_feature (803)..(803): n is a, c, g, or t
ggtctgcacatgttccgtggcagagctcccgcgatcttcctggcttggatgccttgagcttggcgccgcggcggacctgcagggttctggggactcagccacttgtctgacgggcgtagcagcagactaccacccgagacaagcagtgtgttacgaggttnatccagaagatgaagagcagagcaaaaagcaaatgatagccgtggctttcacgtttaaaaacagttcttaggcagcgccgggtcgcggtcctgtagtcctagctacatcggagggtgaggcgggaggactgctgaagcccgggagttcgaggccagcctgggcaacatagtgagaccttgtctctcaagtcatgtagctttggatggtattttttttcccagtggaggaataaatacgcatttcttctcttcacctgcaattttcactggttgtcccacgcagaatcagagtcaggaaaactgtacgtagagaagcttttatcattttatatgttcctgtcttacaaagctccctctggcttaaggctggtggcccacatcttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625236 - DNA, 4183 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625237 - DNA, 219 bp, Homo sapiens
gtcggtacctacgaccgaatatgccatctcaacagcctctgagaatggggctgtgtgtgcctaacgtgtcgccatcaggtgtcagagtctcccatgtgataggatgcagacgctcaatccatgtgccctgaaacccggggcataatccaaaagcatcattgtgagctctcggcataggggcaatcgcgtactgaagttcgtgcgcaatgtgccctggga

SEQ ID NO: 625238 - DNA, 4258 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625239 - DNA, 288 bp, Homo sapiens
gcgaattcactagtgattcagccatgttggccgggctggtctcggactcctgacctcaggtgatctgtctgcctcggcctcccagggtgctgtgattacaggcgtgagccaacgcacccggctgactaatttttgtatttatagtagagacagggtttcaccatgttggccaggctggtctcgaactgctgacctcatgatctgcccgcctcggcctcccaaagtgctgggattacaggcgtgagccaccgtgcccggccaacatggctgaatcgaattcccgcggtc

SEQ ID NO: 625240 - DNA, 543 bp, Homo sapiens
agcggcgcctttaataggttccatatgaactttaaatgtagttttttccaattctgtgaagaaaggcattggtagcttgataggggatggcattgaatctgtaaattaccttgggcagtatggccattttcaccatattgattcttcctacccatgagcatggaatgttcttccattttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgttggtgtataagaatgcttgtgatttatgtacattgattttgtatcctgagactttgctgaagttgcttatcagcttaaggagattttgtgctgagacaatggggttttctagatatacaatcatgtcgtctgcaaagagggacaatttgaacccatctctttggagttaaattcattatttatctaggtattggctattatcagct

SEQ ID NO: 625241 - DNA, 4330 bp, Homo sapiens
  misc_feature (81)..(81): n is a, c, g, or t
  misc_feature (420)..(420): n is a, c, g, or t
  misc_feature (423)..(423): n is a, c, g, or t
  misc_feature (1205)..(1205): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacatgagtgaagtatcgaaaatccccaaggagaagcnagtgctctgagaataggtcactggaatcggggactaacaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625242 - DNA, 4128 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacactagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625243 - DNA, 3927 bp, Homo sapiens
  misc_feature (731)..(731): n is a, c, g, or t
  misc_feature (752)..(752): n is a, c, g, or t
tcccttctgtgttaatagtaaagcatgttgcctaataactacaaccctgaccaaatttgggcctggatctcatgggtcacgtggagttttaaatacgatttttaatttacttgggtaattgagctgaatctttagttttcagattacttttttaaacagataggctcttagaacaaattattaaaaacataataccccattggaggggaatctggattaactacccactgttcccaccccccccaacttttgaaaaattttggccatatagaatgcatgaaaaatcagtatgatcttatgaggactttatagtactgtaaatcttaggagcactttagttgttttgtttgtttgtttgttttaccagtcaaatagcagtgggagattgtataccaactttagtgacactgatattagtaagttctgataacccactaccatcggaccagcctggagcacattactttggccagtggaaagtctcttggagagactttgaggtttgtgatgacaaatcatgctatcgttaaagttaaatacatatatatacacacctagaatataagcagaatggaaaagttggcagggatgaattcaagaacattagagtgaatttttttcattacagaattgttagttcctttaggaacttagtctcgtagatgtatatatttaattagcataacttggacagcacaagattaatgctttaacttgtttgcaggagtttnaaaagctggtttctgttgccnatagttggttggaagggaaaatggagatgccacaaataaaattttttggatgtgcaaaacagttttgattttatttcttacaaactataggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625244 - DNA, 4295 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcaggtaggtgtatatttcccattttgttctgtaggataaatcacacaaattttcggtggttccaatacagatttagcaaaaatttaatttaaaacattctgttcttatggtttagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 625245 - DNA, 484 bp, Homo sapiens
  misc_feature (410)..(410): n is a, c, g, or t
caaaaatccatcagagtaatcataacaacagaataacaaaatttgtgattatatcaactgatgcaaaaaaggcatttgacatatccaacatgcattcatgattaaaaactcttagcaagtcagtaatgaaagagaattacctcaacttgatataagcatctgcataacaacctctacagataacatgaaacttaatggtgagggccaggcgcggtggctcacgcctgtaatcccagcactttggaaggccaaggcgggggcagatcacgaggtcaagagatcgagaccatcctggcaaacatggtgaaaccccgtctctaccaaaaatacaaaaattagctgggtgtggtggcatgcgcctgtagtcccagctactcgagaggctgtggcaggagaatcacttgaacccnggaggcagaggttgcagtgagccaagatcgtgccactgcactccagcctgagtgacagagcaagactccgtctc

SEQ ID NO: 625246 - DNA, 628 bp, Homo sapiens
atagtagccatactgactggtatgagatgctatctcattttggttttgatttgaatttctcttctctaatgattagtgatgttgaacattttttcatatgcttattggctggatgtatcttcttttgagaagtgtctgtgtgtgtcctttgtgtactttttaatgggattgtttggtttttgcttgtaaatttgtttaagaagttccttatagacactggtttggttttattgcaattgcttttggcgtcttcgtcaggaaatatttgcaaattcctatgtccagaatggtatcgcctaagttatcttccagggtttttatacttatagattttacatttaggtctttaatccatcttgagttaattttcgtttatggtgaaagaaggggcccaatttcaatcttctgcatatagctagccagttatcctaggtccagttagggaatagggagtcctttccccaatgcttttatcagctttgttgaaaattagatggctgaaggtgtgcagcattatttctgggctctctattttgttccattagtctatacgtctgtgtttgtacaagtccatgccgttttgatgactgtagccctggcgttaacttgaagtgggtaacagaatgcc

SEQ ID NO: 625247 - DNA, 952 bp, Homo sapiens
ggctccggtccctgccccccgtgcgaatgtgctgcgcagcgggggtgcttacgctcgcggggttgggtgttgcaggcaggagctgggaggaggcggagggggggcggcagaaacagcagcggcggcggcgggcggcagcttggaggaggtggtgacgtgtgggcaaacggccaggcgtcggggacgatgggcgcgacccctggcaggttggttttccccttcttccctcttcccccaaaggcggaggcgctgccgcacgttgccagacccaggctggtgttgttcgcaccctccttagggcggaggccttcttcttaaggcaaggtgcccaaagagattcgcctttggaggggggtggcccttcgggaaaacccttctgttggggccccaaagcccaagaagcctccgtataagacactcccctcttctcaagatttggtgccccttccttggtgggaaccttaattcccgttggagcccttttcccctttaagggagaacggcttggttttggcccaaagccacacaatatttcttccagaagacggggggtagaagccgattcgggggccggattaaaggggcccttaccccaataagagaaaacccagctataccctgcggggggagggcttaaaataaccgtgggtaatggcgcgaggtgcagtggtaccgtgtgtattgccgtgtaaaatagtgggtaggtcctcaaccaaataaggttaaattactggggggcaggagtagacattgcttcgcgcgcggtcaatattccaataaagtggctgtgatgcgtgggacataggctcgtttgggcaagtgtaaacttctgaaatgttggttgttgggactttttcaaaggggttttggataatatgtaagggggccttttttaaggacccatttggtgggggtgtaaaaaggtggtttgtggaaccagcggttattaagg

SEQ ID NO: 625248 - DNA, 179 bp, Homo sapiens
  misc_feature (3)..(3): n is a, c, g, or t
tanttggattcctcactgtggctcagcacccaagaggagaatgctgattgttgtcgtcagtaagaagctgcagataccgtttcattgagaggggggatgctagaagtggaaggtgaatcagatttcactgcagagcctgtagcaccttcaacagattgtgtggtctgtaactgcgtggc

SEQ ID NO: 625249 - DNA, 958 bp, Homo sapiens
cagcctggaggacagagcgaaaatccatctcaaaaaaaaaaaaaaaaaaaaaaaaaaaatttttgggggccctgggccgagaaaaggtttttaaacccctttggtggggggcggggcccatcataggtaaagtggaccttgtgcccaaaggcgtgtccccaaaggagagacccgggcggccaagagacaaagcgtggttggggtttcctccccaagatataaaaacccgccggcggggcaacaccaggacgcggttctgtagaaacaacctcccagagatgggagctctcggccgccacataacgggggagcctatacacaacagggagagtacacaacgcgcagcgcccacgatactacaaacattaacacccctgcccagcagtaggacacacacacaacacacaacgcaacaacacccacacacacaaaactcaccaacacttcatccaacacatcaaccacacacacacacacacacacaacaataacagacacaagacataccaacccgaccaacacacacacagacagcaaccaagagcacaccacagcagccacagcaacaaaacacaacagccacaacacaaacgatccgcagacaacacaccataccacaaccaaaacacccatcacaataaacagacaacaaccccccacaccgcgagcgctgacgagccgcccgcccgcactcccaccaaccgccagccaaccactgccgccgcgccgccagccgcaccaccgcacgacgccacgccagtcacacaagtacagcacgcacaccgggtacagcgaacgccatggcgaagcaagccgaaggacaccagaccagcccacagcaagaaagatgggagggacgcaccaatgcaagcgagcacacagaaacaacaaagaagcagacacaggggaagcaccacacgacgacaaaaaccgcaggccaaacacacagcggacaaga

SEQ ID NO: 625250 - DNA, 484 bp, Homo sapiens
  misc_feature (110)..(110): n is a, c, g, or t
  misc_feature (142)..(142): n is a, c, g, or t
  misc_feature (150)..(150): n is a, c, g, or t
  misc_feature (194)..(194): n is a, c, g, or t
  misc_feature (196)..(196): n is a, c, g, or t
  misc_feature (206)..(206): n is a, c, g, or t
  misc_feature (228)..(228): n is a, c, g, or t
  misc_feature (327)..(327): n is a, c, g, or t
  misc_feature (414)..(414): n is a, c, g, or t
  misc_feature (446)..(446): n is a, c, g, or t
  misc_feature (465)..(465): n is a, c, g, or t
tatctcctagtagtgatctcacactttcaagtgttctctgggatagagagagatcaagcttttatagcctgacgagttcaaacatcagtaaatgggaattagatgattcntcagaaaagcatgcatacagttgggatatagngggttttntttaggaaaacattaccgatgctatttggggatctgaaagtaangntgaagctatnaaagaaggagtcaacattcganatttggacttgaagcaaaactgtgatgggctggtgattttggcagcagcatggcactcagcagacaatccatgtctcatctattactctctgataacantagaagataatggttgccaaatgtcagatgcagttactgtagaagtcactcaatatagtccaccttttcaggtctgaagaccctgantttgtgtcagttgacggtcccaaacttttcanaccagactgcctatcggtntaacaaagtgctgtccatg

SEQ ID NO: 625251 - DNA, 407 bp, Homo sapiens
  misc_feature (7)..(7): n is a, c, g, or t
  misc_feature (86)..(86): n is a, c, g, or t
  misc_feature (91)..(92): n is a, c, g, or t
  misc_feature (96)..(97): n is a, c, g, or t
  misc_feature (105)..(107): n is a, c, g, or t
  misc_feature (112)..(113): n is a, c, g, or t
  misc_feature (115)..(117): n is a, c, g, or t
  misc_feature (128)..(128): n is a, c, g, or t
  misc_feature (139)..(139): n is a, c, g, or t
  misc_feature (145)..(145): n is a, c, g, or t
  misc_feature (150)..(150): n is a, c, g, or t
  misc_feature (166)..(166): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (196)..(196): n is a, c, g, or t
  misc_feature (198)..(198): n is a, c, g, or t
  misc_feature (213)..(213): n is a, c, g, or t
  misc_feature (239)..(242): n is a, c, g, or t
  misc_feature (244)..(245): n is a, c, g, or t
  misc_feature (262)..(262): n is a, c, g, or t
  misc_feature (265)..(265): n is a, c, g, or t
  misc_feature (315)..(316): n is a, c, g, or t
  misc_feature (385)..(385): n is a, c, g, or t
cacggcnggctccccttggggcctttggctagggtgagtgaagctttgaagacagtggcctctagtggacttggataagtggcagnttttnncccnntaattttnnnttttnntnnntcatggtggcngcttcacaaangctccnatccngggggtggtaaaaagngggcncngntcattgcaaataccagatttncnctttctctttttgtnaatataccgtcatatataggctaaannnncnnttggggggggggggttnggnggggggggggggggcaggttgaacctacaattgcatatgtgatggggtcnnggggggggggcggggggggggggggctcttagcctgaagcaaaagaaaaggacactcgcttctggctangtgtggtacaaacactgggggg

SEQ ID NO: 625252 - DNA, 1230 bp, Homo sapiens
tctcagcctcactgccctgccctgggcttcagcacctattcatgtagcccaggtgccatcgctggaagccccagtgccctgcgcaccacatgaccatccccagaatgatcctggtcccctgctttaaccatctgaaacatgagccacatcctggtgccacactgttttgatcctgcaccacagtggctgctatgattggagatatatgaacatgaatcagcaactcctgcatgcctgttcagccagaccattcttctgtgtcacaactgcccagtatagtgtgacaacgacacgtgaccaggccatcaggtgcctcacatcttcagcacccaacccaacagaaacctgctgcctgatgagccgctgggctcagcatccacgctggtgaagacagccttggttgcagtgaggtgcaaccagaaccttctcagccttgtgtgtacccagcgtggttcgcctgtacccagtgacagctggccacatggcagctagagatgggtccggatggcggccagaatcaccagatgcggcagcacaccttgcgggggaccgcgacccccaacaaccagcaaccgacccaacccgccgacacgcccacacggtacagccacacaaccacacgccaaggaaatgacccagcaacgcctccctggccgacgggcacgccggcgcgctcacccggcaccccaccgtggaacacctgcacaccaaacgcggccgtcccgcgctccacgcacaccccacctacccccaccacaacccgcccggccccgacacactcaccgcaacgcaaacaagcaaacacatcacaggagccagcaacgcccacccgccgccacaacgccaacgcaccagaaccagcggaacaccacggcaccacaccgcgacaccccgcgacggaacacaccacaggaccgaggaacacacacaacacgacgtgccgcagacacacagacgccccccaacagccagcacacggggcccgggcgcccagccagcaccgacgcggcgcaccacgcgaccgcacgacgctacacgcgaccaggcccctgaccagaacgcggaacggcggagcagaccaggaagacgctgggagcaccgaaagcatggcgccgcgcgagagcacgggcgccgcgccggcagcccccgacagaccggcacaacgccccacaagaactcacccaggcacaccccgggccgcacacgacgagcacacaagcgaacacacac

SEQ ID NO: 625253 - DNA, 288 bp, Homo sapiens
gggaggcccgggtaggatgactgtggtaacccattaccttttagaagccaggtgtcgggcccttaccatgctggactgctataggcccaggttccccttgtcctgtggcccttttcttcctccttgaagctcccaggtattctttgttcttttccccgtctaaacctgtttctgagacgtggatctcaagcaagttcatgccttcaatcagatgttacttagcggtgggtatacctaaattataaacccttatgtacaagtcagtaagccttagcggaacggtgcagc

SEQ ID NO: 625254 - DNA, 804 bp, Homo sapiens
ggtcagccggcatctgctttagcgtgcgccaggcgagtccagatcgctcagagcaccatggggaacggtgacaggtgcggagctcaaaggattgggtcgtatgggcgcctggtcacccagtggctgctgttaactctggtaaagtggatatcgttgtccatcacatggatcgccgttcgaattgagccctcgaactatgaatggtgttacatagtcgcgcaagtatgcattccacccactgggcgaatagtatcccagtggcgaacgatcgaaggtctgaggaaggcggagaagctatgatcgagtcagatggaagatgccgcatcaacatctgtccaggatgcgagatccctccaaaatcaagtggggcgatgctggcgctgagtacgtcgtggagtccactggacgtcttccacctacacgatggaggaaggctggggctcatttgcaggggggagcccacaagagggtccatcatcatcgtgtccccctctggtgcatgcccctcaggttcgtcatgggtgtgaaccgatgtagaagtatgtacaacagaactcaagatcgatcagcaatgcacgtccatgcacacaacccaacatgtttagtacccctggccaaggtcatccatgacaactttggtatcgtggaaggactcatgaccacagtccatgtgcatcactgcatccagaagactgtggatgggccctccgggaaactgtggcgtgatggcgggggctctccagaacatcatccctgctctactgggctgcaaggctgtgggcaaggtcatacctgagttgaacg

SEQ ID NO: 625255 - DNA, 114 bp, Homo sapiens
gcggccgcctactactactactgctcgaattcaagcttctaacgatgtacggggacatggtttttctcctgctgcaagtggttcaagtgctgacccagttgctcgtaccaaaaa

SEQ ID NO: 625256 - DNA, 262 bp, Homo sapiens
gagaagatgagaagccagtcgatgccaaggcaaaactcatgaacgggtgctggggctaagtgccagctcagctgccatgtgttggtctcctagggaccaaggcctttgcattctttttctaccctgagctcccagcgttctaattgctctttattgttcattgattattcattttgcgtctgactattggtaatattttatagtaaattaaatgttattgtggtcaagaattcaaacagagagaatacacaaacagggagca

SEQ ID NO: 625257 - DNA, 173 bp, Homo sapiens
acgcatcgggaagctgaatacggagaaacaaattacctgcacggtacatcacatcctgtacaaggcagaagtgaacttctcctgcagaatgctgagcacatttgagtgagaccaaccgctatcctccgagacctcctgagggaacagaaccgcagttgaaagactgctagggt

SEQ ID NO: 625258 - DNA, 346 bp, Homo sapiens
  misc_feature (248)..(249): n is a, c, g, or t
  misc_feature (267)..(267): n is a, c, g, or t
acaagctcaagagaagccctgtgaagtagggtgtagggtgctggaggactcactgtggtgcaaggcaatctgccacaggatatgagtgcatggccaagttgtggggctgcactaaatccaagcacccgcaagccccagctcgagatagccaagatgaggtccagatggtggttccaacagggggtgtcattccaggaccatgagatcctgcagggggaccttgactttgttggccacctctcggatcnnggcctctgacaccgcgtntgaagcatagcgttgcttgctgttcaccttgatcacggggcccttgtggaataaaggccggtggttctccacatctcct

SEQ ID NO: 625259 - DNA, 408 bp, Homo sapiens
aggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcatttgaagcaaattggaaaggtgaaaaagcttggtaagtgggtgccttatgagctgagcggaaatcaaaactatcggtttgaagtgtagacttcttttatgctacgcaacaacaaaccatttttcaatcggattgggacatgtaatgaaaagtgaattttatacaacaaccagctcagtgggttggaccaagagggcagcttccaaagcaagttcc

SEQ ID NO: 625260 - DNA, 261 bp, Homo sapiens
caatctccaacacatctggcctagactacgtacatcaactacacctactccaatgctaaaactaatcgtaccaacaattatattacataccactagacatgacttaccaaaaaacacctaattggaagcgccaccctagacaatatcaaccattaaccttccctctacactcatcatcttcacaattctaattctactgactatcctagcaaatcgctgtggccttaatccaagctcacccatacggaaagcaacccaagc

SEQ ID NO: 625261 - DNA, 195 bp, Homo sapiens
atcgagctcgctaccgttaatcgtgtctttcgtacagcgtaggatagaacgtacgatagagaccggagctggattacgtgccggtctgaactcagatcacgtaggactttaatcgttgaacaagcgaacctttagactagcggctgcgccatcgggatgtcctgatccaacatcgaggtcgtaaaccctatggtt

SEQ ID NO: 625262 - DNA, 338 bp, Homo sapiens
  misc_feature (57)..(57): n is a, c, g, or t
  misc_feature (295)..(295): n is a, c, g, or t
aggtaaaggaaagtgggattaacctcctgattataaagttaacgggaaggtggactnggtgaacactgctgtaagtagataattcaatggagaagaaaatttagaaataattttattttgaaatatgtatagtttatgttttcctagttgtaagttaaccttcctaatatgtttgaagactaaaagtaaaagcattactactggccaagtgcagtggctcatgcttgtaatcccagctctttgggaggctgaggcgaatggatcagttgaggccaggagttcaagaccagcctgnccaacgtggcgaaactctgtctctactaaaaatatatatatat

SEQ ID NO: 625263 - DNA, 192 bp, Homo sapiens
ttagaggaccccgctattcatctggcacccatgagacgtggcgctggcaagcacgtgccccgggctgtgtctgtagacttgtaaccccacagtcattgataagttcgcactggcacctaccgccagctcttccaccctgagcatgctcatcacaggcgaggaaaatgctgccaataactatgcccgagggta

SEQ ID NO: 625264 - DNA, 310 bp, Homo sapiens
  misc_feature (47)..(47): n is a, c, g, or t
  misc_feature (73)..(73): n is a, c, g, or t
  misc_feature (89)..(89): n is a, c, g, or t
  misc_feature (91)..(91): n is a, c, g, or t
  misc_feature (187)..(187): n is a, c, g, or t
  misc_feature (204)..(205): n is a, c, g, or t
  misc_feature (243)..(244): n is a, c, g, or t
  misc_feature (246)..(246): n is a, c, g, or t
  misc_feature (250)..(250): n is a, c, g, or t
  misc_feature (259)..(259): n is a, c, g, or t
gcttttctacaactaatgattcttgtggtttgcaaaccatgtttgcntttatttacctacacaaacacggaanagaatttccaataggngnggttcacacagctaacaaagcatagagtgtgttacctcaataaggcattcaacaaagacacacgccgtatttccctctgactgcgttcccttaggntgctctgatgtgggggnngcattcttctaaaagtagaatcaaatcttcaatcaggnngngttntctgccatntgttactctcataatatcaaaagccagtttcagattcttcattgcttgggg

SEQ ID NO: 625265 - DNA, 527 bp, Homo sapiens
ggcaggcaagcggtcttggcctgcctttcgatgcacagagaaaagcgttggttcgtggcaggtcagagatgttgctgtaaacctcatatccagggaggacgtgtgtgaccagtcatcacagaccattcttttttgaaccatacaatctgtgttttgtatcctccagcagatctttacattttgattataagtggtcacaggtctggaagcatgactccaaagaatggtactcatggggcggtgaaggtgttgggtcttcctccaggaagcatgcatggtatcccgcccggagctggcgtggccattcctaaagtagaacgtgcaaccatgaaacggggtggggtcagtgtgccacctggagtcggagtgggtcctgagtcagtgcagtatatgtgtcatttaccataaaggcagaggtcagatggatgggtgggggcacaggctggagaatcttagggtaacagtgttaacacttgtgccgtggcaatgggatgtgctctgattccacccattaataagcatgttaa

SEQ ID NO: 625266 - DNA, 366 bp, Homo sapiens
gctcgaccacggcgataggggtgggtgacgtcgcaatcgactgcttgcgacgcacccacgggttatcggggtccagtcggctggcaggtgtgcaacggtcaatcacgatatcgacctgttgaaaacccttggcgtccaagtgttggcgcacagcgtttgcaggttttgccagtctgtgccgaccacaaagcgcaactggcaatgcgcaatagcgggggtggaatggcgttgaccggtttggctggattgcctgcggtaaacgccaggatctccacggtattccagccgaagagtcgctcgcccagggtcaagtcgggctcgcccagtgcacatccaaaggacggcccagggaattctgatgtcgac

SEQ ID NO: 625267 - DNA, 445 bp, Homo sapiens
caagttgctggctcctgagaccagtatttcctggagctgtgcctcagtgaaggggcccagcctgaggaaccctggctcttttctttaaagcccaggccccccttacataaaacatttcagggtccctggaaacagtgaagtgccatttgttgaagcctactgcatgccagccccctgctcatccacgtggtttgccatgcctacgaggaaggccagcgcatgcaggactggtctctaattctgtggttcctttgcccaaaagggaaaggtttcaaggaagagtccactgggccaagcccaagccccccggacatggccttggtaaaggttagcagactggtgtgtgtggttctgcagtgcttccctggaaataatttattcattgcagatactttttaggtggcattttattcaaaaactgtgctttaaataaacaaatgtacca

SEQ ID NO: 625268 - DNA, 558 bp, Homo sapiens
  misc_feature (1)..(1): n is a, c, g, or t
  misc_feature (306)..(306): n is a, c, g, or t
  misc_feature (311)..(311): n is a, c, g, or t
  misc_feature (314)..(314): n is a, c, g, or t
  misc_feature (357)..(357): n is a, c, g, or t
  misc_feature (387)..(387): n is a, c, g, or t
  misc_feature (458)..(458): n is a, c, g, or t
  misc_feature (462)..(462): n is a, c, g, or t
naggttaactgccgtccacccaggcttgcccacttttccccctctggcttctgatcccaaatatttcactatggggtctttcacatttccaaagatatttctattctaatgccacattttcttgtcctggattacaaaagtgatttaagggtttttattaataagttgtttcactcaaaaaacaaaacactttctactgtccctgaaaaacagcaataacagggtgatctatatcatttgtaaatttacattctgaatctaaataaacctgttgaaacactagttgaaaaagagaaaaaaaaaaangtcancangttattcatgcataacaggaacaagggttaacgggccttttgnattacaaggtaaggaatctgcctaggcccncattggggggggggccggcgggtaaccttggctttggggggttggttggctatggcggtggtgccgggccnggcnacaactctggctcgggctcgcggctttctcttcatctttcaaggcttcttcgtaatgggttgggagggcgcagggggtggtaccatttaccttggc

SEQ ID NO: 625269 - DNA, 363 bp, Homo sapiens
cccccgggtattcatgtataaatccctcatggctgtaaattgaaccgttcctgcagtatccgagattacgagcatacactgctgtgcatctgcttcaacttgctttctataagaatcttctatcgaaggatggtattattcaacaaaaattccttcatcgtattgtacagtcaaagcagacttcccatcgcctcttgagccaagaacgcctagcttatactcacgcatgatgcaagcgtgtcaaaccctagtacctctcgcgctgtcaccgggttcttgcagccagtgtcgcaccgcgctccccccgggtcgatactctaggctcaacggcggtccagcctctgacgcacagctccggctggt

SEQ ID NO: 625270 - DNA, 695 bp, Homo sapiens
tgaggaggggtgtgacccttgagactttgagagacccggtgagaatctaacagggtggccccctttaaaaaacaaaaaaaaaacaaaacaaaaaaaaacaaaacaaaaaaaaaaaaaaaaaaaaaagaaaaaaaaaaaacaacacaaaaaaaaaaaaacaaaaaagaaaagaaaaaaagaagagacagacagagaagagaaatacaaaagccagagaaaaaaaacaaacagcagaaaaggggcggcgcgcgcggggccgcgacgacagaacagggtaggcagagaaaaagaacggagggagcgaggagcgcgcaggcgccagaacacacagacagagaaggaagaggagaaagacgagggaacagagacagagagagcggagaaaacaaaaagagggagagcaccagcgagatcggagaagaaagagggagcgggggagggagagggaacacacacagcaagagaaatgaaaagaaaggaaagagagcgggcggcgggagagaagcagaaccagacaggtaagagagaggacaaaacaaaacaaaaaaaaaagaacgaggagggcagagaagagaggacagagaaagaagaagacgaagggacagacgcagaaagacaaagcaaggaaagacaaaggaaaaggcgagaggaaagaaaacaaacaaaaaacgcaccacgcccggcgtgggggggga

SEQ ID NO: 625271 - DNA, 1131 bp, Homo sapiens
gcgtagaatcctgattgtagctatcaatgatccgttgctgtactgaaacactgaatggaggataacggtgagcgacacaaggtagcttccctgctagatggatggagacacactagtagacccctagtcaaatgttatatatggtgattctgtgtactcgtcccatattcgttgcataatatatgaatgtacacacatatcaccttcctggaggagttcaaaaaatcataggccatacaattgatatagatcctcattcgacatgtcgatgtgaactgtggcaggaattcactgggtataaacagatatcccaccttctgtctgaacataatcatttcctcgtatatgcaggagacgtataacatgctatctcttggagatggcatggtgctccgtccaactttcccatgatgttcagtcctccaacgtgatactcccgattctgatgaactatgtgaacctccagactaagacatcctgctcaagcgttgactcttattggttaggcctccagtagcttgcatatttacccgcatgtggacagctgttggatcatgcaataccaaccgttccagcgctcaaggtgtgatttctgtgcacctatgaagtctaggatggcccttcgtccatagtctcaaatgcagcccctgtagtgaatatctagcaagtaatttccctgaaatgttacagataagaggttctctcgaagtgagcgggggagtcgaccgacggggatcaaactatggccattcctcaggggtagtcccaataacctggccgtccaaggaagaaggtggacccctctagacgaaaggcattaacttcccgcagggaaagatgtgagcgcttccagcgcataggaggtttcccgggtcgcctgtggaagaacagtgcgacccctcagggaggcaatgggcgcgaaggcctttacacagacgaatgcggcaggtgtcgctctccacatctggcactctgcgggtagtccgggagagagaaaggcacacaatgtgagtcagattaccaacaggcgggaggccgaaactaagagcaacgagggcacacacgacacaagggggagcagccaacttacggcgacaccacgcctactacgcgcagctcatactcgcgcga

SEQ ID NO: 625272 - DNA, 937 bp, Homo sapiens
  misc_feature (702)..(702): n is a, c, g, or t
agcggagagagagaggatcccttgagccgaggagtttgagtctgcagtgagctatgatcgcaccactgcattccagaccccatctcgaaaaaaaaaaaaaaaaaaaaaaacaaaacacaaaaaaaaaggcgggttatccctcatttcccagctaagaatcaggttgtttcaaaattaactataagataaattcacttaaatttacattaaaataaaatacacttaccaagtttatgagatgttcagagcccgaggggagcccttcacacgcagccagggcagaccggttctgtgcagggacagcagcgttacattagggatagaaaaaatctccaagggccccaaggccttcagtgctatcgggtgatcttcccatttccccagggttcatatgtgtggccttcatcctttcaatttcccagcaaaattccctttgtcacaatttgttgggcctttccaagtcgggctgtgaacctagaggggatgcaccgcgacagcgttgtgctcacttcgtggtggcgccgacaataatggctggggcgaaaccgacataaacccttgcgggggccaggttgacaacttgggacggtcgcccagagaaatacccttagagaggtgcagggggataatgcaacggatatagacggtgtaacacccagaagggaggaacgcccgtcgaaggtggtgttgtgacccacccgngaccttttcaacaactcggtgccgcgggtcacaattggaggcgccaacatcggccatggcaaaatgttatcagccaggggctgttgacaaagtggcacagaggtcaaaggggggaccgtggaaaggaggactcggggccaacgaggatgggacagcaaatgtagtgcggtagtgacgacaaacactatctggaacgtctggtttgacacggaacaaaagcgcggctcatcacctc

SEQ ID NO: 625273 - DNA, 241 bp, Homo sapiens
agggaacatgatgggcactgacctcctgtaaagaataaaactgtgggccgggcgcggtggctcacgcctggaagaggcaggagcgaaatttgctcagttgcagggattccccaggactccctgggagtcaggccacacccagttgcttctgctgggctggcggtctgtctgctctggagtggggtggggtggtgaggtgcacaccacacacacacacacacacgcacgcacgcacgcacac

SEQ ID NO: 625274 - DNA, 934 bp, Homo sapiens
  misc_feature (666)..(666): n is a, c, g, or t
gctgaatgaatgattatgaggctgtcagaatgaatactgggggtgatgggaaaatgccaaagatgagcatcttaccagaactttggatgagtggccttttaaatgctcagttactaatctgtgttatcagtaactgaatcagatcctggcaagacaaatggcaaagcccatttcttggtcctgtttacttcggatactattgtgaagcaagtcagaggaatgaaagactgtcataacagtcttgaattgacattgttccatttctcaccccatagcatgtggaggcctgtctatatccaactgctgagtgtaaagaataaaaactgactgccccatagtctggtccacattttagtgtgtgcttgaaggattgcaaggtagagaaatagatgcttcaggctctgatttcagcccatgctgtgctatgcaaatgttctctacatgcctgagtgaccttttgagaaagagcctttgtgatcttctgtagctagggcttgttctgggaattctgtgccagattcctctaaaagtgggaaaagtgaatctgttaaaggaccacgtaaaaaaagccagtgcttttcctggatgaataccaataagtccatgtttcttaccatgtcttgccagagctttagaaattgtctgagttgtttacaggtggattgngattgaagtgtgtgagagggaactgtctaagagttcagtagctggaaactgttggttcaaatgctttgattggtgattaaattaattcccattgggttcatagtttctgaagattccaaagtttaagggtggtcccagatggtggtggtggaacaatctattgggaaggctttgcgccaaggggtttacactcggattaaaacttttggtattgggaaaaagactttagaacattttttttggaaaacgtttctgagaggaaaaacaa

SEQ ID NO: 625275 - DNA, 296 bp, Homo sapiens
tgctcactgcccactgtgacgtgtctgtcatggtcccctcggccctgcacacgtgtccactgtgacgcgtcggtcactgtcccctcggccccgcacacgtgctcactgtccactgtgacgtgcctgtcatggtcccctcggccctgcacacgtgtccactgtgacgcgtctgtcatggtccactcggccctgcacacgtgtccactgtgacgcatctgtcatggtcccctcggccccgcacacgtgctcactgtccactgtgacgtgtctgtcatggtcccctcggccctgcacac

SEQ ID NO: 625276 - DNA, 154 bp, Homo sapiens
  misc_feature (69)..(69): n is a, c, g, or t
agctcatcacgatagagctgggagcgtgcttgtctgggcctcccccattgttggatcatcagctttgtnggctcgagcttgtcctggattagctgagccagcatggcattgtccttgtattccccccgaatacaggcggatcctctagaagtcg

SEQ ID NO: 625277 - DNA, 554 bp, Homo sapiens
  misc_feature (1)..(1): n is a, c, g, or t
  misc_feature (22)..(22): n is a, c, g, or t
  misc_feature (60)..(60): n is a, c, g, or t
naggaaagtgctccccagaaancagaagaacccggatgcccagatacacgtttaagcttntgacaactacagtcactgtgtactaactagtggtaggttggcaatttgtaaaatttactcattaaagagggagacagagccaggctccgtgcctcatgtctataatcccagcactttgggaggccaaggtgggaggactgctcgaggtcaggagtttaagaccagcccggacaacatagcaagacccccgtctctacaaaaaatacaaaaattgccgggtgtggtggctcatgcctgtaatcccagcactttgggaggtcgaggcgggcggatcatgaggtcaggagttggagaccagcctggccaatatggtgaaaccctgtctctactaaaaatacaaaaaaaattagctgggtgtggtggtgcgcacctgtagtcccagctactcaggaggctgaggcagaagaatccttgaacccgtgaggcggaggttgcagtgagccaagatcgcaccactgcactccaacctgggcaacacagcgggaccccatctc

SEQ ID NO: 625278 - DNA, 1348 bp, Homo sapiens
ggcagatagtatatgaaagtctgaaagaacaagtaggaaggtgaatataaggagatagacaataattgaaaaatggtgcttcaggtgctgagcgaaatggtcagtaatgatagcccatatgacagaggatctgctttagcaactatgagagtcatgagtgtgtcttccgttgtcgaaagtcacgagagagtaaaggaatggcatgggtgtagagctactaaagggattaatgaagagggaatactagctactgatgaagtagtcctgtcatgaccaagggttatggcaagggtcgcgggtggcgtcgtacgcatgtgctggcctctcttggcaccctcaggatactgaaagcaagcattaggcatttggactttgctgtgagaagacagcgtgaaagagtaaaatcgccataaatgaaacaaatttgattaagtcaatgtgagaaggtacactttccgctgagtgacattgaatcaacccgagttgggcaatcgctcaatcccttgctattagtcacgtactagacgtggccccatttgttcccaactgtgtgctacgcaaaacatacctggggcacccctaggaaatctctgggggcttcgtgggccccttcggggaggaggatagcgcaatggctaggccttagttgaaacagaaggacccatagccccacctgcgtttattcccctgggacacctgggtggcatctgtgccgacaaccaatagtggcctggaacaccatgcaaaaaaccttctcatattctcttctgcgctcgcataccgcactgggaaccctttgaacgagtttctcctcgaacccaattccacaaggaatggcgcgcgctttctagcttttcggccctccatctttcccccacggggggcaaaacccgggtaagttgcgttttaagccacttgttggtccggaattagcttcccatctaggcagtccgtccagcggggtgaatagtggccaacaagcgctcgcaccaccggagacccaaagagagttttatctccccgcgcaaagtggctcccccggtacaaatgccctccattccaattttggtagcgaaaacgcccttgtcctccgcggagcgtacacgctcccaaggctttggaccacccaacaaaggattctccttggagaattacatcagtgccaaacaggccgaaaagtgacatacacggcaaagaattcccccctaggacttatattctcctcaaccacttctaaagagggcaagagcctgtccgtcgacttaagtctctggccccctggttgttcccgcaggggcccttgcgcgcaatccaagcatccgcctctgcctttgggcgcgaacccacg

SEQ ID NO: 625279 - DNA, 792 bp, Homo sapiens
gcctaaacgcgatggatatatgtttttgaaggcagaaagcaaaattatgtttgccacttgcaaaggagctcactgtggtgtctgtgttccaaccactgaatctggaccccatctgtgaataagccattctgactcatatcccctatttaacagggtctctagtgctgtgaaaaaaaaaaaaattgctgaacttggcttataacttattttggtaagaaatacgtgtacaagtgactttatggcattctgggtagctgtaaggcattgaaggatgccaagaaagttttaaggacatatgggagaaattagtgtggaaatttaagaagaaactaggtctgatatttcaaagtggacaaactgtgccagttttggttctccttttcacgtggccacagttgttgtgatgcatttaaaagaaattaaaaaaaaggaaaaaaggagaaaacgaaaaaaaaaggaaaaaagtgttggtagggcagaatcatttggttcaaaggctggtgggcctctgcaaagggaaataccaggttctggggcaatcagtggttaccggttcaccagttggccattggaggggtttcaggagagcctttttctaggcctacatgcttggtgaacaaggtcccggtaatggtggtcggtatgtataatttcaaaggcaccaaaataggaaacggatgtcagatttatctcatcatattatacagaccgaacggtggtataacatttattacgtgctagtcttaagaactgcttcttccgtggtttgttccactatttcccttctctctc

SEQ ID NO: 625280 - DNA, 1576 bp, Homo sapiens
  misc_feature (409)..(409): n is a, c, g, or t
  misc_feature (451)..(451): n is a, c, g, or t
  misc_feature (536)..(536): n is a, c, g, or t
  misc_feature (563)..(563): n is a, c, g, or t
  misc_feature (663)..(663): n is a, c, g, or t
  misc_feature (735)..(735): n is a, c, g, or t
atcatatagtaagaacccagtaccagggagccctaacaggggtcctcatctggaccctcgtaatgacctccggtgacttagccatgctgatcttcaacattcgcatctctcataactgcggcctcaatacataggccatactaaccaatcaataactaatgcaattgatagccgaatggatggcgcagatgtaacactgacgaaagccacaactaccacaacggaccactgacacaacacacgcgtgtccgaaaaacagggccattcagtactatcagtggtataactcctctagtattattaccttctcagtacagctatgtgtattcttatcgtcgaggccattttacctgcagttcctgttctacacgactcctaagcctcagcacactcttaacgcacgcgcgcnaatgtgaggcagcggcaacatgggcactcccaccacacgagngcaatctcacccctgagtaaagatcccccctacgaagtccacacttcccgtaatacaaccagtccagtctagtgcacgtcagtcnaatctcagagcagtgtcaagtccatantaccacacttgagatgctctctatacgataagactctcacagtcaggaaacaacaatatcacagtacaacacgcaacattgaattcaatagacgacatgncttatcatggacgaacatctttaaatctgggaggctccttctaattattttagacccccttcagcataaacnaacagtccgtcagagtccagtctccacctttccgagaggatacttctccccgtttacggagcccaatttttcacggggacggggccaaaatcaattaccgggggcgtctaagacccatatatagtggccgttttcaggaccccaaggaaggtggctttataccccgaaccggaggaacacttttcggagcgctggtcccacttctttcatattctgcggggtccttccataaaaactatttttgcgcctttccaaacttcacatgacctcgagacctttcaaattcacctggtcccaaaatttttaaaaatttaatttctccaaacatgtttttaccccaccttctcctaggaggattcattccgaacactgttctcgggcccttgtcccgaagagaagtcacctggccgggtcccctttgtaaatgtgacaccttgggcgagatctggttgtgggtaaacccaaaatggttgtgcggttgagtggaagctctcacactttctcgccgttggctcaatgtggtgtgcctctccccaagtccggttagccttggcgaaggcaacggcgggctctccttcaaaacaacacaacacgtacagcaacaaaacaagaaaagacgacaacacacagaccactaagacagcgagcacagaacgacaccgagcgagggaccggaccgactgacaacacatctacacaaaacagacaacatgcagcccgacacaaacagagagtgcgcgcactccctcagaaagagaagtcacacaccactagatgagggaggcacacgaaaactgaattcgcatacacagccgcatgatggtggtttccgacacacggc

SEQ ID NO: 625281 - DNA, 230 bp, Homo sapiens
cggtagatttacaatcttccagctatcacaaaaaaaaataagattaacaatgaattgaaatgtcaaataacaggcagggcatgggggtgcacacctgcagttcccgctagtcgggagggcgagacaggagaatcgcttgaacccacagcggcagaggttgcagtgagccgagatcgcaccactacactccagcctgagtgacacaccaagaccctgtctcaaaacaaatg

SEQ ID NO: 625282 - DNA, 134 bp, Homo sapiens
ctgggtttcttatgaggttggagtgcagtggtgcaacttcaaatgatcgactgtctcggcctcccaaagtgctgggattacaagcatgagccaccatgcccgaccctgttgttatttttgaactgggacataag

SEQ ID NO: 625283 - DNA, 1034 bp, Homo sapiens
  misc_feature (708)..(708): n is a, c, g, or t
ttcgggtgttcgggaaaagaagaggggttggggcggtggagtgccactgttgtgatgtgtcagagtttccccactggggggtttaacttctaaggagttttttccggacttttgttattggggctctaaaaacttatggcgaacacctgtggtgtatatgggcttcacccaaaattcgcggggttttaagagacgtgtgtaaaaaagactcgcgggccacataaattccctctttgcgggaaacacgtccttgcctccacacgctgttgtcagagccgttgtttagtaaatctaaggaggggccactgtgggaataggggagaggatgaatgaggccatatttcgcccttatgggccccaacaaaggggggagacaacagggtgttcaattgtggtgtgttttcctacaggcgcttggggttcacacaatcatggcgtttatgagatttcacagaagagcgtctttttctcccgtatataccacagccacaggagactaacaaacgttgtttgtttgcccatcgtggttcgtcaaggtgagttctacgttgttgggggcgatataataaatgggtaatgtttcgtgaagaaaatgtctgcaagagcgcggttgggggcacacaccctggggaactctcgtgtgttgtcgcgtcttttcacaatttcgccacatggggaataacttctgggtccaaagaatatcttggnccacaggggcctctttggtccaaaagtgtggtttcacgaggtgctttcccttgtgaaaactcggcgctagtcttccactaggtagcttctacatctgagtcaccttctaacagtttgggtgttcttcactaggcaccagtggcacaccctcctgggaactaattttatagtcacagttaagttaacttgggttaaagtgcttgggttttttctcccttctaagaggataaatccatgggtgccaacaaccgggttaagtacaacaggttcccctctcccccaaatttctgacaataggtagaacccataaacacttggtgacggga

SEQ ID NO: 625284 - DNA, 82 bp, Homo sapiens
tccccttcccttttggaagttttggggcctcagtgcttgcaacaaccggccttgggcaaataaaaaattaggttgttttcta

SEQ ID NO: 625285 - DNA, 101 bp, Homo sapiens
ggaaattacccagatctgtcttttaaaagaaaccaaacgcgtgagtcccggttttttgaggaaaaaggcccctggcccagtttttttggccccgttccctt

SEQ ID NO: 625286 - DNA, 334 bp, Homo sapiens
tttgctagagtctcactcctttgcccagactacagtgcaatggcatgatcatggctcactgcagcctccacatcccaggctcaaacgatcttcccacctcagcctcccttgtagctgggactacaggtgtgcaccgcacacccagctaatttttgtgttttttgtagggacaggtttcgtcatgttgcccaggctggtctcaaacttttgggctcaggtgatccacctgccccagcctcccaaagtgctgggattacaggcatcagctactgtgccaggccccaattcccaactttgatttctgaacttcaggcccacttctctctcttgtcga

SEQ ID NO: 625287 - DNA, 415 bp, Homo sapiens
gctagaggatcccatgtggatgcggctattgctcaggaaacagaatcctttcaaaatattcattgctcattgacagtgcaccttgtgacccaagagctctgacggagatgtatgtaagatgaatgttgttttcatgcctgctaatgtaacacccattctgcagcccatggagaagggataaatttgattttcaagtcttattatataagaaatatattttataaagcagtatctgccatagttggtgattcctctaatggatctgggcaaagtaaattgaaaaccttctggaaaggattccccattctagatgccattaagaacacttgtgattcacaagaagaggttgaaatatcagcattaacaggagtttggaagaagttgattccaaccctcatggatgagcggtttaaga

SEQ ID NO: 625288 - DNA, 133 bp, Homo sapiens
  misc_feature (44)..(44): n is a, c, g, or t
  misc_feature (48)..(48): n is a, c, g, or t
tagcggtgaggtgtacatatatgtgtgtatcggctatgagatanggantgctgcggtatcgatgtgagctgagactagttcggactcccccctttcgggcaatgtcgaatgcgtcgtgtctctgcagtgtgga

SEQ ID NO: 625289 - DNA, 260 bp, Homo sapiens
atcacataccctaaggcatcctgttggtcatagctagtgtcctgtagctgatgactctttaattattaagttgactgagcactgggaagctgtctatttcgttcctaacttcaacaactatatgagatatctgcacccgagctgtttgctgaacactagtttgcgtgaatgcaaaggtcaaacatttcatgaccacatggcagtatcccacttgagattcctcgctctccttccgcgtgccatcgggttccccgctgtac

SEQ ID NO: 625290 - DNA, 128 bp, Homo sapiens
  misc_feature (115)..(115): n is a, c, g, or t
ttgtagagccgcattcttccagtggccgggcactcctcttcaccgcttccccagcgccgccggcccgccgggaggaagggcggaggaagggagggagtgatcgagagagctagcnaagcctggcgagc

SEQ ID NO: 625291 - DNA, 594 bp, Homo sapiens
agatagccttcttcaaacagcaataccagtttacatacagtgaaacacatgtagagggattctttaaatataaacatggaaaggaatctatttacaaagaacccaaactcacaccactatcaaaaatttctcacatactccaacaagcacaatggttcacggaatgaccaactcatcttcaatcatataattacatctcatggcccatgtatagggacttactttatcatttacaaactcaagatactttccaaaaccaatcactggggatacctatcacatggaggaccaaggggaaagggagagaaaagaaataaataacaaccttatttcttaacacactttctataacattatgacaaagtacacatatttttttaaatctcactaacaatattcaaaattttcattatatcttaacaaaaatataatatacactcttacactaaacttacattttattcttccttacacactaatattataatatataacctacataaaccttttacctttaaactaaacttttcttttaaatattttgtttttcctataccccattctttaatacaataactattttatgactttttt

SEQ ID NO: 625292 - DNA, 484 bp, Homo sapiens
tggtcgcgtgaaaggatgctgttactgatgggaaggaacgctaacggatgactgagagaaagagtgactgtagaccaaaatgaacacatatggaaactaatgcaatgtagtggtatgaatgggcagatggtgttgaaatgagagaaaacaaagagtatgggaacccaacaaacagaggagtaagagagggagaggatggcaggaaatgaggtcatgggggagagggaaagaaaaggtcctagtacctgaagctccttggcccaggagcagtgccagtaggatagtcctacccacttgacaaagaactctcgctcctgatctgccttgaagaggacgggagggtgggacatctggatttccatctgcctgttgaggggctggcagtgttacaggtggctccccccagcgccaatgtaggatcttctgcactcgaccctacagcacggcgcatgtgcctcggggacacagccatgcaacattggga

SEQ ID NO: 625293 - DNA, 384 bp, Homo sapiens
cgggcgccggggttcactgggaatccgagctatcccgaggacacggtgtaatacgggctcccgcattactgcctatctgctttacagagcaactccaataccgcgtgctagtgagaatccttgcgcagaatcgcctcatctgaatgtgctgttttaccccagagctatcatagcacgtgtgcacacctccatgaatgcatgagtaacactactgattctcatcacttgtctgggtccttcagagatgcaccatgcagaaagactcctttttaaaaagctgctgacccgacaactgaaatagttgtgtaccaatatgtgcaccacaatacaggaaagacaggtaaatgctgaaatgtcgtacttctggagtttgttacacaggcg

SEQ ID NO: 625294 - DNA, 171 bp, Homo sapiens
gtacagttacccagcacgtgtacctcctcctcctcctattgctcgggctgtagtgccctcgaaaccgtcaagcgtgtatcaggaaaccattcacgaaggggccaaaagtggcttcaattctaaagagtggaccagcggggatctcccacgctgggaaagttaaaaggagtc

SEQ ID NO: 625295 - DNA, 197 bp, Homo sapiens
ccggctagagcggtctccacgaaacaaatgtatcagcacgccttgcaataaaaaggatgaaggaaacaaacgcagtcgctctctttcttgctctgtgaaaacgttcacctcctccaaagcccttgtacagaaattacccagtacatacacaccaggagataaatccccagagtacaacacatctacgattcaggccc

SEQ ID NO: 625296 - DNA, 252 bp, Homo sapiens
tttcagaccgcgtctcactctgtcgcccaggctggcgtgcagtggtgctgctcttgtgctcactgaaactcatgcctcctgggttcaagccattctcctgcctcagcctcccgagtagctgggataacaggtgcatgccaccatgcccggatacgttttttactacttttgggtacgagaccggggtttacccactgtgggccacggcttgtcttgacctcttgcgctcacgtactctgcctgcctctgcct

SEQ ID NO: 625297 - DNA, 370 bp, Homo sapiens
gattatgttggaaaatttggaattttaaaggagtaaagactgtccagcatttggttttataatgtttgtcccccgatttttattaatgtaaaaaaaaccaatttttaaaaaaaagttggactttggcagcttttaaggaaagttggaggggttttaggattgccatcaattttcagcattgtgctatttggaaataagggttttgcttttgtctgatggtcggggcccctttttaatttttattttaaaaaactgttgcaccaaaatattatgttttttggcactgttcagcaaaggtaacgtgtgccctttatgtgtacccaaattcaaatttaagttttttgcaaaaaataaatgcttttaaatgtca

SEQ ID NO: 625298 - DNA, 611 bp, Homo sapiens
  misc_feature (10)..(10): n is a, c, g, or t
  misc_feature (41)..(41): n is a, c, g, or t
  misc_feature (67)..(67): n is a, c, g, or t
tgcccatgcnaattacgtgatactgtagcaccgcccggttngtgtatagaatcagtcgatcccccgngctgcaggaattcggcacgagggagcctgttttgtggctgtcatggacgcctgtgtccgcttcagtgctcttagccaagcccgggagcgcgtgtgtagggccgcccagtatgcttgctctctttttggccatgcgctgcagaggcatggagccagtcctgagttacagaaacagattcgacaactggagagccacctgagccttggaagaaagattctacgcctgggtaactcagcagatgcccctgagtcagacgagatgttcacctatcagacgatgtcctgagattctgcatcactgttaggcaccctaatcgaggcctgtactttgcctgtgacaatggcccgtgggctggaagactggactggctccccgggggatcaagagaagtgggccccgcgtcattcaggaaccataaggtttccctcatcatgaacatttaaggaggggcctccccccattgcctctgaacctatcgctcaagtcccccccttccttcgagcccctcagccacaccccccttttttccgctcgccccggccct

SEQ ID NO: 625299 - DNA, 1169 bp, Homo sapiens
  misc_feature (1169)..(1169): n is a, c, g, or t
ggacacggctgagtgcggagcccgtgcgtaaagatgctctgacctttgaccctgccgttcagctctagggcccgtgcagtgcctacactcatgaacacctcccctaggtcactggtgggcagtgaccctggtcatccttggccacttgcagagctattgatcacagacctgtgcgtcttctggcatagtcctaaaaggctggctatctgtacgccggaccggtgcatgtacacgagcgaatgtccgcaagcgtgagacagtcctatgggagggtacagcacgggcgagcctgcgaggcgttgactttgctggcttggcagaggaattcgtgcatgaactcccgtgtgactccttcatacagagtcctaccatagacagcatccttggtgggagtccgagccctgaaagactaccacgcctcacaagtctttcaagcgattccaaggccctagttaggttcccccttaatgatgtttaaccccaatagcaattcacacgtaagctggcgagtttggtacctttgacggttccttctaacacaatcccagagtatattatcagccccgccttaactggccctccaatatccgatttctacgactgtagacatgaacctgctgcccggatcctgtactcacgacgccgaaaacacatttggtgggatacattggctgtggtccttttcccaagcttcgaaatgtgaagactgggcgcgtgctctgtgcgacgtggtttacccactctgtcgatgtcctgcgcctgaaggtgtatccctggaccatcaaggcagtccctcgcggaactccatggtgtgaaacgctttccaagtgtgtcccgctagtgaaaacgccctggcgcatggcatggccctgtctcaggtcaatatcctttcccctacggggttcgaaaacccagccaatcgctcgaaggttaactgcttggtcgaatctgttgcccctgtgccacgcccctcgtatcacccacggcggccgaagcgacgtcctatcatactccgcctgcgatatagcgcacccccatcgttacagtccagggcgggccgttaaatatcgccccgctactcctctgctggcaagccctcttgcatacaatactcacaacacacgcagaactctaggcaactgatatgacgtagtgacttttggtctccn

SEQ ID NO: 625300 - DNA, 339 bp, Homo sapiens
ctgggcgcagcagctcacacctgtaatcccagcacgtacgggaatttgaggcgggtggattgcttgagccaggaattcaagaccagccaggcaacacagcaaaatccccacacctctgaaaaaaacacaaaattagccggtcatggtggcacaccccgtagttccagctacccaggaggctgaggtgggaggatggcttgagactaagattgcagtaagccaagatcacaccactgcactccagtctgagcaacaaagccagaccccatttcacagaaaaaaaacagacccaacactcccacacagtatgttctttactgtaaatagaagtgcggacat

SEQ ID NO: 625301 - DNA, 465 bp, Homo sapiens
  misc_feature (329)..(329): n is a, c, g, or t
  misc_feature (417)..(417): n is a, c, g, or t
cgatggtcctcagctctagctgtctcagccggggccaacttagactcaagggcagcaagggtcatctggtggcggggcacgggccccagcatcctcctcacccaggcgtccccgtagctccgggatctgccgttccagctgcggccgcccgctctcggcctgggctgagaaacggcgctcagctgacagctcgggggtcagggactctaccggcaggagcagctggcggtagcggtcatggagcagctctgagtggctcggctcctcctccagctcttcctccaacggccccaggcgcccctccagctgacgcttctcctccagaaggngtgccttgctaaggttaccatgggccacctcatctggcatctcatcccggtcctgctgggcctgccggcgagcacggtccgaggcggncagttcctccggcagccgcagcacctcaggctccaggtgaggaccatc

SEQ ID NO: 625302 - DNA, 572 bp, Homo sapiens
cgttttgatgtgagagatcgataagcgtgccggagtacagcaaccacagcggaataatggcgatctgcatatgcaacaaccaacgccacagcggatgcgtggagattcggcggatggcatcgctacaggccagcaatgccagcgccgcagccagccagaaaccactgccgaggctggtacgcgccagcgcactgccattttgcgccagttgggtcgccgcctttccagctccccacaccagcaatacgaagacgaattgcgccagaatgagtgcacaaatgctgccttttttaccgggaataaaacaggccgtcagccaggcgcaaccaacgcccaccagcatccagaccgtttgcggccacagctgccagagatgacgcccctcacccgaaactaaacgattaggcgcgtaacagataaacggcagcgccgctgcgattgccgtcagcaacagcagcagcgccagaacaggattaatacggaaataagtcacgggaaattacttcgctcaccctttttggttcaagtagccgggagccacttttttgcattcagtccttcacaagaaggtg

SEQ ID NO: 625303 - DNA, 206 bp, Homo sapiens
cgtttctcccagtgcataacgtccaggcgttcgccgacacgcgccgccgaatccagtccacgcgccttcaaccaggccacggccgcgccctgctcctggcccagcgcggcctgctgcagggtttccagcgaagccaggcgaccgcgcaggccgttggcctgcttgcgcagttcggccagttcgttctggccattgcgctgctgttc

SEQ ID NO: 625304 - DNA, 577 bp, Homo sapiens
  misc_feature (411)..(411): n is a, c, g, or t
ggagtaaaggtgctgcaatgatgttagctgtggccactgtggatttttcgcaaaaaaaaaaaaaaaaaaaaaaaaaaaaaatttttggggggctgggcgaaaaaatttttaaaaccatttttggggcgccgcggggccccagatggtaaggtaaacctgtcgccacaaccgggctcccaaggagaactcgtggcacagagccatatgcgctgggagttcccacccaattaaaaaaccgcgccggggggcgccaccccggccccgttcctagaaccaaacttcccacagtggagagtcaggagagcgagcacaacaccgggggggcctcctatccacacgagggacgggccccgacgcgagagaggccctgcagatcattcaaaaatataagcccccccggcccggggggtnaacccgcagaaacaagcgacagaacagcaagccaaaacacaggagaacgagagcacacagcccacaaacaaagaaccaagacaagccagaacgaaacagcacaacgagcgcagcaactcacgccgaccacaaacaccaaagccaaacaaccaaccaccagcctaca

SEQ ID NO: 625305 - DNA, 527 bp, Homo sapiens
tacccttattttattatataatgtacagatgtattgaaacatcacactctaccccataagcatgtacaattattatgtgtcagttataaaaaaaataaaaaatattaatctggccccaatgtataaaacagaagtgaatgaggtaattagaaagaagatgaataaaatgtttttataacagaacatataaagaataactatttcacagagctttatgaagatgatagaatatgtgtaaatattttgtaaactgcaaggtgctagataagtctaatttttattacttctattattatagcagagaagaggtaataattcctaagaggactagaataggatcttcatgcaaggtattttgaaggaaaacctaacaacgtttggattacatgtaatgtgagggataaggaaaacggaagggtctaaatgaggggtgtccaaccttttggcttctctgggccacactggaagaattgtcttgggccacacataaaatacatgaacactaacaaaagctgatgagctaaaaa

SEQ ID NO: 625306 - DNA, 490 bp, Homo sapiens
atcttggaaaggcagagagtcaaagagcccttcgggcccccgcaaaaagttccctcccagagtccttaagaagaaccccctggaaaactttagaatcatgttggagcttaacccatatgcaaagaccatgggccgggacccccttttttgccaggccaggaatcccaagctccgggtggataaggcagcttcttcaccagcggcccttccagcccaatccaattagaagggggcggttgccggccaaaaacctttggttggttaaaaaagaaaaaaggcctccttttgggttttaaaacccaaaaaagcctttggggggaaaaaaggccgccgcttcccagaaacccgccccttaaaaaaagcctgcagagaagaaaccttctcccggggggaagaagcctgcggcataaactttttaatttgttttttccctaaagggccaatccttttgggccgctttttttgaataaaggcctggttttcccggcca

SEQ ID NO: 625307 - DNA, 316 bp, Homo sapiens
gtcttgtgaaacataattctgaagctgaagaaactaaacagtcagacctccaggactaagatgaagtgagccgtgaggagatcgtgtcataagaatgcttctgtcgttggccgggtgcagtgctgtgtgtatctagttccagctacttgagaggctgaggcaggaggattgcttgagtccagaaagtggcagttgctgtgagtggagatcacgccactgctctccagccttggtggttagagcgagaccctgtctcaaaaaataaacaaaaacaaaatgcttctgtcagttaacaatctttattagagggttttta

SEQ ID NO: 625308 - DNA, 1012 bp, Homo sapiens
ggagagagagagaactagtctcgagtttgttttttttcttgggttttttttttacccctccttagctttatgcgctcaaaaaccaatttaaaccccccccccttttaacgggggggcggggacaaaagcaaaaacgcagaaagccagcctggtggtaaaccaccaggttcgtgtgccccccgcaattttatcgcccgtgattgggatattgggttttcacatcttgctcccgtgttggctgggagtgagagttgtgaggggtgagagccctcctgtggggggcactgtggccactgtggagcccccctttgggagaaagtctcagagagggggaaggtgggaaaaggaggcccaagtgttcgcggacacgtggatcttcgtggggagaccaggtggctgtggttccccacagaaagagctcccgtgagagagggcggaagagcgggaggggttgagggacaggggactcctaccacagacgaggtgcgttacagagaaaggggcgtgcactcagagagaggcgcccacacagagcgagaggggggcgctcctccagtggggtgtgggccctgtgaaagagttgtgcgcacgggagaggggggaaaaaggggggcatataaccgagcgtgttgtgttgctacacacagagagagggggtttccaccaactaagaaaggacgtgggggcgacaaagaggtggtgggaacagaggcctcttatccgagcaacaaaacatgttgtgagaggagaaaaagcgcgcgatgccacacatatatgatcaacgcttgcgaggagagcaaaacatatatgtgtgccacacgcgaccacctcagtcagagaacaaccggctcgtgcgccacctggtgctttcactacccgaagaggaaggcgtctcacagaaaagaaaccttcgttgtgtgggagaaaaacacccactccatgaggggggggaacacaacaaagggagtctgggacgtgtaatgaaaagagccccgggggggaccaaatgaca

SEQ ID NO: 625309 - DNA, 378 bp, Homo sapiens
gctgaccttgagtgtcccggggggtcgaggaaacgattgctctcaggtaggttctgcgtcccgaccgccggccctgactatggtcgcaggccgtcctgtccctccccgggactccgaatttctctcctcaaaggacagacaacagggctatgcgcttgttggcaaaatgcagtggccggctcccaaaaaccccatgtgtgtacgattaaaagttggccgtccccaggcctcccagcgcaaacttaaagagacagggcttagatgaaaaccaaacatgggccaagctgggcataatataacaacctaagagactttccggagcagcctgaaacagagcctgcgagaaacggggctagcaagagacatcccccgagtcct

SEQ ID NO: 625310 - DNA, 502 bp, Homo sapiens
tggggccaatgaggggtgattcagggcggaaggaaatagcctattccccccccggttttggaggatgggggcccgcaccaccctggggaagggggcaaccgtgtctttgaatatcgaccacgcaggggtgtgggatcccctattgtggatatggccccctatgccattgggggtcctgaccaagaatttggggggggggggggcccggttggctttttataaccccaactctttttgaaatccccccaaaaaaaatttaaccccaaagggggtcctctggttttatttttgtcaaccggggcaagtggccgcccaaattccggttatttttttcccaaatggttgggaccgggataatttgccaaagaaaaatgaaacttttttttttttggggttcccccaaaaccaattcaaagggttttggttttttttttttcccaattcccatttcaaaaggtttcaaggggggtataataaataaacttcccccctttttttgata

SEQ ID NO: 625311 - DNA, 156 bp, Homo sapiens
cctgaacttcacggaccattcaataacttttcaactacagtgctgcttacgaaatgcaaggaacttggagcaaagacaacagagggcatataaaaccaaatccggcaaccattcattcagaatctcggcaaacacggcttgggcggaagtggctca

SEQ ID NO: 625312 - DNA, 707 bp, Homo sapiens
  misc_feature (376)..(376): n is a, c, g, or t
  misc_feature (509)..(509): n is a, c, g, or t
  misc_feature (538)..(538): n is a, c, g, or t
  misc_feature (540)..(540): n is a, c, g, or t
  misc_feature (557)..(557): n is a, c, g, or t
  misc_feature (622)..(622): n is a, c, g, or t
  misc_feature (631)..(631): n is a, c, g, or t
  misc_feature (664)..(664): n is a, c, g, or t
cagacgttcacaccacagcacccggctgggcactagggtgatactgggcttggctttgagctccgtgcctctgtgccccatacgcccctcagatctctggtgacagtgcggggctgcctacaggacacccagggctccttgatcttttaggaactgcggcacccccgaagctgtgacaggtgcagaggcgctgccgtcctgggccgggcctcaccttccgccttgtgtgctctggcgccagcacccagtcccaagggcacagcggctgcgacttgcctctggccagggcaggtggtggtgtcatacccaggacgggaacccacacttgatgtcctccagggttttttttttttacattatcttaaggactgacagnctcccaccccatctgctcccatctgtccctaatttcatgcgcctccgcctgagttcctgcacgcatttcctgaataaacacacccctgtgccagtcagaacccgcgggggttttggaagtgagagcccagcanggcagctggccagggggcggcactgcctncngggagcaccggtgcccnggactctgcttctgaggcttgcctgtacgatgaaatttgataaatatctccaatcagaacccttntagtgtatntcttaaatataccagaaactggtgtctttacangactagcttgcccggtgatgacacctcgagccgcggggctcgc

SEQ ID NO: 625313 - DNA, 245 bp, Homo sapiens
aaaaaaaaaaaaaacccccgggccccccaggggatgcctttttagggcccccttttttcaaattgccctttttttttccctgggcccccggccccggtggggtttttttttttttggggggtttttttaccaagcccccctttttttttcccccgggtttggggctttccccaggttggtttggggggttttttttttttttttttgggcttttttttttttccggttaattacccccctggcca

SEQ ID NO: 625314 - DNA, 290 bp, Homo sapiens
gccggccccatgagctcctggaaagccagatggaggaggggccttggagcctggccaggagcccagggcctagtggggcccagggaggcggggagggtccaggtgttgacctgcctgccccagcagccaccatgtcaggcccactggtccttccctcctcgggggtcacccagccttcagacaaggctgcctcacacatgggggccgcacggacttggggctcctcgttgtatgagaagatgacctgcaggtcaacagttacaaaaacagcctaagtcatacacgctccc

SEQ ID NO: 625315 - DNA, 169 bp, Homo sapiens
aatggaggcagagctggaggacgagaggaagcagcgctcgatggcggagtggccgcccggaagaagctggagatggacctgaaggacctggaggcgcacatcgagctcgcgccgaacaaagaaccggagacgaagctcatcagacacgcgtgcggaacgctgtcagggc

SEQ ID NO: 625316 - DNA, 632 bp, Homo sapiens
ccaaaaaaacagccttttaattccattcaaggggttttctttttaaaacccaacaaaccctttttttacatatggggctgggttttccaaaacagggggaaatttaaccaggtttttttttaaggcccttccaaatgtaaaccttggggaccttttaaggcctggcctaaaaatggtccccattttcggggaaacccagggggttttattgggaaaggggccatattccccatccgggggaatataattaaaaggggttcaatttacgggtttgttttaaggtccaagaaacccccaaggttaatacctagaactttgggcaaaatcataggggtctttttaaactaaggccccattatttaatgttttcccagagaagggagagggttttaaagattttatgttgccccatgttttttaaggggttctaaaatataaaaccagagtttttttttggcctttaattaacactaaggttggcgcgggggcttttataggaataactaaaatggatcaggagaagggccctcaaccctgtttttttagagcggaaaccccaagaatttttttcatttttccctgtcgtctattttcccttaaaaaaggtttttagggagatttttaaacggggg

SEQ ID NO: 625317 - DNA, 4580 bp, Homo sapiens
ggactcaggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttccttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttacggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtgtgtaaacaattgggatgtggaaagcctatgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgtta

SEQ ID NO: 625318 - DNA, 4652 bp, Homo sapiens
ggactcaggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttccttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttacggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtgtgtaaacaattgggatgtggaaagcctatgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgttaaaaaaaaaaaacaaacccccccacaaatcaaaaatacacacccaaccccacccccaggaaggaaaaacaagg

SEQ ID NO: 625319 - DNA, 246 bp, Homo sapiens
atgcccagacattcccgagctggccgtccacttccaaccccccggaccgcaggcagtgcatatccacttcgcagcaggtgagccctcctcctggtgaccctgctaaccttttccagactgcaccatctctttctagacagagggcatggctgtgtgtgcacctgtgtctatgactgggcgttgacatggagggtatcagtgcgcaaatgggaccgtgcacggggctattgtgacagagcatgcctg

SEQ ID NO: 625320 - DNA, 4868 bp, Homo sapiens
ggactcaggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttccttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttacggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtgtgtaaacaattgggatgtggaaagcctatgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagaatcttgatatgtgggtgatgttaagccctcctgacccagcaagttgaaaactcaccatgaagagcagcggtcaaaggaactagggaaatcctacagtgtgatcagtttttctgctgcaggtaagcagagagcatccctttgcactgaataggccactgagccgcattactgcttattaattcctcatcattcctgcctccttttatgttctccctaaatgactaggtttgcggggccaggaactttatttcccacaatccctaacaggaagaatctgggctcgcttccaccagagagacttgttcatggaagatacggtttcgcagggatcctttgtacttgttcctgaaaactgtaggctaatattacagctgggtgcctttacagtggtttcctggggggtttaaacttccggataagggtttggaacctattattccccgtgttaaccccttg

SEQ ID NO: 625321 - DNA, 493 bp, Homo sapiens
gtctcatgttgtcacgaatacagtctaggtagttggtaaccttgagtgtacacacccggggacatcttctgtccacagcccaggtcccagctgatgatgcccaccaaagtcatgcggccatcgttcagacacaccaggggcctcccgaatcgccctggcaggcgtcgtgcaagtttgcctggggaccgcccgatccaagtgtctccagcacacagcatgtagtcggtgactgtactgttaactaaatcttgtgatgtgcagcggcaggatgggtacagtctgacatgagcctccttacagccgctccgaatagaaaggagactaggcctcatgcttgccggtagccggagagctcacaactccgtccagtaccggcagctgcaggtgtccgccgggggaatggcacacaggtggcgggaccacgctgctctcctgggcacagggtgaacgaatccgatatcaagctgcagcagcggaatgtcatttgtccgta

SEQ ID NO: 625322 - DNA, 1021 bp, Homo sapiens
ccacgcgctcgccctgaatggaggccctaaatgggagcagactgggaaactgggctggaggactcagtgtggcgaggttggatggaccctggggtgtggtctaggaattttggagaggaagtggaagactctgagagcagggcaaggaatcctgggggctgaattgactgggagactttgggggatgggtctggagaccgtcggggtggtcctggaggacctagatggtatgtggctgcagtgaccctggcccctggcccctggtcctagggtggtgcctgtgggaatcctggtggcctggaaggatgggatcctggagcggggcttggaggccaccgggtgggactctgagggtcgacagcgttaagttccagccggctccacccgttcacagaggacctgcgcttttcagcgtagcgcgatctgctgtggctgactgtgccacttgcagggctgtgctcggctggctgccctcaccatcccttgccacgtccactacctgctggccacctgccgagcctgccgggcttgtgctgggctctccgcgggtcacgtggactttcctgtcccgggggccgggacggcagaggtgctggtggcgcggggagtgcgcgtcaaggtgaaccgaggcctaccggtatccgcgtgggcaactgcctgcgtaccccagcgtcggctcaccgacgtctccctggcgctgagctgagctgggcccaacgaatcgggtatctacgctgtgaagccagcacggcaattgagtacagacagccgaccgctatggcagccaagggcacacagggcaaataaacaccaccggagacgggctccgccaggcaaggacatccccacaccccgcgggcccacggaccgcatgtggcccgcatatgcaccccaaaatggccacccgggacacagacacatagcggcccaacctgaggcggaaacgccacgtaaacacccggcaactacaccaccaccaacgaggcaacaacagacacacaagacacggctaacacccgct

SEQ ID NO: 625323 - DNA, 396 bp, Homo sapiens
taatagtcacctcttgctctattatactttcccagctgatcaaacactgcacttaacagctcttccctctgcagagaggttttctactattcaataatacagattttgcctttctttcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgtta

SEQ ID NO: 625324 - DNA, 451 bp, Homo sapiens
acgaggtcaaaaggatcacatgaggccaagttttcaattcttacactgtggagagtcacaaacttgtgtgggagaggcctgcacagtacacgcctcagacattctcccagatcctgacaacctgtgggcatgatacatctaatgagtcttagcactcatgtgaccatcaccggcaagacaacgatgatgaaacttgcctgcctaaaatcagtgtgtggttcacaacttcgacttggtaagaaacatcctctctcctggggtcatatcaacactgcaaagctggtgggagctcactgctgtgacccccatatactcctctctcggcgtctctatcctgctactttctctgactgcatcttcctctgttccttggtcagtgtttgagaagagaatgttgaataagtcacatccttgtcactctgagtcagaaccctcatttgacttggaagat

SEQ ID NO: 625325 - DNA, 4681 bp, Homo sapiens
ggactcaggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttccttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttacggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtgtgtaaacaattgggatgtggaaagcctatgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagaggtgagagccccactaggattgtataaaattttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgttaaaaaaaaaaaacaaacccccccacaaatcaaaaatacacacccaaccccacccccaggaaggaaaaacaagg

SEQ ID NO: 625326 - DNA, 165 bp, Homo sapiens
  misc_feature (40)..(40): n is a, c, g, or t
  misc_feature (124)..(125): n is a, c, g, or t
ctcactgctggcctgtgcaagcaaggtgctgttcctcctntgcctttccaccatgcattctccagtttcctgcaggcctcccccagccaatgtggcacacggtgcagtccaattcaacaccctnnctttcttgggccagcccaagggggcatccgtctcagcagt

SEQ ID NO: 625327 - DNA, 413 bp, Homo sapiens
  misc_feature (212)..(212): n is a, c, g, or t
  misc_feature (276)..(276): n is a, c, g, or t
  misc_feature (339)..(339): n is a, c, g, or t
  misc_feature (348)..(348): n is a, c, g, or t
gggttagagccccagaccccaggggtgccccagagaggaaaattggggagggggatgggctagggagcctctcgcctgcctctatctctctgtttcttcccattctctttctaagtctctgtctctgtctttctctgtctctaggtctctctgagtccctttttatctctgactacctcttttgatcctattggtcccctttctcttgtttntctctgtctctttgaatctacttttatcctgtctttctttcctctctctctctctctaagtctntttgtctctctctctctctctctcttttttggcggggggaaagtctccctctgtctccaaggntggaagtgnagtggtgaatctcgggtcactgcaacctctgcctcccgggttcaagcgattctcctgcctcagct

SEQ ID NO: 625328 - DNA, 356 bp, Homo sapiens
  misc_feature (258)..(258): n is a, c, g, or t
ggacaaagtagctggtataataaaaaaagaaactaactgatctgaaagcgccaaataacacaatacaagaatttcacaatgcaatcacaagtattaacagcagaaaaaaccaatctgaggaatgaatctcagaacttgaagattggttctctaaaataagatggacaaaaataaaaaagaatgaacaaaaccttcaaggagcatgggattatataaagaagccaattctacaaatcactgggcatctctgaaaggggnggtggagaaatcaaataacttgggaaaacatttcagggtatcatctatggaaagcttccctaaccttgctgggatagggcccacagtccaaatttcag

SEQ ID NO: 625329 - DNA, 202 bp, Homo sapiens
ccaggtgggcatggtgggtctcgaacaccttgacctcaggtgatcactgggcctcccaaagggctgaggtaacaggtgtgagctcctgcgcccagctgttcacaagtataggagacggcttggagatgaagaaaaaatgtcttaatatctatagctaaagttcagggccgtgtgctgtaggatggggacttcgcattcagtg

SEQ ID NO: 625330 - DNA, 231 bp, Homo sapiens
ttaaaaccccccccctaaaaccccacccctttgttgtttttttccccgggggttttcccttttttttgggggtttttttttggggggggggggttttttccccccctaaaccccccctttttttcccccctttttttttttttttgggggtggggggggggggggggttttttttttttttttgggggggggggccccaggggaataaacccgggggggtggcccttttta

SEQ ID NO: 625331 - DNA, 428 bp, Homo sapiens
tttggagagacgggggttcgcgatgtcggttggccaggctggtctcgaactcctgacctcaggtgatccaccaacctcagcctcccaaagtgctgggattacaggcgtgacgactgcccccagcctgcttaaccattcttaaatgtcgggtgcggtggctcacacctataatctcaacactttgggaggctgaaggtgggcagattgcttgagttcaggggttcaagaccagcccgggcaacgtggtgaaaccccatctctataaaaaatacaaaaatgagccgggctgttggcaagcgcctgtagccccagctacttgtggatgctgaggcaggaggcttgagcctgggaggtcgagactgcagtaagccaagtatctgtgccgctgcactccagcctgggtgaccacagcaagaccctgtctcaaa

SEQ ID NO: 625332 - DNA, 108 bp, Homo sapiens
gctcaatttctacacgcttaccatctgcctctacttcaaaggctacaatctcagatgaagagattgaacggcaactcaaggctttaggagtagaggcagatggtaagc

SEQ ID NO: 625333 - DNA, 139 bp, Homo sapiens
tattcggaccgaagtcgcggtcaccgttgggcatgtccccctctcctctcttctccctggaatcttgtaaaggtcctggcactgatgatcagtatgaaaatgtcattgttcttgtgagcctaacggtgaccggcgactt

SEQ ID NO: 625334 - DNA, 171 bp, Homo sapiens
ggtgcttcatgttgaggagctggctttggagcgcgaatctgtattggctggggggctcacagaggatctccattggagggggcagctgttgcatcagtggcggctattgcagcacgaagcggaggacgataatggctttaggtggcgccggggaagtcggactttggattc

SEQ ID NO: 625335 - DNA, 168 bp, Homo sapiens
  misc_feature (5)..(5): n is a, c, g, or t
ggtanatgtcattctttgtggctttcttcttgattctgtgggggtgtataacaaagcctgaaggacatagtaatcatttcttacaaggtgcaaattacagaaagattgtgtatgagagcctatatagttgttttatccacttatcatctcttgatttaagactttaaa

SEQ ID NO: 625336 - DNA, 579 bp, Homo sapiens
gcaaggggaattagagaatatcagaccaaggacaggtgaggcgctggctgtagtggttgccccacagtacattaaagttaccagcagagcctatcacacgtgtggggcgagtattggagtgaggtgacggtaattgggcttgatactgggcgactgcctataactgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagcca

SEQ ID NO: 625337 - DNA, 99 bp, Homo sapiens
gcggccgactactactactactgctcgaattcaagcttctaacgatgtacggggacatgtgcacgttttctgtttaaataaatgtaaaaactgcaaaaa

SEQ ID NO: 625338 - DNA, 221 bp, Homo sapiens
tttgagatccccatccggcgaggcagtctcgaactcctgacctcaggtcatctgccctcctcggcctcgcaaagtgctgggattacagggatgagcttctgtgtctagcctattttcccgcttttatttattttttattttttcgagacagggtcttgctctgtcgcccaggctggagtgcagtggcatgatcatggctcactgcagcctcaacctcctta

SEQ ID NO: 625339 - DNA, 295 bp, Homo sapiens
ggaggctaggacagataggtgccgataatacgtattgaattcaacacaccacaatactatgcttggcaaggttagggaggctaggtggtagtttgtgtttaatatttttagttgggtgccgatgaatagcgaggtgccgataaatactattcatcggcacctcgacaccatcccaactcgctattcatcggcacctcgctatacatcggaacctcgctattccaccattagctctagaggtccatgcatacttaatattataattgaattcaataagggtgccgatgaatagcga

SEQ ID NO: 625340 - DNA, 144 bp, Homo sapiens
atgtatttgtgatgtcatgtgcagaaagccgccaatatgatgttgacgtttgtttggttctctccaattttcatgttaagaaaacaacagatgctataaatagtacgaggacacgatgagctgcgaaactacctttactccctc

SEQ ID NO: 625341 - DNA, 125 bp, Homo sapiens
tctttattataagtttagtagcttcatcttgctccctgtgatctgtgctaggtgaggtatcagggtcttctccgattacggaatatattgccactaatgcaaaacacgctggcctacagcacatg

SEQ ID NO: 625342 - DNA, 433 bp, Homo sapiens
  misc_feature (417)..(417): n is a, c, g, or t
  misc_feature (426)..(427): n is a, c, g, or t
tgttgtcctccccatcacgaattcctctccttctcctaactcaagaacaccaatttgggaagctcttgaatagataagctatcttttctggattgccaggaagtggaaaatggggtgggcgtgtgtgtgaggggaattgggcagtgaggagtaagtgagggaaaactttttagcatggttaataggtcaggagagcagcgcaaaggtggaaaccaagcatgcccaatccccagagcaggacaaatgggctcctgggccctggtggagggttcactttggaaatgagtaggagcagtttggtctcagaagcaatcaacatcccctccaccccaatttttttactccgtttcagatgattaattttcaaatactgtacaaattttgatagcttaaattgtgtatacagtcaaataaaancttgcattnncaatta

SEQ ID NO: 625343 - DNA, 148 bp, Homo sapiens
gtatcactaagctcgctttcttgctgtccaatttctattaaaggttcctttgttccctaagtccaactactaaactgggggatattatgaagggccttgagcatctggattctgcctaaataaaaaaacatttatttttcatttgcca

SEQ ID NO: 625344 - DNA, 321 bp, Homo sapiens
tcacttataagtgggagctgaatgataagaacacatggacatttggagggtggaaacacacactggagcctgtcagagggtggggagtgggaggagggagagcatcagaaagaataactgatggatgctgggcttaatacctcggtgatggaatgaatctgtgcagcaaatcaccatggcatacatttacctaataaacctgcacattcctacctatatacccctgaagttaaaatattgcaaacagaaaaaaacaaaacttttttgttgttggttttttggcatttctttttaggttcagtttcattgagttctgctctg

SEQ ID NO: 625345 - DNA, 409 bp, Homo sapiens
ggttggctcttgcacttcctggctctctggacttggttatgtgattgagcctccatggcctccgtgtctttgtctgtcaatgggtttgattaaagcgttgacctcataggttcttaggaggattaatgagaacattttatgtaaagctgcttacatggagccttggtatgtgccggaaagctttagccctttattaaaagtgacagcagacccagcacggtggctcatgcctgtaatcccagcactttgggaggctgaggcgggcagatcacttggggtcaggagttcgagaccagctactcgggaggcagaggcaggagaatcgcttgaacctggggtgcagaggttgcagtaagctgagctcgcaccactgcactccagcctgagtgacagagtgaaactcagtctc

SEQ ID NO: 625346 - DNA, 214 bp, Homo sapiens
ttgcaaactacacaatgctgcaggtgcttcccaggggccacaggctgtcaggaaacgtgttttatgttaagtcacaaacccacttgacttcttggtacttgaattaataccagttggtgagacttagggttagtgtagttagtacatattaatatctctgttgttgagctttcagactatccccgtgcacaagtgtttatgctatagtatgtga

SEQ ID NO: 625347 - DNA, 595 bp, Homo sapiens
attgtcagtcgggagcgttgtacaggctacgataggtgcggaatgagcagacaggtggtaacaagtcagagctcaggagacaggtctgaaccaaaatttgggtagtgatggcaaccatggcactggccggacgagatcaccaggagccttgcatgttcttaattgccatctacaaggcaattaaggtggtgtgcttggagaagtaggaggaaaaccaagagggtgtagcttcccagaagccaagggaaacagcatttccagaaggaaagaatgagggaattatagaccatgatgtcaaaggtcaaagaatgccaggactagaaggtgttttatggacttagcaccatattcactgggttatgggtgctcgaatacacaggctcagatgtctgatggcaagaaggtcagggaaaggagaaagaaggcactttggtgagaccggcaatgaagtaggagaagagcaaatggctgcaggggatgtggcctagaaaactggtagagaactgagcatgtcccaggatggtgccatggaggccacaggccacatgaggctgaagagacagagaggggctcatggcctaagtgctgcccctag

SEQ ID NO: 625348 - DNA, 392 bp, Homo sapiens
gatactatctcctagcctaatgctcactaagacaagtctcctggatgctccgtgcagactcatcattcaaaatatgccggtgctaatcgccagctgctcctagaccaccatttagtactatgagaacagcttcttcacaggttcacgagtcatgtcaacacaaggggtggctaacaaatcaacacagacaatgggttccacgtctgcagctgaagccgctgcagattactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcag

SEQ ID NO: 625349 - DNA, 392 bp, Homo sapiens
tcagttcctggctcccaaggtgagtggccttgggattttggggaggggtgttgaagactggaaagaggactatggaatgaggtgggtggagtcaagcctggagcctgagggccgggcgtggtggctcatgcctgtaatcccagcactttgggaggccttggcgggtggattacctgaggtcgggagttcgggaccagcctggccggcgtggtggaaccctgtctctactagaaatacggagattggctgagtgtggtggtgggtgcctgtagtcccagctactcgggaggctgaggcaggagagtcgcttggacctggagggcgggggttgcagtgggccgatgtcatgccgctgcactccagcctgggccacacagtgagattccgtctca

SEQ ID NO: 625350 - DNA, 294 bp, Homo sapiens
agcctaattacggaatcgatgaggctgaccttgactacagtaagaaggttcaagataagttgaaaatatgatcagcagatatgcacagaattccctgaaattgtaagatctcagcaaggtcggctatgtgatcaaaatgatggggtttcagagccactccatcccgcggtgtagaccccaaaggattgaaatccgcatgaaccgtcatggcggctttatccgcaatagcccagcgatggcaaccacccaaatgaccatcactgcacagtaaattgttattctgcatggcaaagg

SEQ ID NO: 625351 - DNA, 552 bp, Homo sapiens
  misc_feature (41)..(41): n is a, c, g, or t
  misc_feature (43)..(43): n is a, c, g, or t
  misc_feature (45)..(46): n is a, c, g, or t
  misc_feature (50)..(50): n is a, c, g, or t
agcgcgttattcgtcgtgactgtttaagcatagcgagtctntntnnactnatcgtaagttgcagcacgagcggcttcgccgcccaggggggtgacgagattccgaccgataagtaccagtcccgcgcgagcttgtccatcctggggcgaagcagattcggggacgtcgacttgtcggctggcccacacggctcggactagagtcaactccagctgctagctagaactgtccgcgcttacaacgctgtgagtgataaaccttgtgctggtatatcggtgctgctctgttatacaatccttgggtaaattgcaatcttggcttattcatgtttaaaaattccatgtgtaaaacatacgtttgtaaatacctggggacttttattgggattttcgtttgtgatggcggattattctgtaaagggttgctaagttctactgttgttctattgggtctttttgttatcatatctgttatccttgtttataaagtgggtctttaatacttatctatattatgtccttgtattggttgttgttgtgtctatatcttatg

SEQ ID NO: 625352 - DNA, 1797 bp, Homo sapiens
  misc_feature (453)..(453): n is a, c, g, or t
actcggttcgtggttgttgcaagtgctccttgattgattatatctatcggtggtgtgtctggatcgtggttgttttcgcttccgcgtcggtatctgtgtgctggtgctggaacacagcccaggttgggggactcctgtctctggtaggagtggtgccgcattgtgggctcgctgttgtggatctgcgccggttgcgcccggttgtgcatctgttctggatgaacccgctgggtgttgtgtgtactcacaccgccgtgtagtggggtgcgccctctgtgttgtgttgtaggtcccgcctcacctctcgtggtgcccgctgccgcgatgtctattcgtggtgtgtactcgctggtttctggagctgtgcccgcgggcagttctgatgactatcattgttaggactgtcttatgatgatcgccgaatgttctgtgtcgccgcgaaggtgtgtgaancgaccgcgtggggagggtgaatatatctccgccccgcatggacaactcgcccctgtgaatggctttccacacaacggtgccccaaggtggtgctgatatcgccttgacagtgtgtgagacatcaaagtgggtgggacgaaacagaaagtggttgtcctctgtggtagacaaagtgttagttagaggccccgcgccgcacgttttagggttgaaactcttgggggtgttcgccacactttgtaagtgtgtgtcctgaaccccgcgttttggtttgtggggaccttttttacgcctaatgacgtttttaaagttggtaaacctgtttttgtggggttgagcctgcctgtgttgaacaagaaaggaccgcggtgtgttgtagcattttctctggtttaaagcagttttgttgtaaaatgttgtgacgaacggagtggggaacccttggctctggaaaaaatttgggtaattaagggaaccacccgtggtgtcctcttatatttagaattacgtggcagggtacaaagaaaataagtctcttatggactacggacggccccaccccgcgtgtgagaccccccaactggagacgcacagaagattgtaggaaattgtgggaaataattttcgtcttgtctgaaaaacaactttttattagaaaaaacatgtgtgtatatagctcctctttctccggcactgctttaaatatatattggtactaaaaacactctgttgtgtttacgccacagtgatcttcccacacacattttgttttctccacacctcttatatatagaccatagaaaaaaaataatgtgccgcactcggagaacccactcttgggagacctcgagtcgaggccacccacgggatctttcccacgtgtggagagatgttttgtgtgtgcacgctgctgttttgagggcactgggctcagaataatacgcactttctgcgaggtgtgtacacataggtgtcctcgtgtgtagattgggcccactctcactataatttgccaagcacctatccacctcggtgcacgcttttctgtggtggaatataggaatataaaaaatatggttagcctcgccacagtggtaaagtacacgcaccacctgtgcacaatttctgtgttgcctctataaggggcaccacgtgataatgtaccacgatagttataaggcccctcgttttgtaatgtagtaccacttttctaatctattattcctcaacctacttataacctcgtttcgcacgataagaaaagaattcttttctaataaatctgtaaaattatgcttacttctaaccagtaggcttctaaattaaattttttaaaagacccca

SEQ ID NO: 625353 - DNA, 118 bp, Homo sapiens
ctaacctacttacatttacatggatagaagtgaggtcctactgtacagggaactgtatgcacctcatggatagtacatactgaagatggtataagaaaacgaatgcgtcgagaagctt

SEQ ID NO: 625354 - DNA, 815 bp, Homo sapiens
tcaaccccgtgtcttccccgccgccttgaggaccttttctttagttcagaacgaaccttacgggcacccttgcccgccctttagagtagcccccggggtcaccctccacctcggaccccctctcaatggggagagactcttgtttcaagagaccccctcgagcgtgaccttctgtggctttgttaacagcgtgttccccatttcctctcccggctgttccgcgaaaccctgggaccactcggggagcacccttcacatgcactgctgccttaccccgcagttcccagacccccctttccgccccccctttccaaatatcccggtacacctattccgcgcccgcaggtccccctcggctgccctcccccccttcgggaggagactggcccctgaacgcagatgtgtgaccctggacgtgcctggcacgcggcgcttctagcccccaggaccgtgcgtggggtctgctggctgccagggtctaacagaactgcccccgcgagaagtacacctgacttggcccatctccgccaagagccccacacccagggcgacccacccacccttctgctgtgacccacgacatactgcgcgtggcacacccgaggactggaagaaaggggaaccacccttcttcccgcacaggggggccccgcaggccccgccccgcgccctcaacccccgaagaccctcgacccccttggcggggaacccccccccggccaagggtctgtgtcacaggcggaggtggcgccccccgctactgagaccccccccccggccccccccccggattactccccgctcccccccaaaaa

SEQ ID NO: 625355 - DNA, 672 bp, Homo sapiens
  misc_feature (118)..(118): n is a, c, g, or t
ggcctttgaaaggactaatcagacacacacacacacacacacacacacacacacacactcgctatactcatgcactattttcctatcattctccgaagatccatattatcttcgaagngcgacgccctaatttctcctcgtggttattcatggatgacatacaatgtaccacaacactcgttggcgacgaagatatgtgtcgagcttcaccgtgcgtgcagggcttcgttgtgtagtgaggcgccattcagtgcaagcgggtataatctttcatcaactatacaacatgaggagacagctattgttgtcgacgaacatcagtgccaagacgtggcgtgttcatcagcagagagccagagtcatttaaaagatgtatatcattatcatgtcgtaggaaaattgttgagagcatattaccacaaagagttggaaagttcacgcgcttttgcaatcagaaaagcagtgtgatttgagtgaggtcagggtgggatcacaataatcaatatcatatcatcataatcatacattcaattaaacaaagaagaacaatcggatgtcatgacgagagagataaattgagacaacagtgcgtgctgtggctaggataagcttccatcattacttcaacactgattttataaacagccactaatagagaggattcatcatcat

SEQ ID NO: 625356 - DNA, 99 bp, Homo sapiens
gttttaatagggactaatgtggaggacttgctaatttgtcacagtcttaggtacactgttaatgtgtaacctctgttagagacaactgtggtacaaggt

SEQ ID NO: 625357 - DNA, 861 bp, Homo sapiens
ggccacccagtgtaataagaggccgctctggctgggtgttgtttctccgtgtgacgtgtgtgcctttgagatcaactctcctgtatccagctcgtgatgcctgcatgagtggaggggcgggctcccgcgtgtcctgcatcggcgaaagatggtgacgttaccggatccctgacccgaaccctttccggtcgcgtcgacagccgtcgtagccagctacctctgcacgcctaagaatacgcaggagggttggcccctcgtgagtgtgtgatgtgaaatgagcgattagctttattttccaagtttctctctcaccttcaaaggagcaatacatcaggcgggtgcagtcaggacgcggatgggcagacgcctcgacgagaatctaaatcctgaagtgcatttccccaggtgattgtaaactttccatgagggcatagtatagtgacgggaggatgactccgacataactgcgcatccttgatacaacagagggcacatctaatgcgtccccgttgatacttacaatcgtacttgggaagttgccggggcgcttagacttgcgctatgtttggcacctgtccccggaccctttttatagggtaataggccttcagcgcgcccgggaaaagataagtattgggttagaaacccgagtttgggccgcttcccgttgggaaaaattgcctccttacacaggaacaccccaaagagcaacgtaaaggcgcgaggggacgttacggtgaaactataccctggtgcctatcttgtggcttaagcagagtccctcaagaggggcttccggcactcgttaattacaagacccgtctttggtataacattgtggcgtacgcggaaccggaagcg

SEQ ID NO: 625358 - DNA, 228 bp, Homo sapiens
cgatccttctttgggacggcggtgtagatcaagagatcgcgaagtacggggcgcaggtcaggtggcggggatatgctgcccactccacgagcggcatcacatcgctgcgtccgagtctgtcacgagtgtgtcaagcagatttgcctgtcatgctggagacgctctcccagtctccgcaagggagagtcatgaccattccggtaccagcccacgccgcccaaagcacag

SEQ ID NO: 625359 - DNA, 910 bp, Homo sapiens
  misc_feature (13)..(13): n is a, c, g, or t
  misc_feature (16)..(16): n is a, c, g, or t
  misc_feature (32)..(32): n is a, c, g, or t
  misc_feature (51)..(51): n is a, c, g, or t
  misc_feature (60)..(60): n is a, c, g, or t
  misc_feature (70)..(72): n is a, c, g, or t
  misc_feature (75)..(76): n is a, c, g, or t
  misc_feature (87)..(87): n is a, c, g, or t
  misc_feature (92)..(92): n is a, c, g, or t
  misc_feature (100)..(101): n is a, c, g, or t
  misc_feature (119)..(119): n is a, c, g, or t
  misc_feature (137)..(137): n is a, c, g, or t
  misc_feature (142)..(142): n is a, c, g, or t
  misc_feature (147)..(147): n is a, c, g, or t
  misc_feature (171)..(171): n is a, c, g, or t
  misc_feature (176)..(176): n is a, c, g, or t
  misc_feature (181)..(182): n is a, c, g, or t
  misc_feature (201)..(201): n is a, c, g, or t
  misc_feature (205)..(205): n is a, c, g, or t
  misc_feature (212)..(212): n is a, c, g, or t
  misc_feature (217)..(218): n is a, c, g, or t
  misc_feature (301)..(301): n is a, c, g, or t
  misc_feature (312)..(312): n is a, c, g, or t
  misc_feature (314)..(314): n is a, c, g, or t
  misc_feature (321)..(321): n is a, c, g, or t
  misc_feature (390)..(390): n is a, c, g, or t
  misc_feature (399)..(399): n is a, c, g, or t
  misc_feature (454)..(454): n is a, c, g, or t
  misc_feature (461)..(461): n is a, c, g, or t
  misc_feature (466)..(466): n is a, c, g, or t
  misc_feature (509)..(509): n is a, c, g, or t
  misc_feature (530)..(530): n is a, c, g, or t
  misc_feature (538)..(538): n is a, c, g, or t
  misc_feature (548)..(548): n is a, c, g, or t
  misc_feature (714)..(715): n is a, c, g, or t
  misc_feature (825)..(825): n is a, c, g, or t
  misc_feature (909)..(909): n is a, c, g, or t
ggtgattccgctnctnaagaggggaaggcgcnggtgtggggggtggggccnaggcccatnctgaggggtnnnagnnatgaagggctntgagntgtagatnntggggtggtctagaggcnatggggaggttctggatnatgtnttganaggtctgggctgtgtggggggtcnaggcnatgtnntgggggtctgggctgtgtntgtngggagtnagggnnatccatgtattgggggtctggggcaggggggggtccaggctgtcttggggagtccgggctgtgtggaggggtccaagttatgnctttggggatnangcctgtnggaggctctgggttatgtcttggcgggggtccaggctgtgtcttaggggctgggccatgttctggggangtgtgaatnctggagggtggggccccggtctcgcgggtggctgtgtccctcgaattcaggcagnacctctnggaantttctggatttgcgtgctggcgtctgtaggcctcgatacccanaggctgcgcccctctcagcanaggaagtnctggagaacntgaaggaccgctggtaccaggcggacagcccccctgcagacctgctgctgacggaggaggagttcctgtcgttcctccaccccgagcacagccggggaatgctcaggttcatggtgaaggagatcgtccgggacctgggtgaggctgggtccagcctggccggcanncaggacccaggaccgactggcaggggccgggcatcgtcgggaggtcggggcaggtcctgcgggagccccagcctgggtgtgggctgacccattcccgtctcgcagaccangacggtgacaagcagctctctgtgcccgagttcatctccctgcccgtgggaccgtggagaacagcagggcaagacattgacgana

SEQ ID NO: 625360 - DNA, 369 bp, Homo sapiens
gggtaagccgttgctgggttctgatctgagatgtcctgagtctggctagtgtacttcctctcgaatcgtgggaaatgtccccctccttggtgctctgttgcgttacagaagcagggagctggataagccatagctcgctgccctgaagtattgtcggcgcgtagttgctcgacgtggtatccggtgccactcaaaggctggattgggaatagcagacaaggcgaattgatgcagctggatgatccgtcgagaaggaatgctgtcacggggaagccttcggccgtggtgtccccgaggttcctgtcgaataccaaccgtgtcggctgttatgggggcccagtggtggtggctgagggaaagcgtgctctc

SEQ ID NO: 625361 - DNA, 382 bp, Homo sapiens
caattcgcaaaatgtccgcaccatgtgttccatctattcgcccaagtcatgaaaaaaaaaaagatgctccgtccatggcgcggttgacctttttcagatcatgtccccgtacatccgtgcttcttccatgagagagaagtgcccagatgtgtcatgtccccgtacatcttcgtgttttccatgatttggatctccgggccgagcccatggcccccacacagtagagtatccccatgccactgcggagcgagcagctccccatgctcaacaacttcaacgtcgaaggcatgaaaattctcagatttagttagacatgtctaactaaatgttggctgaagccatgaaccactaatcctcaatagggacatgtccccgtgaatca

SEQ ID NO: 625362 - DNA, 171 bp, Homo sapiens
gacatgtaaggtgtctaagacctgtggacagctgacctgctgaccagtgtgatgtcacatgcctgcagaggtctgcggggaacaaatgccagagcttcctggagccaggatgggaagcgtggtcaaccaaccttgccaggtcgtgccggccccaataacgttgcatgggtg

SEQ ID NO: 625363 - DNA, 123 bp, Homo sapiens
gcgcagccgcaccgtactgtaacatagatccatgatcgatgtctgtaggctcattgaactgtcctctatcatagcagtgaagtccttgcgtatgctcgactattaaattacgccccgcgcctg

SEQ ID NO: 625364 - DNA, 731 bp, Homo sapiens
  misc_feature (57)..(57): n is a, c, g, or t
  misc_feature (59)..(59): n is a, c, g, or t
  misc_feature (62)..(62): n is a, c, g, or t
  misc_feature (69)..(71): n is a, c, g, or t
  misc_feature (75)..(75): n is a, c, g, or t
  misc_feature (79)..(79): n is a, c, g, or t
  misc_feature (84)..(84): n is a, c, g, or t
  misc_feature (88)..(88): n is a, c, g, or t
  misc_feature (145)..(145): n is a, c, g, or t
  misc_feature (169)..(169): n is a, c, g, or t
tccaaagaattatggcaccagaggcaagttagggccaagattgccggccccgacggngnccnaggtagnnngacnggcntagcntgtngcagacctggcttcctaaccacgtcgtgttcttgcggctccgggagggactgaaaanccagagtccaaccgaagctgaganaccagcttcttcgtcgttgccttcgtcgccgccgccgcagttgctgacgagaaacgtggtctttggcctcggcggagagcttttcctgtagggacggagaaagacagctcctttcttagtcgtagcgccttcgagggccccagtcggcggcggcagaaggagcccgccctgtccacagtatccagagattgctttgcataaatccacccctgttctggaaagtctactcaagttcttgtcaaagcccaacacaacattcatggtaagcacgtttattagggatttcacacaggacgtcaatagggtattacgagatttaccttaacagcactggcgggacagaatttcttgacattttgaacgcggtggaaacatcaacgagttgaattgtacgttaccaactccaggttgccgggacagcatcttctcaccagttccacctctctgactctaaagcatgcttgcatggtatccaagtgaaatcctggatccccacgtagatgctgttaaccattcagacaacgtactccgaatttactcactactttagcccgaagacacc

SEQ ID NO: 625365 - DNA, 608 bp, Homo sapiens
  misc_feature (20)..(20): n is a, c, g, or t
atccttcgcctccacccacnccagtggtacatgcacgtacatatgtcagtatacatacacattcacacacagtcctgcgagtggctcagaacttaatctattaataactaaggaatcagaaagctaattcatcaaattcaggcttcatattcgcagcccaaattgagaggaaagtggaggccagaggcgtgaggtatattgcttctcccccagcatccaacaggagatgtgagagggcacccgaggcccactcttcagactctaagaagttcttttggtccatggtctacaccagagccccagcccctagcataattgcatacctgtggtttcaccagggcctaggcagagggaatgatggggaaggcaggaagcctattctggaacccctggaacagggaagcaagggcccctctctaacagggggagaaggatggggctcagccttctcttgtgcaaagtcaagggcagtgggaaatggggagtacagcttcatctcaaaactgggatgaaggagccttccctgtagtccctgcccacggggtttacacacatgcacacgcacaggcacacacagctaagacaccaaacacgggaagtgaggagtc

SEQ ID NO: 625366 - DNA, 504 bp, Homo sapiens
  misc_feature (236)..(236): n is a, c, g, or t
  misc_feature (402)..(402): n is a, c, g, or t
tctaactgatagagtaatgctgacataatagtctgtgactctgggtgtagaacataagactcactgcagcttctactttggttctctctttctctgggatcatgagccctgggggaagccggctgctgtgtcataaggaggcctgtggaaaggcccatgtgactaggagtgaggcttcctgggaacagacaataagaagctgcagcctcttccaacagccatgtgagagattcttntgtcttgtgaatccccaggcccatttgagccctcagaccattaagtcctggatgacaactagactgcaactttgtgagaggccctgagccagaagcactcagagaaacctctcctggattcctgaccactagaaactgtgggagatgataaatatttgttgatttnagctgctaagttttaggtgacctgtcattgagctttttcatttgctctaaattcattataagatattaaacatgtcatttgcttttaatatttaaaaaaaaa

SEQ ID NO: 625367 - DNA, 768 bp, Homo sapiens
tcgccaggggggagcgcctctccgtgactactatcgctgtcatgtctgatcttggcaagcaaggaggcaaggcccgcgccaaggccaagtctcgctcatgccactctggccttcagaccccggtacgacaagtgcataggttgctgctcataggcaactgctctttgcgagtcagagcactcacgcccgtctacatggatagaggcctcgagtatctgaccgtctagatcctggatctggctgacaacgcggatcgtgacaacaagaagacgctcattattcatcgtcacctccagctagtcatccgtaacgaccaggaactgatcaggctgctggtcagagtcaccataatccacagcggcgtgttgcctaacatacaggccgtactgatctctaagaagacggagagctaccacaaggcaaaagggcaagtgaggatgacttacggaccaattgagcccaatccgaacagatataaaaagggcacctgtaaactaaaaaggctcttttcagagccacccacattttcatataaaagagttgttaatggctaaaaaaatgaacacaaactcggcaaatgggatattacttttaaataaaattatctgtcccccatatttttggctaattttccaaatgggacaaaaatcaacttataacatttagtgtccaaagtataaaataaaaactggttgcgtgtcgccccctatttaatccttgacctataattcttttggggctggggccctaagatcccaccctggttcc

SEQ ID NO: 625368 - DNA, 413 bp, Homo sapiens
  misc_feature (52)..(54): n is a, c, g, or t
  misc_feature (177)..(177): n is a, c, g, or t
  misc_feature (260)..(261): n is a, c, g, or t
  misc_feature (285)..(285): n is a, c, g, or t
  misc_feature (300)..(300): n is a, c, g, or t
  misc_feature (321)..(321): n is a, c, g, or t
  misc_feature (360)..(360): n is a, c, g, or t
  misc_feature (399)..(399): n is a, c, g, or t
gccaacacagcatatttggtttatctgtgatgtggttaatcttatctctttnnnatacacaatacttcatgtacctatgaaataaaacaggtagggaatatgtccagtgcaaacagaggactcacacctgtgcatagacagcaccatccactgattgtcgctgcagtccacggcgtnactaagcctgcgccacccacgtgctgcccccaggagcgctaccaggctcttcgggccacaggcctctcctccactgcatgtgnncggagggcgggtaggtcgcagggntccatgatggtgggngagctcaaggggaatgggggnaagccctcgaaggtcccctcctcagtaggggatgtcatnctgatagtactgtatcatgtggtaggtccggctcctgtngctgaggaagcagc

SEQ ID NO: 625369 - DNA, 355 bp, Homo sapiens
gactacagactttcgaagactacagcagattttctaaagtccaaattaactgagctacagaggacacacatcacgcttctacaggagcataataatgctttgaaaccaattgaggaactaacaagaaaagagtcagaaaatgtggccagggcagtgctgaaggaactgagcgaaaaactgttactggcagagaaggctctagcttccaagcagctgcaagtggatgatatgaagcaaaccattgccaagcaggaagagcacctgataaccatgaccatcctcaggcctcagatggaggattatattctgatcctaccaggcttcggaatactcacccatattgtaacttactact

SEQ ID NO: 625370 - DNA, 126 bp, Homo sapiens
tgaccaaaggacacattaggccttaaactccttcctcagttcttgcccctcaggtcccgcaccaggccaatgtgtggtgaaggcatcctgtgggtggcatccccccagcgcatcacaggattgatt

SEQ ID NO: 625371 - DNA, 222 bp, Homo sapiens
  misc_feature (220)..(220): n is a, c, g, or t
cttatgatagatgaggccaaaatagggtattaaagtttttttcttattttttaaaatttctttttaaaaattaatagagacagggactccctattttccccaggctggtctcgaactcctgggctcaagggatcctcatgcctcggactcccaaggtgctgggattacaggcgtgagccactgggcttggcctgaaggtttaaaagtgagttaataaccnga

SEQ ID NO: 625372 - DNA, 1076 bp, Homo sapiens
ttcagctcctccctggagaagagctacgagctgtctgatggccaggtcatcaccattggcaatgagcggatcctgctgatctgaggcactcttccagccttccttcctgggcttggagtcctgtggcatccacgagactacctttcattctccctatcatgaagtgtgagcgttggaatatactcgctatacatgaatctgtaatgcctaatcacaagcagctgtcctgcgtccggcgaacccaccaatgctaacccatgcgacaattgtccggccaacagcgaatgccatcaatggatgaatcatcatgccctatggggacccatggcacaaaagaacgaatcaaagaatcatccgctcccctcctgatcagcatcgctacatccggttgtgcgaatcgggaggccttcatgtcctggccgtcgtgtgtttcactctttccatcagaatgatggaatcacccacagtatgaagtaattaatagacggtccggtccctctaatcgaaccagtgagaaatgcttctaggtggattatgattaagtagcgtagacaggctgttcgtaggatgaatatctaactatgcgcagataagaagatgagatgggtatggctcaattagtcatcataggggtgagtaataggtagtttctaccgtaaagggtaagataaggattttaaatatggctatggtatatggaaagtatagggtggtagctagtattccccatagtttcagtgcgcgacgctactagtaatgcgcgcatcgtgagatcagctaaaatgactaccaccttaaattcgtcggtctccgtgttgctcgaggctgcaaagtaccggttttgccaagggggcggctcgctattccagtcaacagggggtatccatcagttgcgcattatcttctgaaccttataactgctaatattactagggatttcaataggagtgggccacgtcgtgtttccccccatatacgattgctccggagtgggcgggacatcttattgacaaaaggtcaaaggagagaacaaaaagggtgcggcctgcgagaggacagagcacaaaaaatataca

SEQ ID NO: 625373 - DNA, 266 bp, Homo sapiens
tcggcacctgttaaacgtaggcgcccggcatgttcatggtcgagcaacaccaggtcccagtcggatttttcagtcaggcgggcttccagttcggcaatgctggctacttcgaccaaacgtacatcggggccaaggcccaggattacggcctgatgcagtgcgcagcgaaacagcgggtggtcatcggcaatcaggatttcgtatgtggccattggttaaatgatcctgttttttatgggagctctgatgggttcagggttcaccaa

SEQ ID NO: 625374 - DNA, 434 bp, Homo sapiens
tcgatctagaggatcccttgatagcccaatcccaggaggaggttgcggtgagccaagatcgccccactgcaccccagcctgtgcaacaagagtgaaactctgtctcaaaaaaaaaaaaagaaaaagaaaaaaaagagcagagtgagactccatcaaaaaaaaaaaaaaagaaaaaaaatactaaagctgttttacacagaattgtgatagcttatctaacacagacaagtgatataaataagggggaaataaatggctggagcatgtggaacaggtttatagaaaaactggatgcaaaaatttccatagaaagaagaggtgtgtatatactgtggccctttggcagaacacaaactgtattatgattgttttgccccctttaggggcactatcttcttcattgaaattgtttttccggggatggggctatcaag

SEQ ID NO: 625375 - DNA, 146 bp, Homo sapiens
acgtgactcccccaactggtcctgtcgtgttcccgcacgcacgcacgtacgctactggcacgtggcacgacacgactttaccttacgtaccacaccactgcttacgacggacgacggacgacgccacgacgacacgtgaccacgtg

SEQ ID NO: 625376 - DNA, 727 bp, Homo sapiens
cccctccacctcccatatgtccagattctcttgatgatgcttgatgcttttggcaagttatcttaatttgcatggtacatgtagtggctgatcatactggctatttatatgggtttccgacgttaatccacaagacaggaaggtgctcacattccttaaattaaggaggaaatgctggcatagatccagcatctatatgacaccatctgaaagaaccgatgcagacagatctggaatgtgaagcgttatagaacgataactcggcctgcatttcttcaaaatatcaagtgtgtgggtaaagaaaaaaggaagtggaatgggtcactcttcttgacttaaagagttatgtaataacgcaaatgcaatgtgaaatattttactggactctattttgaaaaaccatctgtaataagactggggtgggggtagggaggccagcacggtggtcgagggtcagattgagaacaactttgaatgtggattagatatttgaatgactatctggataattattggtaattttatgagctgtgagaagggtgtatgtagttgttataaaagatcctgtcttaattctgcatacttaagcatttaggaatgaagtgttagagtgtcataaaatgtttcaaatggtttaacaaaatgtatgtgaggcgtatgtggcaaaatgttacagaatctaactggtgacatggctgtcattgtacatatctttcttctatcttca

SEQ ID NO: 625377 - DNA, 612 bp, Homo sapiens
  misc_feature (5)..(5): n is a, c, g, or t
  misc_feature (9)..(9): n is a, c, g, or t
  misc_feature (450)..(450): n is a, c, g, or t
tcgtnctanggattggcgggcagaggtaagctaatcgcggtgattggagacgaggacacggtgactggtttcctgttgggcggcataggggagctaaacaagaaccgccaccctaatttcctggtagtggagaaggataccaccatcaatgagatcgaagacactttcaggcaatttctaaacagggatgacattggcatcattctcatcaaccagtacatcgcagagatggttcggcacgccctggatgcccaccagaggtccattccagctgtcctggagatcccgtccaaggacatccctacgatgcagccaaagactccatcctgcgcagggccaagggcatgttcaccgctgaagacctgcgctagggctgctcagcctcagccctcctcatcaccaggcctctcctggtttgccatgctctatttaagtgtcaagccttggttnccagcccctcccttcctcttcactgagtggctcgtaagctgttggggttcggttgttcaggtctaggctgggtagagaaagaaagcccaactgtttctccactgcctcctccctgtgctgttaatagtatcgttgttgatattaaaggaattattctctcca

SEQ ID NO: 625378 - DNA, 106 bp, Homo sapiens
  misc_feature (53)..(53): n is a, c, g, or t
ctaactttggctacaacattccactaaaacatcttgcagacagagtggccatntatgtgcatgcatatacactctacagtgctgttagaccttttggctgcagttt

SEQ ID NO: 625379 - DNA, 823 bp, Homo sapiens
acaagcgagaggcatggccacgtgtcaaatccgactcgtggactcagatttgtcgtggaccctcttgcgcttttacccgttgaacagtggccgtcaaagccgtgtacatgtgtgtctgggttgtacctccgggggcctcatccaccaccggtgggttccaccatgttgccaggcctggcacgattcgtccccctcgctgatacatgctgcttgccagatcatggtcgttttcggaacatatggccagcggcgccagtttgccttcatggggttcctccgcgcgggtttccagcgcgtgttcatcccacttgagtcatccaagttgatcagagcgcgcaccgtcaccccagagcccagtggagccgcacaattgcctcctctgaagactttcccctcttccggttcgggctcccccctatcctcggaataaccagggcggaactccctgttccccgtcgagtggtggcggctgtcactatccgcaattattcttgctccttcccgcacgtgctgcagctcccggcaggcctcattcttgagtatcccctgcctccgtcgtgagggcgtggaggcccggcacacctgttggtcccaacatccgctcatgcgggcatcacacttttccagctctttgaggcctgcatgagggcccccccctgttcatgaacttcaccccgcccccggcactcaagtgtttttaacccacgcacacgggcttgtggtctccactaccaaacgggagctagaacacgtcaccaccaccatcacggagggggcccccccagccaccctcccccccacttagaatccccccgaccacaag

SEQ ID NO: 625380 - DNA, 643 bp, Homo sapiens
  misc_feature (169)..(169): n is a, c, g, or t
  misc_feature (248)..(248): n is a, c, g, or t
  misc_feature (279)..(279): n is a, c, g, or t
  misc_feature (284)..(284): n is a, c, g, or t
  misc_feature (290)..(290): n is a, c, g, or t
  misc_feature (330)..(330): n is a, c, g, or t
  misc_feature (480)..(480): n is a, c, g, or t
ccgagcccgagccgatgccggatccctgagcgagcggcggatactcgtgcccccgtccttcgtgcccctgtctgccgccgcggcctgtgcccggcatgaggaggagtgcctggtgttctctccatactagagccagctttatccagcgagcttacttggtcaagccggncggccacgttcccgctgcaggttttgggatttgagattgacgcggtgaactctgtccagttttcaaaccacacaggctntgcccactggaagggccaagtctgaattcanatganctccangagttgtacgtaagtgccatgagggctgaacaacatgaantaatatatgacttacgttgcttcacattggttatactgagggactaagtcgttccgtgtgcctagtggttggttgtactttgttcagggagcattgtaagcagcagtaacctccaggctggtgtacgttgtgttgatccagctcttgggntgacaagtgggacggcgaaggcctcgatgtacgtcccggaggagctcctttcctgtctacggatgtaataagtggttgccggcttgcggactttatcacgcccaaccagtttgaggccgagttactgagtgggcggaagatcatcacctaggaggaaggcctt

SEQ ID NO: 625381 - DNA, 1557 bp, Homo sapiens
  misc_feature (146)..(146): n is a, c, g, or t
  misc_feature (1223)..(1223): n is a, c, g, or t
  misc_feature (1326)..(1326): n is a, c, g, or t
  misc_feature (1365)..(1365): n is a, c, g, or t
  misc_feature (1517)..(1517): n is a, c, g, or t
cggcaaataaccttggatgttccccacaatttgtttcctttccttgaaaagaagtagaatctccttattgaggtccatgattatatcagggcctatttaggagatacttctgaggccaaggagtttcccaagcagttccttgagcnccgtgccaaacagaaagccaaccagcagcgtcagcagcagcatctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcggttgaatgcatgcacttaacttggatgcatcagaagcctgagtgggttgagatgaggtggttggttgatgttacacactcctcacntgttcttctgagtgtctttctctgaaaggattatgttttcttcgttagatagtgacttctgagcaagctgatctcccctggcatgctccaacctgattggacnaaggaagctctatggcctgggagagagactattcttaanttttctttcttacaaaaactgattttcccataaatattttacttcagaggactaggaccattttgttttgggcccttctgctgaaaatttgtctcgtttaagaggcagctagaatctttaccatatgtatgaatttgtataatttcattttnggatagggataaacttttgcttctgataaaagcctggaat

SEQ ID NO: 625382 - DNA, 782 bp, Homo sapiens
  misc_feature (169)..(169): n is a, c, g, or t
ccgagcccgagccgatgccggatccctgagcgagcggcggatactcgtgcccccgtccttcgtgcccctgtctgccgccgcggcctgtgcccggcatgaggaggagtgcctggtgttctctccatactagagccagctttatccagcgagcttacttggtcaagccggncggccacgttcccgctgcaggttttgggatttgagattgacgcggtgaactctgtccagttttcaaaccacacagagacaaggtcggtctctgtcgcccaggctggcgtgaatgtggcgcaaccagctcactgcagccttgacctcctgtggctgaatgcaatctttcttgcctccacctcccgatgtggctggtgactatatgttgtgcaccatgcactgcccacctccatgcccatgggtttgttacttggtggtgtgtcactgtgtggcatgcttcttgcctggtgatgtggccacaaatgccatgactccctgtgcatgggacactggagtgttccacacaatgcttgcgtatgtttgtgttccctgacagcccttcagtgctggagcgggtgtggaaatgcctgatcccaccaagatgcctgcaagagcccacctggctgcaggcctcgccgacctcgatggctgctgctcgcacttctagcccctttccccacggaccaggcccccgtatccttgagggccgtaccacaaggtgcgttcatttctaccacaccgtgagctgggcttggcagagcctccaacttgtggccagtattcccagtgggacc

SEQ ID NO: 625383 - DNA, 424 bp, Homo sapiens
  misc_feature (169)..(169): n is a, c, g, or t
  misc_feature (248)..(248): n is a, c, g, or t
  misc_feature (279)..(279): n is a, c, g, or t
  misc_feature (284)..(284): n is a, c, g, or t
  misc_feature (290)..(290): n is a, c, g, or t
ccgagcccgagccgatgccggatccctgagcgagcggcggatactcgtgcccccgtccttcgtgcccctgtctgccgccgcggcctgtgcccggcatgaggaggagtgcctggtgttctctccatactagagccagctttatccagcgagcttacttggtcaagccggncggccacgttcccgctgcaggttttgggatttgagattgacgcggtgaactctgtccagttttcaaaccacacaggctntgcccactggaagggccaagtctgaattcanatganctccangagttgtaccaagggctgaggcttgaccacctgaattaattttacttcctgcttaccaggtattccaaggaccaggcgttcctggccctggtgggggaccttgggccagaacttgaaccacaaaaccccaagct

SEQ ID NO: 625384 - DNA, 666 bp, Homo sapiens
agatgtctgggggcggggggaccggtatggagagcaagacccgagagcctgcagccgctagatcacggtgtgtcgagcagtggccagcgtcgacggtgaccaaggcttctgttccgcaagtgaagggctcactggtgtagcagctaggcttcgccgtctggctgtgatggatccctggagagtatgtggacgagcgagtggacctagcggactgggcaactgcggctgaggggcggcggtgcgccaggtaagtagcctcccgtgacttcggggcttctccgcgggggcgtctccttaggttcccggaccctgtcagatcctccggtgggtttggcagttgaaggacaggatggtctgtgggacgtcctgctgccgtcgaggagccgtctgagcaggtgcagtaccggtgtgcccggctccccggatgacagccgtggtcgacctgggtcgtgacttgtgtacccgtcggagactgcgggtgccctgcccggagtcgtcgcgcgagtccttgccaaggcacgagtctgacctgacgtctgagtccgtatgagcccaggaagcggcagtgtggctgttaggagtaggtttgcagtcgagccagttgcccttcctggggagatctccggcgcctgtgcttctctgcgagtcgtgctctacgctgtgttc

SEQ ID NO: 625385 - DNA, 158 bp, Homo sapiens
tgcttgtaccactagtcacggttggctagttgtgcactttttggtaagtctggaacttggtgctgctggatgaacctgaactgccgtgttaatgtgctgccctgactgcctgactgctcatcatgacccccagaaaatggtgtttggtttgatatatg

SEQ ID NO: 625386 - DNA, 260 bp, Homo sapiens
atgcagtgcttgtgaggttcgtctaatagtgttgtgcgataatgtgcgcttgaacacggtgaatgacaaaagcatgccgtggggcgtgtgtcagttagtgcaaaaattcggatttccccagtgtcatgtggtctgttgtgcgtgctgaaagggcggtagttgtatattgcggtagcacttcaggtgtcttgttatattaaagtgctcaaaagttgttttttatgatgttttcaaaggcaggttaaaaacgttttgtgtta

SEQ ID NO: 625387 - DNA, 178 bp, Homo sapiens
attacatactgggactgaagatagatgtgtcttagagagacgcctgcatgaccaggtacattcaagcatgggctatgcgcaagtacatccaccactgctcgcgtgttgatcctgccagcgccatatcagggtccgaaagcaggtggtgaacatcccgtccccgtagcgggttgttgcg

SEQ ID NO: 625388 - DNA, 194 bp, Homo sapiens
ggcccaattctttgctgttctttgctcaacattttccaaagagaatttctctgccttttgaagtagttcattgcattgttagccagttctcactagaaagtttctccttatttttagccaaaaagctaatttcctaaagtttctatattttgattctaattctgtcctctaaatttataaaaacttaatacaat

SEQ ID NO: 625389 - DNA, 338 bp, Homo sapiens
gcacgagtataaatgagattgtttcaaagggagctcacgacttaaagagtcctggccaggtgcggtgactcccgcctgtaagcccaacactttgggaggccgaggcaggcaggtcacttgaggccgggagttcgagagcagcctggccaacatggttaaaccccgtatctactaaaaatagaaaaattagcggggatggtggcacgcacctggagtcccagctgctttggaggctaagccaggagaattgcttgaacccgggaggcagaggttgcaatgagccaagatctcgctgctgtactccaacctgggcgacagagtgagactccatctcaaga

SEQ ID NO: 625390 - DNA, 2157 bp, Homo sapiens
  misc_feature (1589)..(1589): n is a, c, g, or t
  misc_feature (2038)..(2038): n is a, c, g, or t
ctcagcgagctgctaggggtcatgagcctcccagaagcccctgacagctgagactccagcccgccgcatgcaaaccccaccagaaaccatacatagcaaagcccacggagtccagatgcaaaccccaccagccactgactgcacaacccacaccacgacagcaacgccagcagaacacatctagaacgccaatgaccagcaaacacgacgacggcgcacaatagcatggaatattaaacccaccaagaccacatgcgcagacaacgctggcaagaacacacagagaccaacaatgtacaccaaaacaatgaacagcatacaaccaagacacatgaggaacattcatcgccaccacaaacacgcgacatgaaccagctcgcaacgctcaacaacaacacacccctcacccttgcccacacaacagagcaacacaacacacgacaacagcaaaccacctagaactggggacaccatagccctactacagacacacagaccacacatggacagtgcaaacaccaacaatagcactcacgaccagaaacacgcacgaaccagacgccaacaacacccgtcattcatacacacactacgcgaaccaaacaagcgcgcacttcagcaaccacggcagcacacacccgacagaccgagaaccacatgagagcatacgcagctgatgcattgtccactagaagcacgaccaaccctaccagagaccacacttccactatcgagaccgcaacgcaacacccataggacgacacaaacacacaaactcagtagcgctgacagtcgtaccctcgcacgacccaaagagcaaccacgggacaaagacaagacgtaacaaccaccaacacactaggtagcaacacacgacgccacaccggtcaacaaacactcgacaaacaaccacacaaaacgcagaataacatggctcgcacacactgtaccgagcaagcataagtcacactcgacaatcagccagcgcgtcgcgacacgcgagagtaacttcacacgtaaggcaacatcgaccaacggcacaaacgaagatatcaccccaacccgctgccagaccaacacaccatcgcgaacaccaaccgcaattctcctcggacactacctctcccaactccagtaacaccacccatccatcgacactgacgtggtaacacatcgcatacgtctgagtattggataaagaggatgagctagtaaacagacgcacactgacatgtagaacgcaccctgcacacagtcacccatccactgcattcactatcaccatctcgatgactccagtacgaaaagaccactgctcagcacgaactgcgcatacacggcaggcgaaccgctagaacaagagaccaccatagagcactagctcttaccacagcgtgcaacagactagagatagtggcgagcaaccgagaggcaatggagaccagcactaccagacatagacatgtgacactaacataatggaccagatctagagcacacagcgaccgacagcatctcgactccctcactgatgatcatgtctgctcactagctgaagtatgctagaacacgaaaccatccagatgagnaacttactacctcaagaacaagtacttagtaatgacgcacatcacgtccatactgatcacaaagagtaactcctcagatcagcacacctaagaccacatactgtagtagacaccaacaccgacagcaacacacctaggactacactacactatctacaactcaacactcgatagcagactagctatacagagcacacagcgacgacgacagcacatcatatcgcacacatcaatagcacatagaactcacgaagacaacagatatagaataatacataccagactcaacacacagaagacagacagtagatatcgtagccatcagaagactgacacagcaagccatcaacgatagagcttaacatctcagcacacagaccactagctacatacaactcatcaacaataagacctacacaccacaagcactaccactcgcacacgcagancaacccactacactcctacgacgctcctagtcatcatcacaatcatagcacaatgcaaacagaactacagatccaacagaggcaaggacatacacacagctcaaccagtactaccaaca

SEQ ID NO: 625391 - DNA, 428 bp, Homo sapiens
atgtagggggacaggaacttccatatattgctggcagtaatgaaaatgatagaaaatgatacagctattttggaagacagtttgatagtttctcaaaaagctaaacataaaactaccataaaacccagaaatttcactcatatctgcccaagagaaatgaaaatatatgtccacacaaatgttcatagcagcattattcataatagcccaaacttgaaacaatccaagtattcaactgataaatagatgaaagaagtatgatacagccatataatataatatgatgcagccataaaaaggaatgaagtattgatacatgctacaacatgaatgaactttggaaatattacgctaagtgaaagaagtcagacaaaaaggccacatactgtatgattccatgtatacaagatgctcagaacaggcaaatt

SEQ ID NO: 625392 - DNA, 168 bp, Homo sapiens
catacaacttcctatactcttggcatggcagttcagaagaatattcagaattccttctaaggcttctggaataagtaacttattttccaaagaaataagacctaagcattataagtagttatgttccgaatactatgctaacaaagatgcctagctgaataatctcaa

SEQ ID NO: 625393 - DNA, 644 bp, Homo sapiens
  misc_feature (119)..(119): n is a, c, g, or t
aaggggatctccccccacattgttttagagcccccttcaccccctttagagcggacaatcaatgctgttctgcttgtgggtaatggccctgactcagcctctgggaagggattacgggnattgtaaaaaccagctggggcaccggctggggtgagaatggctacttccggatccccagaggaactgatgagtgtgcaattgagagcatagcagtggcacccaccccaattcctaaattgtagggaacgccttccagtatttcataatgatccgcatcagttgtaaaggggaattggtatattcccagacggtagactttccccagcaatctcagaagcttccaaatagatttccatgaagaaatttgtcttcagaattaaaacggcccttaattttaaaaaccctttcaatcggccccgggccatttttttttaagtattcaattaagcgggaattttttggaaaatggccacctatgaagtaatagagtttggttaatcatttgtaattccaccacgccatattttttaaaatcaatgtgaaaacatagacttatttttaaattggcccaatcccaagaaaaaaagggcaataattatcaaaacttttaaaataaatgcccatatttttaaaaaaaagtttta

SEQ ID NO: 625394 - DNA, 399 bp, Homo sapiens
cacgaggtgaaaaagggtctttgaaaactgaatttcaagtgcacgcaatataaaatgaaagagatggagagacatctgacacgataaagcatggaacaaaaattggtaccctaggttctgcatcaacagaattgttatctgggagcactcgaaatgctgatgacaaagaggaggatgaccgcatcctgaagacttctaaagagctatccacttccccatgtaatcccacagttcgccagaaggaatctgaattacaactgacatctgcagacagtccacaccctgacttattgatagacttgagaacctctctagaaaatgcacaggttgatgactctattaaatctcatggatcttatgaaacagaaggctttgagagtgctagcttgaatgcagagc

SEQ ID NO: 625395 - DNA, 425 bp, Homo sapiens
actctaagtatcccaggcgtggtggtgcgtcctgaataccagctactcaggaggctgaagcaggagaatcacttgaacttgggaggcggaggttgcagtgagccgagattgtgccactgcactccagcctgggtgacggagcgagactccctatcaaaaaaaaaaaaaaaaaaattggttccggggaattaaaaattccttttctttaaaaacttttgtcccagaacttatgaggttgcccccagaagtttttggtgcacttattataaccgcgaaggtcctttcaaggaaattagttaattaattccttaaaaccttaaaaataggcgggccattgagaagctcttgccttttattcccgagcccttcaggaggcttgaggttttagggcccatttgacccgtgggagttaatggacgaggacc

SEQ ID NO: 625396 - DNA, 325 bp, Homo sapiens
  misc_feature (85)..(85): n is a, c, g, or t
  misc_feature (87)..(87): n is a, c, g, or t
  misc_feature (142)..(142): n is a, c, g, or t
tggcccccagggccctgcaggttagttaatgtagcagggacccaaaaaagaccacggggttgggggtttgtgggcttgaccttgncngtgacccccccccccctcaggccacacaataaaaccttttggccacggtggaagntgttggggaaacttttgttgggccttttggccggaggcctggttgatgggttggggccacatccctgctttttggtcctgtttatcctttttccctttcccgttttggacctggacctagcccccagccccttttttttaggtgagtgggtggagtggtcaataaacccccatgtgcctgtta

SEQ ID NO: 625397 - DNA, 438 bp, Homo sapiens
  misc_feature (11)..(11): n is a, c, g, or t
  misc_feature (71)..(71): n is a, c, g, or t
  misc_feature (109)..(109): n is a, c, g, or t
  misc_feature (111)..(111): n is a, c, g, or t
  misc_feature (150)..(150): n is a, c, g, or t
  misc_feature (370)..(370): n is a, c, g, or t
ggaataatcanctggaatgcctccgtagatagtcagcgtaccagtagagttagttgtccgtagtcctcacntatccgcgttttgcttcgtatggttcgaggtcagaaantnttaatggaaattccagaaataagcacttcatagtttaantgcacacattctgagtattgtgatgaattctgccatccattttgtcttatctggtctcactgggacatgattattcctttgttcagtctatccacactatatacaccactgccgttagtcactgtgtagcctctcggttatcagctcgactgctgtggtatcacagtgcttatgttcaagtaaccttattttacttaataatggccccaaaatacaaganttgtgatgctggcaattcaagaagctttaaagtgctccctttaagtgaaaaggtgaaagttcttgacc

SEQ ID NO: 625398 - DNA, 940 bp, Homo sapiens
  misc_feature (686)..(686): n is a, c, g, or t
  misc_feature (732)..(732): n is a, c, g, or t
  misc_feature (742)..(742): n is a, c, g, or t
  misc_feature (751)..(751): n is a, c, g, or t
  misc_feature (868)..(868): n is a, c, g, or t
  misc_feature (878)..(878): n is a, c, g, or t
  misc_feature (884)..(885): n is a, c, g, or t
  misc_feature (887)..(887): n is a, c, g, or t
  misc_feature (889)..(889): n is a, c, g, or t
  misc_feature (894)..(894): n is a, c, g, or t
cgccacattgcccaggctggtttcaaactcctgagcttaagcaatccgcccacctttgcttctcaaagcgctgggatcacaggtgagccactgcacctggccaaatgtaggctttttctatcttgctcctccaaactcttccagccactccccttgagaggacttgatgatatggaaaagtacttatggtatagtaagtaaaaaaatataaaaacttgcatgcatgtttttataaacaaaaataatttttttaaaaaattgcactaaatttttaatagatcaatttctttagaatgaaattgtgaatattttcattgtcatctttttttttcttatagggaaagtacattaagtttaaatgaagtggtgtaaaaatacagaatccaaaagtcatggtgtgattagaatcaagttggagagatactttatttcgaaaataaataaaactatttatttgactaaaatctgatgtaaaacatttaaatctaatgtattgtgcttttaggcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagtttngtgtacctgatgtgaaagctgctgatttagaatactgcagtaatangactagctantgctttaanggagtatgcagagaaagggatagacagtgttcacagttatttggaaaatttgctaagtctgctaatcttctgtgtacagaagaagtgaattttcaaaatgacaaatttggaaactgnggttcccgtngtgatnntntngatancctttgtggaaagattgtgtggacacatggcgaacaatcaaagact

SEQ ID NO: 625399 - DNA, 285 bp, Homo sapiens
ccccccaaaaaaatcccccaaaagccccccgggaaaagcctttttttttgggggccgggggaaaaacggtttggaaatggttcccccttaattttaaagccccttttaaaaacccccggtaaccgggccggggcaaaggggggaaatcccgcctttggcccattttaggggaaggtaaacctggttttttttgggttttgtttccaaggaggggttttccaaattggttttttttgggggtttttggctctggcttttttttaaaatttttaaaaaccccaagga

SEQ ID NO: 625400 - DNA, 614 bp, Homo sapiens
tatcccccacgtaaggttcaactggaatggaatggacacacatggcaccaatatggactggcatggactcgaatggaatacaatggaattaatggaatggactctaatggactggaatggactagaatggaatagaacggaatagactcgaaaggtatggaatgcaatggaatggactcgaatggaatacgcacagaatacgacctacgaactggtatggaactgcaactggacctggaccacgaatgggatggactggaatggaactggaatggaatgcactggaatgccattgaacggattggaatggaatggaatggaacggaacggaacggaacggacacggaacggacccggactggacccggcaacggacccggaagtggaacggaacgagacccggaatggaaacggaacgtcatgtaatgtaatgtcatgtaatgaagtgtactctaatgtaatgtaaatggaatggaatagactcgaatgaaatggtgatggactcgaatggaatggaccggaatggaatcgactcgagtggaatggaatggaatggaatggactagaatagaatagactcaatataaatggaatgaagtggaatgaactcgaat

SEQ ID NO: 625401 - DNA, 155 bp, Homo sapiens
tgggcagattacctgaggtcaggatgtagaagttgcagtgagccaagatcacaccactgcactccagtctgggcgacagagcaagactccgtatgaaaaaaaaaaattagcataaactattctgtataaccgacagcatggtcactattggaagg

SEQ ID NO: 625402 - DNA, 1587 bp, Homo sapiens
gagcaggtaggaacgttatcgtcggtggagcaccgcaagttcgatactgatagactttgttgaggtgaggccctaggccgagtagtagtgtcggcatgtgaccgaaggtgccgtgagaagaggcagaggatgcgcgccgaagcggcgcgcaggtccggggtacagagggcagtgtatccgctgtgccgaggaagcgcggcagctatgggagacgtggaccgcgcagggtggaaacgggcggaagtggggggataaccacgacggggcgttgtgaagcccgccggcgccgtgacccgtataggcgccgccgggacatgtggggggtgccgagggtcgctacgcgacccgaacggtacgggtttccagaagcgcggcctaaaaggccggtcgagtgcgacggtgtgcgtggggtaaagatggcgcctaaaaggttgtgattgggcccaaacgtgtagtagattggtctagtggggagcggcgctttcagcggctagtaattggcgacctttggagggtgtctctacctcgttgggaataatgctgttggtaacgtgccgtgtgtgggaccgcttgtctgcctaaagggggttggccaatgaggcgttcccaggaccctcgctgcgtaggttgattgattggccaaagggctggtgggtcaaggcatttactggcgaagggttaacatgtgtgggagatgcgcaggtgactggtgcagcctgtcaactgggcaatatgtggacaaggtggtgggatgcgcggcaatttggcgtaacgcgtggtcgcgctagtagaaatcgctcgccgcggtggtgtcgcgaggatgtctgcgctataggtccttggcgtgtatcttggcgaatataatcgcggatagtatatgatgtcggtgggagtgtttgccgccacatcatggggagcatgcacaatgcacgatctttgtgaaactaggtctttaggccctagggagatagacgttggagaaggcgtgcagtcgcacgacacggggtcttgcgcatttgtgtagcacagataggctgcaaaagagcgcgcagcctttggcaacgcaatatggcaagctggctctggtactggtctcgctggtagatatgtgcgctgccctgtgagagacctctgcactacgcgcgagatagagagtggtacacgggcttccgcataatctacagggccctattcacgacatgtgcgtgttgttgtcagaaatgggctatgccctagagggcccatgcccagttgttatcatgctagacaggagccgtgacgcaagagaggagttcgccttactaatgctgagaggtgcagtttgaatctcagtgggttcagaactcaagatgccaagcatcggtcgtgtgactatcaggaacaatggggcattgttgcttgttgggtaaaaagtgtaagcagaagccgccacaagttcagcatgtaactcaggcatttcatgttattttttcctttgtcttcttggtctggttctttgttctgtcccccatgctgctgatgcagtgacctctagaacggggaaagaattaatgctctaacaaactcacctgctcaaggcagtgaaga

SEQ ID NO: 625403 - DNA, 918 bp, Homo sapiens
gctcgcctacggtctggtgtttgccccgccgcctctgcgaaggaattctgttttatgtgggcgcgacaccgttgtgcacctgtttacaacgaatgtgtctcttcttgttgccagacatggtgcgtctcagaacgtaccccctggtttagaagacactgcaatgcgtttgagactctggggttcgagagagagttttgtcccaccaaccgctgctgggtccttgggggatacttccttgctaacgagcgagctttgtgtctggaacactccgccctcctcatattggttgtgtgttgttgcgcgcaaccgcgccgtgattcatgggcgtccggagccgcacactcgtcgtcgaccgccagagtagtttgcttcggaagtagggtttagtttgccgcagtgcctgactcaaagagtgaccagcacatttgcgagaagatggacagttcgggcgccccgctgtcttccaacagtagaactagtgatagaattgcgtgagatcactcgtcttggagggaacaacaagcatagtttttccacccgcctcatatgcggggcgagcaataaataaagcacccctcgtcatttctccaagaaggctgctctatggtctacaaaagcatgattctttcaaacgcaggaagtcaccaacgcatagtgaataggcacaatgctactagatgcgatcgtgtttgtatatatggtacaagataaccccactaaagacttgcgctttaagagtaggccggatactatgtgtatggctactgctgtttaaaagctagcccccactactctacagggacagtgcacgtgtgccccctggcgtaccaccagcgcacgccggttattataattctgtatcagaataaagttctgattttgcaaatggggaaaacaattctttctcgccaacaaaac

SEQ ID NO: 625404 - DNA, 154 bp, Homo sapiens
gtgatcacttaggagggacccttctggtgcagcaattttatcttggcttgtactcaccacttaaaaaatcataaaagactgagatgttggagaggggcaagcctgaggtcttgagagaagaagataccagaatagaaaagcagcaaggaaagcg

SEQ ID NO: 625405 - DNA, 558 bp, Homo sapiens
  misc_feature (2)..(2): n is a, c, g, or t
gntcacttgagcccaggattttgagattaataatattatttattactattattcaagctttgttaaatcaaacctaaagctcttggaactttaagttattctgagccttgacaggaattggtctctgcagcctgagtcatggggcatgcagctgcaacttccacctatttttttttttttctgtaattacttaggaagaccaaatggcaccagagataagactcccttagatccccacttagatcaccaccctttctcagggggtaataaagtcatcttccttggaatgtagcaatctataaccaatcaaagcactgtaacatatgcactggtcttgtatggaaaatgttgtaatcctgctaaaattcctctctctttgcctgtggaagtgaaaccttaacttctccagtttggaatgctcaccccattcctttggagtcaatgcttactgggtggctattctcaaactttgcactcaaagaaactctatacttagtcttattttctgaatctcattatttaggttgacataataaacaactattagtaagtaaagtg

SEQ ID NO: 625406 - DNA, 198 bp, Homo sapiens
catctactgtccggagatttcaccggcagcagtagatgtacttaatgccacagaaccgcacacttaaaatcggttaaaatggtcaattttatactgtgtatattttacgataatgaaaacatttttttaaagagctataccaagagtcctgtgcacaggttgtaagggaaagcctggcctgcctctgggaggaccatt

SEQ ID NO: 625407 - DNA, 111 bp, Homo sapiens
ttgaacaggcacttttagtttagacctaaagggttaggaaagcattagataggtattgtggatctccttagaaaaaagataagtttgcttaaattaaaacattccatggga

SEQ ID NO: 625408 - DNA, 285 bp, Homo sapiens
ggatcctaatgaattgtgctggtgctaaaacgggacattccctactggaggagcagagcaagcagcagatccaacgagcacctgcgccgccagttcgccagccaggccaatgttgtggggccctggataccagaccaatgatggcaggagatctgggcgcactctccatatgatgctgaactgggaccctggacggaccagcatgagccacctagaagcagtatgaactgcagcatctgtggactacaatgcccaagcgtggaccttgctggagcagcagcacca

SEQ ID NO: 625409 - DNA, 256 bp, Homo sapiens
cactccaggaaagtgagtcagatagcagatgagtaataaaggagaatcatgtaaagcatgttacaaccaatataatgaacagtacagtgatatactctgggtcccagatactacatctctgcaaattccaacaaaagaaaaccaagatagatcagtttctagagtctgtagccaacatgttagcagctgctcagcaaatctcgcagaacatcagttcagaaactgcacaactcctcctggtagtctctgatgggcg

SEQ ID NO: 625410 - DNA, 266 bp, Homo sapiens
tcacaatataatggccacagacacataatacctttaagtttaacctgtcttattaacactctgtacatcactttcttaaatccagacaatcaacaaaatgatcaaaccctgatttgcagcactggccattatccctggtgtaaatattcccattgtggcttatttcaagctaccagtgtgacgtcattgaatgtggagttggggagagatgcatagataccattatatgtgtttcaaccatataggtaccaattccatgctaataa

SEQ ID NO: 625411 - DNA, 299 bp, Homo sapiens
catcattatatatcactccaggattgatggagggttcgttctactattatgactattcgctgcgaacgcgacggcttctcaactcatgataattattaattattattgctgttggaaaaatgattgatcctccaaatgataagatgttgcctgtggtgtatgcatcgtggtagtccgcgtaatgtcggggagttctggataggccgagaaaatgttgtgggagggaaagttaggacttaatcgccgctgaatattatagtgatatggattttggcgtcggtagggtgcaggagggtatg

SEQ ID NO: 625412 - DNA, 236 bp, Homo sapiens
gtttctccgtgttggtcaggctggtctcgaactcctgacctcaggtgatccgcctgcctcggcctcccaaagtgctgggattacaggcatgagccaccacacccagccagatgcaaataattttcttggaaaattatttcaaagttattttaggccagaaatcaaggattgttccaaccatgaaaatgggtaagcacctgccttaaggaaatctaacctgctattactgccaaatt

SEQ ID NO: 625413 - DNA, 499 bp, Homo sapiens
  misc_feature (41)..(41): n is a, c, g, or t
  misc_feature (69)..(69): n is a, c, g, or t
  misc_feature (100)..(100): n is a, c, g, or t
  misc_feature (166)..(166): n is a, c, g, or t
  misc_feature (411)..(411): n is a, c, g, or t
  misc_feature (454)..(454): n is a, c, g, or t
  misc_feature (468)..(468): n is a, c, g, or t
  misc_feature (496)..(496): n is a, c, g, or t
ttcgtcattaaggtttactattgcggctattaatagaattngtctggttttgtattcccgcacggcagncttatacgatcacctctgccttaatctccanccgacacgctccctctccagttccgcgtgcgcctatcgctccgtcagcgacgcttaccgcaggcgncactactagtattgtacatgcacttattagaatagcaagtcccgcaggaaatcatccttgtgaaagtggtatccgggggttccgttcggtgggtcaaattcccgttccaactgcaacaggtttatccgcagcgtcaagtgattttccttgttaccgtcgccatcatcgttgtcgtcaccatcattattgccgtcccccgccacgtcgtcgtcgccatcgtatttataataaatgttaatcaaatnaataataagcctatttatgccgtagtagtacagtttcgggttncgggggtacgaacngcggggagaacagtggaagaaaaatgtncgg

SEQ ID NO: 625414 - DNA, 645 bp, Homo sapiens
  misc_feature (5)..(5): n is a, c, g, or t
  misc_feature (23)..(23): n is a, c, g, or t
  misc_feature (38)..(38): n is a, c, g, or t
  misc_feature (51)..(51): n is a, c, g, or t
ttttnttggtaccccggaattcngccattatgcccggnggctttatctttnttccattccggcaagggtccgcaatacaatctctcataacacttacttattctcatcatgcacttttatctatttttcattacaaactaaaactaattttaaattttcaccttaataaattttcactttttcctcaaaaattttctttaccattactcttcaaattggatgctattaaccaacccctctacctcttatactaaaaacaaacctattacccatctattctcactcctataacttaactccaccccttaaaaatgaaactccaactctacaatacattccacattccacaactacctacccaaacaccctccctttcctaccctcatcattaacaaccacataccccctttatctatccaattcttccataccacacccacatcatccaccaccccccaaacctttctctttacctttacaacccctccccccttttaccctccactctttctcttcaaaacaaacaacccaaaaaaccttctcccaccttccctcccctcctccttccttcccctcttaccctcatccccaaactacaccttcccctccaaaaacacaatccccccctttcttaccccctctcct

SEQ ID NO: 625415 - DNA, 569 bp, Homo sapiens
agctgtgaatattttcattcatccacactctttttaaagcatgagtgagttattttagtctgttgcaaaggctgcctgtagtaaatgaattactgctgatcagacaagtgtaaaggtttcatttgctttgccggtaaaattgaacgactgaagtggcaaccgttttgaattaccctccctaatgggtcagcaaggatttggcccttaggaacttgactctcatgtgcatcatctgctcggtaattctgtaaatgaggcggccattttagaacgtccaccattttaaagtggttaatgcactttgtttacagatcaataatctgctaatgaccacatgccagtctgcatgtctgccaccccgaaaagcaaacctcccacatattagagagtctgaccggtgagttgcttaggaatagagcaagtagacttttaaatactaatgtttttaccacaagggctgaacggtttgccaacactaagcgctgatgatgaataagctatttgtcttcaacgatttgtttgtacaaatttactgcaacaataaaactgatgtgtcaactgaaaaaaaa

SEQ ID NO: 625416 - DNA, 268 bp, Homo sapiens
  misc_feature (11)..(11): n is a, c, g, or t
  misc_feature (19)..(20): n is a, c, g, or t
  misc_feature (29)..(29): n is a, c, g, or t
  misc_feature (31)..(31): n is a, c, g, or t
  misc_feature (109)..(109): n is a, c, g, or t
tagccaggtgnataggtanngagacaggnanacaggcagggatggaacgaggcagctcacaatctttttgtttccgtcttttttcatttcaatcaaagcgatgtcattntggtaagtgcctgcattgtagttttcatggaaaataattctatcacgtatcatactatacgttagtcggggtatcagtctactactgtgtcatattgtaacgatgagtttactgttgagacatgtgcagcagtcagatcacagcacatatatcccaaga

SEQ ID NO: 625417 - DNA, 1031 bp, Homo sapiens
tggggttctctgaccagcacctgggcggtgggcaaaaacaagcgccttacaaaagggggcaaaaagggacgccaaagaacgaaacgtgggttggactccaatttcctaaaaaaagattgggttatagatggtagaaacgccccttggctatggtctcacattataagagacacttattgggaaaagaccgctctgtcacgcaggacccaagggacaccaaagagtggcactatctgtgagagtgggctcctccagaagggctcgcgtggtgtttgtgaaagtgtgacagactcgtgtgccgtgatattgcggcacaaacagtgagatgacaagtgtgtgcatatttgagacaaaatatctcaaaacgcgtgaaatacacgtgcaaagaatgtctccagggggattacacaaagagtgtgccaggacaccataacgtttctcagaagtggcccgtgtgggaaatctatataacccccgtgtgaaacgaaaaacagtgggtgttctcaccagtgggtctccagaagaagagagtgggacaacacacaaacagtgaatttgtgaaaggcccttccagcgtgtgagagatgtggctacagaagaaaactttatccgcggcagttcggttatcaccttgtgaacaactctgccaacctgcgtgtgtcaacgtggtggagggggggagattataacacacatcaagaacaaacagcgccaaaacacaacatctcgacgaatcatcagcgcgaaaaagaaacccttacaatatgaagtgcgccttcaacgggccaccacaaacgcagggggctcccgcgcgcaaaaaacatcccgggggacaaaacaaagacgtagcaggtggggaacaacaactccatgtgagacccccccaggaagaccaggggcgcggcccaacaagacaagacgaggggcacctttctgaacccagacaaacaagggtggggcaccaaaaatcagagacgggggaaagtccccagaaaagaccccgccaacgtggggggaaaacaaaacagcac

SEQ ID NO: 625418 - DNA, 696 bp, Homo sapiens
  misc_feature (648)..(648): n is a, c, g, or t
atagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaacaaaaaaacgagaaacttcagttaaccacgcctcctcgggggcttagaagcgcatttcagcgtttccttcagggctgggtactcttatataattccctgaaacggggctccagggtcaaaccctttaagacaatctgacgctggcaaccctgggccttgggtcgtcgacagatacggacgggttcaacgggaagaatctaagcttttaaacacttttctttaataaattagacttatttcgccttggtaatggtatggggcctttaagtggagtaagggctggggcagaagggttgcttaacaagctttgattcccttttnctcccgtggactggatctggcttgtccagaggcaaggtggtcctgggc

SEQ ID NO: 625419 - DNA, 107 bp, Homo sapiens
accctaatacaagaatgacaattataatggaaaaggacaaataatataccagcgggttggttattatagtccgtgtattaaaatgctatgaaacttctaaaactagg

SEQ ID NO: 625420 - DNA, 909 bp, Homo sapiens
gtggcttggccgtccctcaatcacggaagctctatgactgtcgggtagataaccttatgtcctgacgtatggcggcgccaagcctgttccacccagtacactgcagagaggcaatcgcattgatctggggctgccacgaacttatggtagccggcgcggcatcactggtaagcacacaatgcccctcacgcaaggccagacgcagtcactctcccattcctgcgtgtgtacaggcagttctagcgaatcctcagggtaaccctcagcagtccatcgagatgcctgtgcctctggatgcgaagagaggagcctcactacttgccatcgggcactgacgacttatgcttcagtcacagggctcatggaggcctctccactgtggtcgaatagtacgtcgaatgaagcgctgtgcagctggtcttccgcaaggagggtctgggctttggagatggagggcagtagcggtgtgaggtcgaggggcgctagagcctaggacctgtgggcgcagtcccattggcctgggctctggccagatcactgggctcaggatcagggcttggttcccttgccacccagtattgctgcccacatgagtagtaggcaattacatgagtcacttggaagaagacagtgactctttttccactgcatgggtaagtcatattatgtatggatcggttggaattttctgaggcgccagttcccacgtgcctttcgaggcagtctaacctcaggccacttatcttcacctgggtgcctcagggtccttctcatctcagtagggacttctgaaatgggggaggcagtgtggaatactgtcgatgtctgtgcagagccttgccggcactgaaggcatgcagcctgtcggcagagtgtcataacaccagatgctactttttactgtattac

SEQ ID NO: 625421 - DNA, 833 bp, Homo sapiens
  misc_feature (727)..(727): n is a, c, g, or t
agctgagtggcagggtggacgcgtctcgtactaacggttaccgcgttgtggatggctgaccattggagtggacagaatagaattgcaagggattacgagagtaagcatgtttttcactagtatttgtactaagagaatgtgtgattggaaactatacactaaataaatggaaattggggagacctgtaaatgagcatcattattgtgggcatgaatcaccattatgaagacagcagtggactgtggacaactgcattgaatgaatgtgaaatgctggctggtaatggctgaattgactttcctgaatactgacgaagatggctacggtaacatgaatagacatacgacgccgtgaagtacagagaataaagataggccattgcgcgtgtatgagaaggatctggcccgggtgatatcagtgtagaatcaagtagcgggaatgtgcatgagtgaaccgttgtgagaagaaggtgagccgcgatggtgaagtctgatgcaaatggtcagggcatctggcgttcgactggcgcgtggtcacaggtacacgctcgagcgatgtcttaggtcacaaatctggatgacgagcgatgagatgaaagcatgttggcttcacgaaattgtgttacactctcctttgtgaccacaatgggctcttgtactggccatcacctttgttagggtcaccttattcttgtcacaataagtcatcataccctacctgtccaanacacccatcatgcatgttatcagtcagtacaggacctcactcccctccatgtcttgtcacccctatcgtcactggcacggggccacaacacctattgtgacgcacg

SEQ ID NO: 625422 - DNA, 264 bp, Homo sapiens
gacttcgtgtttttatattgactttggggtaccggccctttaataaaacgagggggggcactcctttggtgcccctcaaaaaaaaaaaaaaaatgattttcagcggcccacattagagtagaaatttcctggtgggagaatctatacctcgttcctttataggcccaggacccaagtccttcaatcacaccagcgtaaaagcttgaggaaaacttgtgtatcttcacagcatctgccttctaatacctctggccattcttaata

SEQ ID NO: 625423 - DNA, 139 bp, Homo sapiens
tttctttcgccaggctggagctttttactcgcggcggtgatctttttgtggaactttagcagcagcagcagcagcagcagcagcagcagcagcagcagtagccgtagtacccttgagcatcaggtggcgatgaagcggg

SEQ ID NO: 625424 - DNA, 105 bp, Homo sapiens
tgcttcacccagtgtgtgcttacatacacacacacacacacacacacacacacacacacacacacacagtgggttaagtaagcacacagtgggttaataagcagt

SEQ ID NO: 625425 - DNA, 1057 bp, Homo sapiens
  misc_feature (400)..(400): n is a, c, g, or t
gcagtctatttattagctatcatcccatctactcatttattataaccagaatcgaactaacaagcttttatcctcgctaattacttaactacctggactcctatcccctctacgaatctatggcaaggccaatccccactttatccagtgaatccgactaatcatcgcaacagagaaagctcctatccgtcatctaatactaatcgtcgccgtaccaagaatctcccttagaattactaatcagttcatctatgtccacgagtaagctaactcatgtacttgtgtatattgcttcttatcggcaaacctacatctctattccaccgatccgtatggtactatcgatcaacgctcagatatgagtggatacgcatgccctatgtagcacgctcatgatacngtcaatgcgcaatcagtacgtctcgcttattttcgtaccaatccacttaggtaaggggcttcccacttctcacctcgtaattactcactccgtcaatcttcatcactaatgtgacctaacataccaaccattaagaacccccataaggcgcctttccagcctcataaaaccatttcccatatatcttcaacttcaatcctacttacctatcctggttcccgcgaaggtaaacctttctctccaaacaactttcccatgggcgagacacacagacaccaaaccgttttctaccattcagttgccaacttagttctctgtggaccaaatttgaaactcaagcgcactactggttcaattacagtcttgagaacagctattacgcccctggtaattgtcaactgtggacaccgttcaacaaacacgttgtacttggaaccacttcgcccctaataataacaaaggtcccctcggagtaatgggtgtcccgtacacaaaggttcctcccaaccatctaaatcttcctgccctttacggggcgcgaggtcccaaacagctaacaggctttacacttttgtctgcccctcacgccctacgcgttctacaccgtccgcacattggaagacgacaccgataaacggggcccggctgttctgtaac

SEQ ID NO: 625426 - DNA, 408 bp, Homo sapiens
  misc_feature (72)..(72): n is a, c, g, or t
  misc_feature (301)..(301): n is a, c, g, or t
  misc_feature (314)..(314): n is a, c, g, or t
  misc_feature (330)..(330): n is a, c, g, or t
aaaagaaaacctttggtatatattatataatatcctcatgttttatctcaaagatattgaggtcactatttnattgtaaaggtatttcacttgtctagtaatgggattgctgatttttaaaactactcctttgctatctctgcagtggctgctgagtgaaaaaggcagagtgctacctgggaaataaacttgttgtgcaaccacttgaaagaaaattttatcctctaacaattttttcccgtatccagcttggttattcctgtggcaaccacagatcatataacttggatgttttatctcnacagtgcattctnggcattgcttactcangagtgaaactcatgatatgttaactatgcttccttaagttctactttattttgatttgacctcataagggacaaggaa

SEQ ID NO: 625427 - DNA, 859 bp, Homo sapiens
  misc_feature (435)..(435): n is a, c, g, or t
  misc_feature (465)..(465): n is a, c, g, or t
atgctgctttcatttgagtgatgactatgtacacacagcttctatcatcggctcgcctttgggtggaacacagctgagagatcgacatgagtgcaggccggtagagatcctcttccaatccgttccatgcggacttagatgcatcagctaccaccatggttggccctgggcattagctgtcaggagcaaccagtagctagtggggactggtatgtgatgttatccagactgaaagaataatatctcagacaacaaatacttctaatcgagggtgcatggattgaatgcagaaggggtaaagagatcgagaattcatgtatgagtacaactaggaatgaaggtctgtagttgtgtctcatattgataatggtgagaggtagattggacggagagcttgttagatacatggtcattctaacgatggatcatgggtgntcctctgtaaggggagcataggacttatgnaagttggtgcgaggataaggagaaaaggcttgtcaacgcaaatgacacgtcattgatacaattagaatcaagtttagaatagtagataaaagctagaattgtaatgagtccagaaagatggttctgctagtgaaggagttaatagaaaggaattattaggtaggtgtcactgcttgtcctctctggaaatataagggaatcctaaaagcctttctgtcgtcacgttctcctgcaatccgagggagacctccgaaatatcggatgccaaaaccggggtcctttctttttaggaccccgaagagggtttacgatactgggtttgtggggtggaccacatgtctggatgaatcctttggttaggggtgtccccatggggtgggttccctgtgggggg

SEQ ID NO: 625428 - DNA, 106 bp, Homo sapiens
cccttcacgattacctcaaagtgactgatgcatttgcaagactcatgtctacagtagagaagacaagcacatctaccagtaggaaacccgaaaagagaaagagcac

SEQ ID NO: 625429 - DNA, 215 bp, Homo sapiens
ctagaacgactctggacggtagtagaaagaaagatcagtggttggctgggtgcagtggctcatgtctgtaatcccaagcactttgggaagccaaggcaggtggatctcctgagcccaggagttcaagaccaccctggtcaacagaacagaacccccatctcttttttttttgtttattttggggaaacaatcgccggggcaaccccgggtttccc

SEQ ID NO: 625430 - DNA, 372 bp, Homo sapiens
gggagccgtatataaaagtagctagtctaaatgctatcgattgcttttagagctacgtatatattttcctttctacaaggtcccctttcatgtttaggggaaatttcactgaagtgtatacaccttcgacatcgctaatatgtcccacactatttcataccccttttgcacgcttctagctattcgcactcacacagcatgtcacaaacacagtccaatcatgcatttcctattaagaagcacaatacacaacatcattcaatttcattacaccataacttcaaaatgtagatacaatcccctttaggaagaaaagctatttctgtagttcactctgtcagtcaacacactaagttgacacgctgcagcaga

SEQ ID NO: 625431 - DNA, 441 bp, Homo sapiens
tcgacgacgatcagatccgtcgttgtcccgaccattagcgatgcccaccggtcgatgcggcggtctttattcccactcacccgccggtgccagcttccgggtacaccaaagttctccgcgtctccggggggagtatggttgccacgctgaaccttatcaggaattgaccggcatggcaccaccaggatctggagcctgtcggcttccttttgacccaatcacgggaaacctcacccggcccggacacggcacagtgattgacagattgatagctctttctccattccgtgcggtagtggttgcatggcccgcttcttagtttggtcgtagctgcatatgtctgcgcttattccgattccgaacgatactctggcatgctaactagttccgccacccccgagcggtcggcgtcccccaacttcttagagggactagtggcgt

SEQ ID NO: 625432 - DNA, 119 bp, Homo sapiens
ccatgtgaggacctccgactccaactctcttcgagccaccacgcggtgcaaatgtttgtatttttggtggagacaaggtttcgccatgttgcccaggctggtcttgaactcctgggctc

SEQ ID NO: 625433 - DNA, 269 bp, Homo sapiens
aacctcttcacaaacagtcccatctcggtaggtctgccccatgcaacaaagacctccagtccaaaccaggtaccgtaggtaaaacaaactccccagaaaccttcccaggaaccatcggcctcatactaccgccagcaaaactctcaaccctgcgtaagggtctccctggaacacgagattggtccagtgaacattctggtataacagcagtttacctatcccaattccatcctttccagggtctcaaaagaatgagaatggtctccctt

SEQ ID NO: 625434 - DNA, 497 bp, Homo sapiens
gtcccgcgccagagacgcagccgcgctcccacatccacgcccatcgcgccctcgttcgcctcttctcagggagccatgtccgcgcctaccgtcgtgcgcccatgcccatcgccatccctccgcagccatgtccaccaggtccgtgtcctcgtcctcctaccgcaggatgttcggcggcccgggcaccgcgatgccggtccgagtctccagccggagctacgtgactacggtccatcccgcaccatacatgcctttgggccagcgcgcttgcagccccgcagcgacccatgccggccaggcctcgtacgcctcggtccccgcgtctggcgttgtatgccacgcgctccatctgcctgtgcgcctgcggagcatcgtggcccggggtgcggtcctgcaggattcggtgggacttctcgtctggccgacgccatcaacaccgagttcaatgaatcacccggaccacacgagccggtggagctgccgggcagctggcttga

SEQ ID NO: 625435 - DNA, 646 bp, Homo sapiens
  misc_feature (2)..(2): n is a, c, g, or t
  misc_feature (20)..(21): n is a, c, g, or t
  misc_feature (31)..(31): n is a, c, g, or t
  misc_feature (34)..(34): n is a, c, g, or t
  misc_feature (59)..(59): n is a, c, g, or t
  misc_feature (70)..(70): n is a, c, g, or t
  misc_feature (76)..(76): n is a, c, g, or t
  misc_feature (86)..(86): n is a, c, g, or t
  misc_feature (103)..(103): n is a, c, g, or t
  misc_feature (450)..(451): n is a, c, g, or t
cnatgtgatgcggagcagcnngcagatccgntantgccagctaccgtcccgcggctggnggtcccttctncagttnttgattcccnaccagatccttttgccnatggaactcaaccgatgccaattttgcaaccctttaccgaattttttaagaaaaaaccttggtcccgatactggccattcaccgggccacccttgaaaattttctttaaatcttttaagggaaaaaaaaaatttcccccggggttttttaaaaatttgggaaaaaacccccgaaaattttttttaaaaaatttgggcgtttggaaactttaaaaaattttttttaaagaacccgcgaaatttttgaaaaaaaaaaaaacaatatttttgtccccccccccgggggggttaaaaaaaacaaaaaaggatgttggtttttgttcccccccccccattttttaaacgggnnggggtgggggccaccatttttttttgtggggaaaaattttttttcaaaaaaagttcctccttttttccaaaaaaagaaagagctttccttataaggaggttttactctttttttttagagaagcgccccccacccacaaactttttttttttaaaaacacccccttttttaaaataaaccaacaaggggtgggcg

SEQ ID NO: 625436 - DNA, 377 bp, Homo sapiens
  misc_feature (331)..(331): n is a, c, g, or t
  misc_feature (367)..(367): n is a, c, g, or t
acagtagtggcatatatccataatcccaacattttggaaggccaaggtgggaggatcacttcagcccaggagttcgagaccagcatgggcaacataacaagacctcaaagtacaaaataaaaactagctggggctgggcacggtggctcacacttgtaatccgagcactttgggaggccaagacgggtggatcatgaggtcaggagatcaagaccatcctggctaacacggcgaaaccccgtctctacaaaaaatacaaaaaaattatctgggcgtggtggagggcacctgttagtcccagctacttgggggaggctgaggcaggtgaatngccttgaaaccaggggatgttggagctttgcagttnagccgagatc

SEQ ID NO: 625437 - DNA, 977 bp, Homo sapiens
acgagctctatgcctttccggcttctcatcccgctcggcctcctgtgcgcgctgctgcctcagcaccatggtgcgccaggtcccgaggtccgcgccagatcccgcccactacagggagcgagtcaaggccatgttctaccacgcctacgaagctacctggagaatgcctttcccttcgatgagctggactctcagctgtgacgggcagaacgctggggcagtttttctctgactctaattgatgcactggacaccttgctgatttaggggaatgtctcagaattccaaagagtggttgaagtgctccaggacaggtggactttgatattgatgtgaacgcctctgtgttttgaaaaaaaattcgagtggtaggaggactcctgtttgtcatctgtctccaaagaaggctggggtggaacgtagaggcttggatgggcctgttcacgggctctcatgagaatggctgaggaggggaccgaagaatacctcacagggctattcagaccccactggatggccatatggaacagtgaacttatttcatggcgtgaacccaggagagaaccctgtaacctgtacggcagggttgggaccttaattgttgattggcacctgagcagctccactggtggaccccggagtccgaaagatgggggccaagagtggattgatgagcatctgggaggagccggatcagatatcgggtggcggaaccaaatcgatgtcttccatggaagggggtggcccaggacgaagatcgggatggtgaaccacttgatgatggggaaggcgcaccagtcgaaaaacactagctgcatgtccaaataaagagaggaaaccggtataacgacagggacaagacggctggcaaccaaacttaggaggcgaaaccagacgagagggggacaccacaggagggcggcagaagagaagaaacgcagaagagacggacaagcataagaacagtgtgctgaggc

SEQ ID NO: 625438 - DNA, 491 bp, Homo sapiens
  misc_feature (2)..(2): n is a, c, g, or t
cnctccgtgggcgggcttctgccttcacggcgttccgtcctcctccccccgctgtgtcgcttcgcccccttggctcctccgccccgcccctcccccccctgtctgcccctgcggttcctctcgtcctgcgccggcttcccctggcccccccccctcctccgtcgggtccccctcccctgtctcccgcacggtctccacaccccagctccacgttccctcattcagtgggtgcacacccatcccccgcttggtgcacattctgcttcacctgcatcggccagcagccgcaccatcgcacgtgcatccccccagcggcgtcgctcatcacgcttggccgcccccacgcccagttcatccctgtggtcaacttttctgcacactcctgcttcccaccccaccagtcccaaggcatcgtgcaggccccgctttcacggtctgtcattcgtcctgcaacatccacatccgcgcacttttgcccttctgctcccggg

SEQ ID NO: 625439 - DNA, 991 bp, Homo sapiens
gagcgggcatgcagccgccgccaccacttccccctctccctccctccttgcgggccctcctccccttccctgcctactacatccccaaactcacagactattccgccacacatgcccgaatcctcaccttcataaccaactcaccacaatcaacatatacatgacaactgctgacacacgagcgacaacacaagttcacactacacatcaacatagcaaccaacacgcacccaacgcgaaccaatgcaacacaacaacctccacaatatctggagaacacaatatctgaccactcccagtacctgcgtcgcggaatgaagccacatcccaaacacatcataatccaccagagagagaacacacaaaccaccgcaacgaaaaccgcgggccccacatgtgcggcgagcccacacacttcagcgcgaaacactcacgaaaaggtgtatcgcgagcactgaacacgaacgagcccacatacacccagccagcacaccgacgcaccagtcccaccgtgcggagtcgcgacaatgccccaccaacagcaacactcctctcccataccacaccccagcgcaccagccccctcaccaccccaccatcattcaccttcacaacaaaaccaactagcaccagacaacagcgactcaccctctcccaacacactaaaagaaccaccacgcccactgacacacctcccccaaaacacaatccgcatctttccaaccaccactactccaaacacacatgaccatcaaactccaactgtctgacaaaaaatcacacacttcacaaacactcgcaacttacacacatcaatatcaatttatcctgaaccatatcatcaacaaccaaacttccatcccaaccctcaactacatgcgtaccataacataacaaatacaccttactcaccctaaaacatacaccaccacctactaacatcacaccccatctcccaaaaccacccaacaacaatgtacccaccatatac

SEQ ID NO: 625440 - DNA, 117 bp, Homo sapiens
  misc_feature (61)..(62): n is a, c, g, or t
  misc_feature (104)..(104): n is a, c, g, or t
gttcttttcccagcttcatgttcattcccgctgtgaacttttaggctttgctcctgctgtnnttaggaacaaagctgtcatggccatcacacacaacgtacctnaggcagcgctcgg

SEQ ID NO: 625441 - DNA, 629 bp, Homo sapiens
ataccctgtcctttgttgaaaactacaacatatttattactgacatttaggctcttctcccacctgctcccctcttgcaaacatttctgcaaaaagtctatttcagagactgaggaatcctcatttgcatctaatgctcccccgaccacactctgtggaggagtgctaggaaaggttagggcaggggagacatgactgaggaccacagagccaggtgagcacagagcttccgtcaggaatgcctcagcaggaagagaggtaaaggaatcagaggcctgctttagcactcagcaaagaactatccccgtgactggtgacaaagaaaacggtttttagtctgggactccagatccatggacacaaaccaagtccaaaaagtagtcaagtggctcctgaaccggtgagcatgcaatgacactcatcaaccagccagaaaccagaggcctggggcatttccaactcatctgggaaggctcaccttcctctcactgagcaccgctccagaataaagtgggtctaaagcacctgctggaataagtggcattgcctgtgagtctaataaataatagtacccaatagggagcaattgtcattagggtccattggaaagcctgactcaacccaagtat

SEQ ID NO: 625442 - DNA, 109 bp, Homo sapiens
cgtctgatcgaatcgagccggtaccagttactgagtgtgtaagctttatcttctgtccacatggacttgtggtttgttataaaactctccagtaaataattgttagaga

SEQ ID NO: 625443 - DNA, 106 bp, Homo sapiens
gagggtagtcatctagcgtgttctgaggtcatgaaatacatatgagtgaggtatcattacaacataggtgtaaaagcaaaagattagaagcaaggctggtatccat

SEQ ID NO: 625444 - DNA, 223 bp, Homo sapiens
gcgcactccgtccaagacatcccagaatcgggtcacaacctcctttatatctccacttatcctttccttaaggcacattaacccgggtctcgggggtttcccagtcgggcagccccttaagggggtcagggcttccggacctatcagggtcaaaagggctcgtaggggaatttctcagattctcgttttttgttcttccagcggccgcttttcatattcccca

SEQ ID NO: 625445 - DNA, 301 bp, Homo sapiens
gaccctagacagcggacccggcttcgctctgagtgaggcatggcccaacctgcgcggcataaatatatacagattcctgggcatcagcgcaccaggaccgacgcagagttggggtcctgtccctaagcctgtggcacaggcgactcctatgacatgcggagccacgggagctcgggacctgccgcaccccttcccctgcctccctctctggggtcaccacccatcaggcggctgccagctggcctaaggacgcggcggaactgctgggtgctgtggcccagctccttgaccctctccacca

SEQ ID NO: 625446 - DNA, 649 bp, Homo sapiens
aaagtcacaggtggagctgccaagacatgggaacccacctcttttatcagcataacctggatgagagacatgggataaaagaagatcattggggagctttaaagttgccctgctggattctggacttgcatgggcgctgtaacccctttgttttggccaatttctcccatttgaaatggctgtattacctaatacctgtaccctcattgtatctaggaagtaactaacttgctttggattttataggctcataggtggaagggacttgccttgtctcagatgagactttggactgtggacttttgggttaatgctgaaatgagttatgactttgggggacaattgggaaggcatagttggttttgaaatgtgaggacacgaatttggaggggccagggatggaatgacatggtttggctgtgcccccatcaaatctcaacttgaatggtatctcccagaattcccacatgttgtgggagggagccaggggaggtaattgaatcctgggagcccgtctttcccatactattctcatgatagtgaataagtctcatgagatctgatgcatttatcaggggtttccgctttggctttttcctcattttctctggctgctggcatgttaagtagtgccttcaccaccatcatc

SEQ ID NO: 625447 - DNA, 1379 bp, Homo sapiens
  misc_feature (1071)..(1071): n is a, c, g, or t
gatgacttggctcctcacactatcggaaccatgccttccagggagggagcccatgctcttctggccgtgccattgatcgtaactgggccacattgagagtgtgtgataaatcagtcaagcatgttgaagtctcaggcagctcctcatggtcatgaccgtgcaggaaggtaagtcctcgagtccatcacgagctcattttgctcaaaaactggagtcccgaagtgtacatctaggtatatcgtcttgaatgacgagccacatacatgaaccccatctgacgttgaaagcgtctgagaaagtaagggtcttggcacccagagtctaggccatcttgatatagcatctgtgcactctaggagcccttcagccacttagatggaaaggctcaggaatccaagagtaggggtgtaatggacgcgatcattgcacaactcagggtcgcgacacgtctactgtgtagccatactgaacataagccaatcctttaaatgcgcgttcattgaccatctcacagggcagtgtaaatgactccctccaacaatgtagattgcgtaaattcacctggtgggctaatgggcgtcacattaacgcgtgctctaaagcactattggggagagcaaaatcccctaaaccttgtgacgtaatatcgggctgtatcctacaaaggcctttaaggcacaacttattgcatgtgaagtgaagagtcggattcgaggaggcccagtaattggaaatacgagacgtggttcagtaaccttctatctattgggtggtaagcgttatttagaaccatgtgcgtgttccgtgtgcccatcacacacgtttagaaacataccgaagagggaggtgggtacaccaataattgattagtttgtcccccaacatggcaaattgaaggccaacacggcgctaaagcttgcgaactaattgaagagcaatcaacttagcgaccccttaaaaggacgccaagggacgtgggtttacacaacacggggggggtcaagtgacactcgtggaacagtttccctaaatttggactcgggagaatgaagagtgaacacacctgggggntttgggggggaaccacccatagagcgagttatcaccctgcacaaacgaggaagatcataaagagattttcacacgctcatggaggcaacacacacaaaggaggacttgccccgacggaacgtacacaaaaagagcgagcaaaaagacacaggaaacagattgcagcacttaaggaaacgcacaacggggcgtccaccaaactgagagggagaccgagaacagggcaagcaataagttgtccacaccacacacttcagatcaccgccagacagaccgtgcgagccgaggcaccgtacacccccgcaggg

SEQ ID NO: 625448 - DNA, 398 bp, Homo sapiens
tggggtttaaattcccaaataataataataatggtaataattttttgggcccggttgaagtgaatggttattgaaagcattcccgggtaaaccaaggttttttgtaacccccgttcccccataggggtaggaattaactttggtttaaaggccccaaaattaactgggcaggttgatggtttgaggtttatgaaagaaaaggttttagccaaatttttaaaaaagcccgtttgggtcaggaaagtagggggtttcaatgttgttgggacccggaagggtgggccaccgggcgggtagggccattgggtcccccagttgggtcaaaggtgagcaagcccgggttgcccttgtaatgtaaattgttttgttcagctggttttaaaaaggttggtccttta

SEQ ID NO: 625449 - DNA, 306 bp, Homo sapiens
cacgatggcgcgtcctagtgtagagagagacaaaaatatcttcatgaggaagagaagatcgtcaacgaagttgtagcgagtatggaagactttgtctgaatgacttgaagaaggactaccacggcagccaggccgattggttacgtctgaaaaacgtggaagtacgggactttcctacctgcgtctaagtgggagcaggctgtagttaccctgataaggagaatttccaacctatacaaaacaagatgcgagccatcctgcgcatagaagtggaggccgtggggtttcctgaagtggggagccaca

SEQ ID NO: 625450 - DNA, 100 bp, Homo sapiens
aatactcaagaaatacgatagacccgcatttacagcaggcggaacatctcacacccttgcataagttaaaataaatattacgtacacatctccatcacct

SEQ ID NO: 625451 - DNA, 1500 bp, Homo sapiens
ccctgctggtataggagccatgctgaaacctgttatactagatacttacctgataaacatataggtgctatcaaactcgctagtatatgctggcattctactgtactctaccacgctgggatcagactcatcatggcaagaccagctagttgggcccaagcactccaagatgggaagaaagactgggatgattgatcataatgtacttgattattgatcttaattattgtactcgtaggtgaaggctgcctttgtgcgtattactcatagaatcacgctgtatgtattcttattctcctttatagattgaatgaggttggatatgaaagttgtgtgaacttcgttgaggctgcgatgattaatacattagactatactttgtgtcccttggtcacactaagagagagatataatatacaaaagatagtagtagatagtaaataagcatacttataaaagagagaagagagagatagatatagtgtgggcgtatctttgttataataacagcacatgcaagaaacataccacataagcatgagaaaggacccagaaaacatgcgtagatactacgcacagaacggaaggagcgagcatcacaaaaagacggtgggtcgaacacgtcacataggatccatgaggggaccaacccttataccaaggtacacgcgacttccttacgtacacggcacagtgatcacttgaggccacacacacaccagactcggctgtgcacacgaagcacgagacacacagaagcccctggaaaaccgacaaaagatcgcacgaatagtgctggggccgaaagcatcacgcacgtaggctgcatgaaatggcggagaggtgtgtagcaaccaacgcaagtaaaatgcatgaggaccctacgcatgacccacaaagcacaacagatgcaccagaacaaaaaatatatatcgcaggaaaaacgtgaccgccaagatgtggtatcacaaccaaggaataacacggaccgaaagtaacagagcgagagcaatcagcacgtcaacgtgtgccgttccaaatgaccactagagcgacgaacgacccaaggcacacatcagcaaagcacaggtgccatgaccacaaggaaaaccatttgacacgattcgacaccatgctgtcaagacagaactattgccaaaggacaaacaaaccattaaaaggcgcgacagggaccagaaaagacccaccatatatgcaaacagtgcaaaccactaggagaagcgcaaacaaccagaaggccgaggagccaagggaactacgggtagcaaccaagggaaacaacagagcagacaagagatcaactagacacacagaaggagatgaaacaacgcgagaccacagaagcagggacatacaaacgcgcagaaacagccagggacaccacacgggaagcactagaaacagacagaagcaaaaggagacgaggagacgaagaacagcagatagcgagatgcagagcaacaacacacacacaaagta

SEQ ID NO: 625452 - DNA, 420 bp, Homo sapiens
ttaccacacaaccagatattcacaacactcgaatatacctggaatactacaagtagaggtagaaatgaacaaagctgccaatttccaatatgattgtgagagaactacttatactacatgtgttctcatgtatgagttttccttgatggcttccttccaattcactgttagcctttgccactataccaaaggatatgatcatatggaatcggcagagttaagatctacgtctgagaggaactgccatatgaacaggtagcaacttcagacacctggacctagtttgctcatcccacgttgtgctggtccagatggccagaacacatggataggtaaaatttctaatggaaatttctgttgctagcggaagcaaaaagccatataacaagtaattgagaaaaagattttgctagctacttg

SEQ ID NO: 625453 - DNA, 178 bp, Homo sapiens
taaactcctttgtctatgaagacagattatttcttattaatggaaagttattaacctgaaaatctgcaccatatctaccagatcatttagacacaaattttattttattttcatttatttatttatttttttattttttgagacagagtttcactcttgttgcccagtgtggagagag

SEQ ID NO: 625454 - DNA, 156 bp, Homo sapiens
ggatagttgtgcagtgactcctgcacatcaagaatgcaattaactgataaggatactgtggcaagctatatccgctgttcccaggaattcgcccggttaatatgcacccagagcccctgccgtttgtgtccggttgataacgcccaaagcccggcc

SEQ ID NO: 625455 - DNA, 132 bp, Homo sapiens
tagcccgcaccttttcgacggtgtctggacggaatggggcgctcttaaaaattagctaagaaaactagagtatattatttggtatatgaggagagaataatggtaatctggaagtgttttgagagataggta

SEQ ID NO: 625456 - DNA, 320 bp, Homo sapiens
  misc_feature (31)..(31): n is a, c, g, or t
  misc_feature (36)..(36): n is a, c, g, or t
  misc_feature (40)..(40): n is a, c, g, or t
  misc_feature (48)..(48): n is a, c, g, or t
  misc_feature (52)..(52): n is a, c, g, or t
  misc_feature (60)..(61): n is a, c, g, or t
  misc_feature (69)..(69): n is a, c, g, or t
  misc_feature (74)..(74): n is a, c, g, or t
  misc_feature (76)..(76): n is a, c, g, or t
  misc_feature (90)..(90): n is a, c, g, or t
  misc_feature (97)..(97): n is a, c, g, or t
  misc_feature (99)..(99): n is a, c, g, or t
  misc_feature (106)..(106): n is a, c, g, or t
  misc_feature (111)..(111): n is a, c, g, or t
  misc_feature (116)..(116): n is a, c, g, or t
  misc_feature (118)..(118): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (142)..(142): n is a, c, g, or t
  misc_feature (145)..(145): n is a, c, g, or t
  misc_feature (147)..(147): n is a, c, g, or t
  misc_feature (154)..(154): n is a, c, g, or t
  misc_feature (164)..(166): n is a, c, g, or t
  misc_feature (183)..(184): n is a, c, g, or t
  misc_feature (188)..(188): n is a, c, g, or t
  misc_feature (193)..(193): n is a, c, g, or t
  misc_feature (202)..(203): n is a, c, g, or t
ggagcaatgctgtaacgagttataggaagangtagnccancccacatnagcngatcatgnngtgcatcngatcntntctataccaacganaggagcntnttgactntctcnacaangnactcatctacttgntaangnggcngtngnactttgngggagccacnnnacctcctttcctaaaanncagngagancaccctgtnnacggccacactagctctgaaattaatttccaaaatctttgtagtagttcatacccactcagagttataatggcaaacaaacagaaagcattagtacaagcccctcccaacaccctta

SEQ ID NO: 625457 - DNA, 230 bp, Homo sapiens
  misc_feature (223)..(223): n is a, c, g, or t
gctcccagacctagagaggaacctcctctcctcctcccagcctactgattcacttcatgcctccacttggaccaaccctccaactctttactcactcatctttgggggcctatcctctctaatatccctggtcaggctgcagctgcttaactggaggtcaccttctccaggtaagactgaccacactggtctgagtgtatacctctgtcccgcccttctccanctgttta

SEQ ID NO: 625458 - DNA, 469 bp, Homo sapiens
  misc_feature (32)..(32): n is a, c, g, or t
  misc_feature (49)..(49): n is a, c, g, or t
aagaacccgcatggtttggaattacctgtggncctttaaaagtaaaatncctaaaagtcaggaggaaataacattttcccaacttggctccttccttttcctaaaattttcctagctattcctagattgtttgcatttcccagataagtccttagaagcagtatgtcaatttctttaaaaatacctgctggggccgggtgcagtgaagtgcacgcctgcaatcccagcactttaggaggctgaggctggtgattgcttgggctcaggagttggagtccagcctgggcaacgtggtgaaaccccctctctacaaaaaatataaaaattagcttggtgtggtggcacacttttggtcccagctactagggaggctgaggcgggaggattgcttgagcccaggaggaggctgcagtgagcggcgattgtgtcactgcaccccagcttgggtgacagagcaacaacctgtcca

SEQ ID NO: 625459 - DNA, 631 bp, Homo sapiens
  misc_feature (91)..(91): n is a, c, g, or t
  misc_feature (96)..(96): n is a, c, g, or t
  misc_feature (100)..(100): n is a, c, g, or t
  misc_feature (102)..(102): n is a, c, g, or t
  misc_feature (110)..(110): n is a, c, g, or t
  misc_feature (127)..(129): n is a, c, g, or t
  misc_feature (133)..(133): n is a, c, g, or t
  misc_feature (162)..(163): n is a, c, g, or t
  misc_feature (174)..(174): n is a, c, g, or t
  misc_feature (282)..(282): n is a, c, g, or t
  misc_feature (284)..(284): n is a, c, g, or t
  misc_feature (308)..(308): n is a, c, g, or t
  misc_feature (336)..(336): n is a, c, g, or t
  misc_feature (383)..(383): n is a, c, g, or t
  misc_feature (425)..(425): n is a, c, g, or t
  misc_feature (467)..(468): n is a, c, g, or t
  misc_feature (491)..(492): n is a, c, g, or t
  misc_feature (498)..(498): n is a, c, g, or t
  misc_feature (507)..(507): n is a, c, g, or t
  misc_feature (510)..(510): n is a, c, g, or t
  misc_feature (548)..(548): n is a, c, g, or t
ggaccgggccggaaggcccgggagggccatcgaggtcggggggcggccggcggggggcaggaggacccgaggggcagccaggaaaggcgancgcgncacngngaaaaggngcccgggggcagcgccnnntccngcgaccaggggaaaggcaggcggggcccnnggggggagccngcggggcgcgggggcgggccccgacccccaccaccaccagaaggcaggcccagcgtaggaagccacaaacaagccacccaggaggaacaaaacaccgccagcggggangngccaaagggcccgggaaaggaagncgcgcgcgggccaaagaaaaggcgggcntggagaggcgcgggagcccaggaggccagcaggggccaaagacgggnaccggcagcgcggcaaaagaaaagccagagccgaggacgggnccgcgacccccggggacggcggcgagggcaggggaggcggannataagggcgcagcccagccaagnnggccgngtcgccggncanttacgtccgcggggggcccgtcaaagggggtagaagtnggacggaacttcaaaatgtgtcccgttctccccagaccactctagccacagtatattgcaataaaattacttcttatatttgc

SEQ ID NO: 625460 - DNA, 390 bp, Homo sapiens
tggtagcttagagcaggaatgggtccaggaatgggttctcaagtaagaaggaaaatgggaggggaagaactcgttattctccaatcagtctcggataagatagttataaggaaaaactcctggcttatgtcttggtatggcacatttttatatatgtatatatgtgtaaatagagatatttatatattcacagacaaacacgtgtatgcacattttcccaagggaggaagaagggatatggtgtgcactgaggtaaagtgagcagggatacagaagagagcgggagcctcacagtcggactctctcatggtacataaccttcagggatctggtttccctgagcttctcgggctatggagcacggggctcgggccggggctaccgagctcg

SEQ ID NO: 625461 - DNA, 440 bp, Homo sapiens
  misc_feature (427)..(427): n is a, c, g, or t
atcataaaggtaatcagaatcctccggcggtagtcacgcttacccttctaagcaggttccccaggattcagagagccccggatttctccgggactccaggtgcagatgcctagtatttccattctgaccgtggccctcctggttcttctggcctccctagttctccggtgcctccggtgggctctcttggcatctggcctcatccaccgagtcggtgtcaccaccgggtatgttctggacagcggggtaaggggtgtagcattccgtgtttgggcatgggatcttacggtgagggtgccagagtttttccttccaaacctacctctctctcggttctccctcccggttttcctaaactggaactgggattctttcctggaggctagggtcttccctaggaggcaccaggtgggcagatgcccacggntgccatgaccttt

SEQ ID NO: 625462 - DNA, 875 bp, Homo sapiens
ttcttcgcgctttccttagtcctgggttgttaaatatctcgcctcattgcttagcgtttctctattgtgaagagttgccatccattatcggcggtgtgtaaggaccccatgtgctgtcctggatgatgccgcggcggtcccctcgttacacccccctgctgcccagggagacacccacgaccctggtttttaacggtcacactctccagactatcgattttggtacaggtcttgctcagagacgcgccaatttcttccgggtattttcacatatgtccccctctctatgctgagacactgctcagagggaggctgttctggggatgttctctccacacacaccacgacctgttctggcgctccccggttcaccacaatttggtgacagtcgggggccgcactgcagtgcacagtcgtctctggttgctccgcgacaaggaaaatgcgtctatgttgttgtcgtcgctctgtgccttgttgctgctgtgtgtgtctgtgtgagtgtgtgtcgtagtgctggttgtttcttcccatgttgttatcatcttacgtaacagtggatgagaagtcgtgaagcgcggagagccctaagtgatataccgctgaggagctgaagcccgtggggaagcaggtgcacctgaatgcgccgttcaatctctccttcccgttccgttcctccttgcatagcccacttgactatggcaagcagcgccagatagtagcatattttgtgtttacggcggtgacagacgccctgtaatcccagcactttgggaggccgaggtgggtggatcacttgaggtcaggggtttgagaccagcctggccaacatggtgaaaccccgtctctgctgggaataccaaaattggcccgga

SEQ ID NO: 625463 - DNA, 1126 bp, Homo sapiens
agaatcttcagataatctgtgagcgtccgcttcgtctgggcacttccggtactcccattcagttaccggtccctgatcttttacgtttaccggcaaaacatcagtgtctgtgggtagttggaatcttcagttacctgtgagcgtacggcgtcttctgggcctagtggagtttctatggacaggggccgcggggctaccagagacggcgcccttaagcgacaccatggcccgaaatgccagaaaaggccatagacggcctatagcaagatatatcgccaggctccagctaggcaagcagggcacacacagtgcaaggacacgcgagcaccctttcttggcctcgagcacatgtcactgcaactagcctcaacagctgcagcaagtgcgagcacgcaccagcatccataggcagcagatctctcacaaacaagtggcctccagcattccagcacatgcctcggtttcaggtgcaatttcagcaatcctgtgcacctaggaatgcatgcacacattcaacacagctgctacagggcagccacaggacactaggcgaggtcctggatcaaaggagctagggcaggtccatgatacatggaaaacgtacggacccgtaccactgctagagatcatgcaaggcacaaggaaggtcccaaggcaacaccgcaggtaaacgaacgtaactaagggaaggcagcacaccggatttggccctgggtggaacgaagagctagcataagcaccaaggaaagcatcattgcctacctcccaggaaccagacacagccgttgacagggagccacccatggacagggccaaatcagaagacgacggacgactacctactgggctaaccgtaggacaggcacgacatgacatgggcagctaacatcggaagcccccttgcagtggaaacccagggaacgtactgtcacccacagcacacaacgaacccagcaacgcaccgacagcatacggcggcgccacacacgggtggacacagccccaaccagacaacacctggctctcacgacctggtgcacacagcaagagacagacaccaaacagtgaccacagcgcacacaccgcaacacaccgatcgcgcaaagaaaccacaaccaacgaaaag

SEQ ID NO: 625464 - DNA, 118 bp, Homo sapiens
gatggttaatatagaaatctggatctggatcaatattctagaggaggcggaggttgccgtgagttgagatcatgccattttactccagcctgggcaacaagagtgaaactccatccca

SEQ ID NO: 625465 - DNA, 140 bp, Homo sapiens
gagaggggtctagttctagcatctgctcaaagaacttgtaggttggatttatcgtagccagtactgctgcatcttgagacaggtggcgctccatctggggtgacagcgagcgtcaacctaccaccaccaccatgatgaat

SEQ ID NO: 625466 - DNA, 551 bp, Homo sapiens
  misc_feature (199)..(200): n is a, c, g, or t
gtgtcccgcaacaccccccagggcctgggcaaggtggcctgatttggggaatggcttcccgctcgtgtacccttttttttggccgcggggggcagaaagggccccattcccgccctgagatccacaaaaaaatttataagattggccgggggtcccttttcaaggggggcaaggtgttcaagaacaatgcctcccctgnntttgccctttttgacaagggcatcacccctttgggggggtttgtcccctatggggaagggccccaacactttgtcatgctgaaagggtggggggggggaaccaaaaaggggggggtccccccccccaagtcctttttggggcaaaaaaaaggggggggtttggaaaaaattgcccttaagttttttgacccccccccccagtgtgggccagggcggtttccagcccatgggggggaaaaaagcatttttggggcccctgaaaaaaggccgaattgcaaaggaagaggggggttaatgcccgggacagattttgcggggggggggggttcaaaaaaagtttttttcccctga

SEQ ID NO: 625467 - DNA, 674 bp, Homo sapiens
agcaggtctataaagggaacggggtagcagaaagtcatgggctaggagagtagagttcgctgacgcttctaatctctgggacacatctgtggccatcgctgggtccatgttgttctgacctcgagaagtaaggacgagacgtcgtcagtacccagggcctcttcagctctatatgtagcattctgggtctggagttgtgggggaccggaggagactgggctctaccatccctcgccattagtagctttatccagccccgtttttgctgcttcctagggcctctgccttaaaaggcccaccatggggctgtccatcccatggctctgcctacggaaggggcttaagtgccatgtgcggtgcccctcaccaccagctgttttttaatgaaactgaaaaaatagacattgatcccggcaggactgtgatagcagagccctagcctgcccagccagccccaagatctcaggagctgttagggagaagacttggtggggctggagcacacccttgggcctacagtggtgttcctgtgtccctgtggtgccagtgcttctgggcagtgacaggcggctgccaggcccagccctagacttccactctggctcagcaacctggttatttatgtggggccgtgcaggcatgggcccactgcctgtccatcctgtttctcgtta

SEQ ID NO: 625468 - DNA, 637 bp, Homo sapiens
gccgttcgcggtggctcaggcctgtaatcccagcactttgggaggccgagacgggtggatatcctgacctcgtgaaccgccgacctagcagtgcgactatgcgaacgtctgtactaaaggaatacccaatgttatgcaccggattcggtaggctttctttcgcgtagtgccgcagtttgtagtgttttatcttatcctacacatgggggactgaataagtaaaagagatccaagatgaagaattcaactgcctatgaaaacgacatatgagcaacgcattcggatgacggatacctgtctcttaaagacctttttctgtaagaggaatctgcattgtaatgtctcaatgacacaatatactttctatgctctgcaaagatacaattctaaaactttcttttccaatatcatgtcgccctattgtcccaataactttatatttaataattttattaagcagtcctatttttgctacttggccaattcacctaaatagatcgtattacaattaatttcccgtgtttacaacgttttgacttgcccttggcgttactcaactaaattggttttactaaatcccccttttcaaactgccttattactataagctcttacctattgcctttctatttggtct

SEQ ID NO: 625469 - DNA, 167 bp, Homo sapiens
atgtatataaatggctgttacctaaattggctgttatgctgttacctaaatggctgttacctaacagccatttaggtaacagccatttaggtaacagccatttaggtaacagccatttaggtaacagccatttaggtaacagccatttgggtaccagtcatctaggt

SEQ ID NO: 625470 - DNA, 135 bp, Homo sapiens
acacgcacctgtggtccaagctgcttgacagcagaggcaggaagatcccttgaacccgggaggcagaggctgcagtgagctctgactctgccactacacttcagcctgggcacacattatggaggggtaccgagc

SEQ ID NO: 625471 - DNA, 187 bp, Homo sapiens
gccttcatctggctcgctgctgcgacggttcaagcagatggttcctcaatcaagctcaggccaggttcgaggtcactatgtagactgagagattgtggccgcattgtaagagaacgaaaaattggcccttgaaatacccagttagagaggctaccgttttaattacactaaggagggattccccttt

SEQ ID NO: 625472 - DNA, 312 bp, Homo sapiens
  misc_feature (21)..(21): n is a, c, g, or t
  misc_feature (61)..(61): n is a, c, g, or t
  misc_feature (177)..(177): n is a, c, g, or t
  misc_feature (185)..(185): n is a, c, g, or t
  misc_feature (190)..(190): n is a, c, g, or t
  misc_feature (203)..(203): n is a, c, g, or t
  misc_feature (212)..(212): n is a, c, g, or t
  misc_feature (214)..(214): n is a, c, g, or t
  misc_feature (309)..(309): n is a, c, g, or t
aaccaccttagcatggctttncatcggatgcttcagttttccaaaaagccagagacctgtnttccttgaagcttttggggacttcgatagtcccatctataccctgagcttcctctgtttagctacacttcttttccttatttttgcagaagaaagaaactttatcaccatgtggcnttccattnttaantttttcctgattntttactctntntccttggtacaccacagtggcttttttcacaggtaatttacaagatgctttacaacttggcatggcagaccagtttcccagtttggtacattctnttt

SEQ ID NO: 625473 - DNA, 367 bp, Homo sapiens
gtcgacctctgacggctccccggtatgtgtccgagggatcagcagtccaacgatggagcacctgacggagaaaatgaagaccaccatccagagaggacttgtgctcagaaatgagagctgcagtgaaaactacaccaccgacttcattataccagctgtattcaagaagagggccaaggcgtgtttgactgcaggaagaacgtgctgagtcacatgcagcagggtgaggcaccctctccatttgctagaaactttggaaccagaaatctctgccagagctatggagtggatcacctgcaaaactccaggaggcccggagcagaggaaaaaaatttaacaacgatgactccatatgtgtgctggggaa

SEQ ID NO: 625474 - DNA, 380 bp, Homo sapiens
aagagaatacacatggtatgtagccttccgctatcatacaccttgctttcaagagtgataaaacagtcagcacctaattattggaaagtctttttttgagatggagtcaccctgtcgctcaggctagagtacagtggtgcgatctcggctcactgcaccctccccctcctgcgtccaagtgattctcctgcctcagcctcctgagtacttgggattacaggcttacaccaccacctgcagctaattttggtatttttagtacagacgggtttcaccatgttggccaggctagtcttgaactcctgacctcaagtgatgtgcccacctcggcctcccaaagtgctgggattacaggcttgagccgctgcacctagcccagt

SEQ ID NO: 625475 - DNA, 916 bp, Homo sapiens
aacaagacctaaagcttaatcctgtacattctggtgttaagaatgaacacagcattgatatttcacttatccaggctgttagaatttgcagttcacatcattactctgtgcttaaatttaaaaagcttttcaaaacatcgtgacatgtgtagcatttaaattccattttattctttgtcctaaagcaggcagtggtatagttcaggattaataacttattgggagtctctcagtcatatagaatattaaatttaatatagtcacatgcattaagaaaaacttacgcaaacagtttttcactgttaattttgttgtgcttgaagcataatttattcatcccttctgtcactgataattaattattggaattatatactttaggaggctaatccatgcccaggaagcacgaacatactgttcagaatgtgcaagttgatgtagggaaaggaagattcagaaatgtacaaaatcctgtgattgtttagtaagaaaagagttgtaaccaaaatttcttctggtccggatgtaattagtccagtcacaaatcttgtgttgttaatggattattcaagatatatatatatattcttactactgatagttcctctcatagtcttaaattattaaagggggaggtaaacaagcagtctgtgtttcactggtcactaagggccttatgagacagtaggtgtctcatttccagaagaatttcctgtaatacttattacaatgtgaactaaatatttgatcagtatcaggcaggcaaattctttttttggaaacaatgacgttgtactcaaataatttacgcgcaagcagagagtacaagaacgagtaggctttccccagggaaactgcaatgtaaacaacataaacagaggtagctttgaaaacaacccctctgagtttttttctg

SEQ ID NO: 625476 - DNA, 1039 bp, Homo sapiens
agcggagtgccgcgcgggttctcgcgcggagaaggggtgcgagcggtggcggcggcggaggctgccatggacagacgaggaggagacgtaccggctctggaaaattccgtaagaccaatcaatgcaggcttgttgccacggaccagtggcttatcttggtgacccaatggacgaagtgttgaccatgacctctgggaggagtttctaagaagcccgaattgggggacgaagcgcgagtgaggggcgtgcctgcggtcgcactgggtacgctcactcgtgctggtggctccacaaaatgcatgtgaaccccaacgcagatccagtatgatttgatgcttacattatccaatgaggaagcctcaaaaggttgggggacaatccaaggactctcatcgaagagctgattacttgtcccagacaggctatcgctggcagggcagacacaatctgacttggtgcctctccattcgtggatgcagagcagggccaatgaacaaacctctacgcgggcctatagacaagtccctccttgtggttctgaaccatttggacactccggataggcttagcaatcacttgtgcacggcatgtttttcttaggactatggcgaagtgaggacttgctcaattcatatcaatacatcgggatgtcaagctggaagcttaggttctcgcttggtaaatccaacggtacagatcattgaatccgaacgggacaggacggacgaccaggatgcttgcttgggtcccccgatagtaaaagtctcccggaagaagaaaccaagtcttgcactctggtggaatctccatagtccagggaaggcgaactcgcgttgatggtgctggctggcatacgatgtatggcggaattatacagcagttggggccaggaggttgcgttgtaaaggaagtccaaccctgggcccccgagtttgaagtaactgggcttgtgcaaggggttccgattcgaagccttacccgggggtggggttgtcaagataagacattcgccagtcctggtacaaggcccctatagaga

SEQ ID NO: 625477 - DNA, 140 bp, Homo sapiens
cctgtaacggtacaaacgaacgactaaacacgatcactgaacaaacatcagtgctcaacaaatgcagacaactcaggcacagtaaaataccacagtgcactgctcctagccatgggcacctcactcaaaatccttttcat

SEQ ID NO: 625478 - DNA, 148 bp, Homo sapiens
  misc_feature (20)..(20): n is a, c, g, or t
tgactgatctcctttaaccncactgccctgggccagggatcaaacctgcttcctggtgctgcagagacacaaatgatcccgttgtggcacagtgggaactacttaatattgtttttcacagcagatgggatcagtccgttcgcatgtt

SEQ ID NO: 625479 - DNA, 315 bp, Homo sapiens
  misc_feature (11)..(11): n is a, c, g, or t
  misc_feature (23)..(23): n is a, c, g, or t
  misc_feature (37)..(37): n is a, c, g, or t
  misc_feature (39)..(39): n is a, c, g, or t
  misc_feature (59)..(59): n is a, c, g, or t
  misc_feature (69)..(69): n is a, c, g, or t
  misc_feature (94)..(94): n is a, c, g, or t
  misc_feature (108)..(108): n is a, c, g, or t
  misc_feature (115)..(115): n is a, c, g, or t
  misc_feature (118)..(118): n is a, c, g, or t
  misc_feature (143)..(143): n is a, c, g, or t
  misc_feature (146)..(146): n is a, c, g, or t
  misc_feature (165)..(165): n is a, c, g, or t
  misc_feature (182)..(182): n is a, c, g, or t
  misc_feature (244)..(244): n is a, c, g, or t
  misc_feature (249)..(249): n is a, c, g, or t
  misc_feature (253)..(253): n is a, c, g, or t
  misc_feature (278)..(279): n is a, c, g, or t
  misc_feature (288)..(288): n is a, c, g, or t
  misc_feature (293)..(293): n is a, c, g, or t
  misc_feature (304)..(304): n is a, c, g, or t
atgacgtacgntatttccatggnagatagccgctgtngnagctgtcacatcaccacagntccctagggnctgccgagaaggcaggcagtctttnggttctgttctttntcacgtnccntacaagtaaattttgtttctttgancgntattaaaatgccaagaccnaaccatttcttccaccngcttgattgtgccagtgtttgctcaggcctctttcttagtgttgctttcaaatccttctctntcctngggntgggaaggccaggcagggcagagcnntgacacttntcttnctcttgccctncctgcctcttt

SEQ ID NO: 625480 - DNA, 363 bp, Homo sapiens
  misc_feature (94)..(94): n is a, c, g, or t
  misc_feature (97)..(97): n is a, c, g, or t
  misc_feature (109)..(109): n is a, c, g, or t
  misc_feature (111)..(111): n is a, c, g, or t
  misc_feature (114)..(114): n is a, c, g, or t
  misc_feature (273)..(273): n is a, c, g, or t
gtgcacaaaaggctgtctgcaagctgaggagccaggaagccagtccgaatcccaacaactcaaaagttgggaagccgatagtgcagtcttcagnctntggccaaaggcnantgnagcccctggcaaagcactggggtaagtccaagagtccaacagctgaagaacttagagtctgatgttcccagcccttgaacataggactccaagttcctcagttttatatgtatctatatatcatattagttctgtccctttagagaactcttactaatncaaagctctacagggatgccaaagcagctcgtaaattagaggctagctgtatgcccagggtgaaaagactggcaatgcttacttagacaa

SEQ ID NO: 625481 - DNA, 426 bp, Homo sapiens
acatagcatggacccagtgcgtagcccatactccctaagtcttgcatcacaaattgatcaggatggcagcatgcatggctgttcttctagtctgggtgtgcctccgtttacattggctgcaaaaggtaactctagctacgctcattgtcctcatccatcgaccccatgcacatggtatgacatatggtcctcgaccttgtagggacacccgaatttttgcatatacctttctgattgatcctgggcggtagccccaagatcagtatatcatacttggctgtaactacctctcagcaattcttaaaaacattcagaacaatccaggtgattccatcccaatggtgggaagcaatgtatcacaggccgaaagcccacacacagacacgtgtacgtccacacatacaatgcgtgtgcacccacaagtat

SEQ ID NO: 625482 - DNA, 696 bp, Homo sapiens
aaggattagagtgatgagtaagagaaagtacctcatttagagcttccttaggtaaacctatatataagctcatttcacagaatcatgtatgccaggtagaaaataaagctgagtaatgtggagggagtaatgtcaggagtagaggaggggagggtcacagcttcaggtagtagacagtaagggcctccctgaggacattccaggaacttcacaggaacaagccctctaaagatttacagtaagagcatacaaggcataagaagccagaagtgtaaaggtcttcaaaaaaacaaaagaaactagaaatccggtggtgacaatcctggtgagtaaaaaaaaaaaaaaaaaaaaaaaaaaaaatttggggggggcttgggcttggaaaaggtttttaagaacatttgtggtgggggggggggcccaggtagggtagagggaccctggggcaaaaaggggggcccccccaaagggagagccccgggcgccccagcgagaacaagggcggcgggggagtctctcccaaccagatagaaaaaacacggccggggggggaaccacggggaggctgtcctcgggacacaaaactcccaagaagggagatgtccgagagaggggcacaaacacgggaatacacataaaaaggggatgcccacagggaagacggcgggaatttcaaattaacccgcaccgcgggtg

SEQ ID NO: 625483 - DNA, 126 bp, Homo sapiens
tctagccgcgcagtggctgggataaggcgtgcgcaccgctctggctaattttgtgtttttattggagaccgtgtttgctgtgtggccaggctgaccttgaactcctgacatcaggtgatccacccg

SEQ ID NO: 625484 - DNA, 123 bp, Homo sapiens
  misc_feature (32)..(32): n is a, c, g, or t
ccaccccgccaaaagcccccgcccacgggagnccccggggcgcgccaccacctccccggcgcaggccatcggatacgtccccgccctcaggagccggcgccgctgcctcgctctgacctccgc

SEQ ID NO: 625485 - DNA, 948 bp, Homo sapiens
  misc_feature (16)..(16): n is a, c, g, or t
  misc_feature (18)..(18): n is a, c, g, or t
  misc_feature (23)..(23): n is a, c, g, or t
  misc_feature (60)..(60): n is a, c, g, or t
  misc_feature (62)..(62): n is a, c, g, or t
  misc_feature (67)..(67): n is a, c, g, or t
  misc_feature (112)..(112): n is a, c, g, or t
  misc_feature (114)..(114): n is a, c, g, or t
  misc_feature (119)..(119): n is a, c, g, or t
  misc_feature (129)..(129): n is a, c, g, or t
  misc_feature (149)..(149): n is a, c, g, or t
  misc_feature (153)..(153): n is a, c, g, or t
  misc_feature (161)..(161): n is a, c, g, or t
  misc_feature (163)..(163): n is a, c, g, or t
  misc_feature (195)..(195): n is a, c, g, or t
  misc_feature (205)..(205): n is a, c, g, or t
  misc_feature (211)..(211): n is a, c, g, or t
  misc_feature (214)..(214): n is a, c, g, or t
  misc_feature (216)..(217): n is a, c, g, or t
  misc_feature (223)..(223): n is a, c, g, or t
  misc_feature (244)..(244): n is a, c, g, or t
  misc_feature (256)..(256): n is a, c, g, or t
  misc_feature (262)..(263): n is a, c, g, or t
  misc_feature (266)..(266): n is a, c, g, or t
  misc_feature (268)..(268): n is a, c, g, or t
  misc_feature (271)..(271): n is a, c, g, or t
  misc_feature (277)..(278): n is a, c, g, or t
  misc_feature (280)..(280): n is a, c, g, or t
  misc_feature (291)..(292): n is a, c, g, or t
  misc_feature (302)..(302): n is a, c, g, or t
  misc_feature (309)..(309): n is a, c, g, or t
  misc_feature (336)..(336): n is a, c, g, or t
  misc_feature (338)..(338): n is a, c, g, or t
  misc_feature (342)..(342): n is a, c, g, or t
  misc_feature (350)..(350): n is a, c, g, or t
  misc_feature (352)..(352): n is a, c, g, or t
  misc_feature (362)..(362): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (383)..(383): n is a, c, g, or t
  misc_feature (385)..(385): n is a, c, g, or t
  misc_feature (397)..(397): n is a, c, g, or t
  misc_feature (401)..(401): n is a, c, g, or t
  misc_feature (419)..(419): n is a, c, g, or t
  misc_feature (433)..(434): n is a, c, g, or t
  misc_feature (442)..(442): n is a, c, g, or t
  misc_feature (457)..(457): n is a, c, g, or t
  misc_feature (478)..(478): n is a, c, g, or t
  misc_feature (484)..(485): n is a, c, g, or t
  misc_feature (487)..(487): n is a, c, g, or t
  misc_feature (502)..(502): n is a, c, g, or t
  misc_feature (534)..(534): n is a, c, g, or t
  misc_feature (546)..(546): n is a, c, g, or t
  misc_feature (922)..(922): n is a, c, g, or t
ccttcggcgccgccancnccgcnatggctgcgccctgcgggaggaaacctcgctggaaangnatttnaagggccaccgagatgcagttacctgtgtggacttcagtatcaananaaagnagctggccantggctccatggactcatgcntcanggtctggnanatgaagccgcagtcacgcgcctaccgcttcantggccaaaangatgcngtnanntgtgtnaacttctctccttcgggacanctgcttgcttcnggctcnngananaanaatgtnngnatctgggtaannaatgtaaaangtgagtncactgtgtttcgtgcacacacagccanantgangagtgtcnanttctgaagtnanggcnantncttcgtgaaancntctgaagaaaanaaantaaaagtgtgggaaaatnatcgcaaaaaattnntgttctcnctgagcaagcatatnaaatgggtccgctgtgcaaanttctcnncngaagggcggctcatngtgtctgcaagtgatgacaagactgttaagangtgggacaagancagcagggaatgtgtacactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactggttgccttttcaagaacgggggagtattttgcttctggaagctctgatgaacaagtgatggtttggaagantaactttgatattgtggatatggaga

SEQ ID NO: 625486 - DNA, 411 bp, Homo sapiens
  misc_feature (79)..(79): n is a, c, g, or t
tagtggttgtgggtagcatctagaccgagtatagaagatcaagggtagagtttcttaatctctgttcctggtacaggantgtgaatgaggttctttgtcccaggagcaggaagtagcaaggtgggagcaacttgaaaaacttttgaaaaactctctattctgcattttcaggctgcataactactgaaggtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccgctgctccccagtctcgccttccctcaaaggccaggtccccccacccagcatacacc

SEQ ID NO: 625487 - DNA, 168 bp, Homo sapiens
tagaggatccccccgactagcccgacagggcggcggggcatgagtgtgctccacatctcagacgatgggcggccgggcagagacgctcctcacttcctagatgggatggcggctgggaagaggcgctcctcgcttcctacgatgggatggctgtcgggctagtcgggg

SEQ ID NO: 625488 - DNA, 309 bp, Homo sapiens
  misc_feature (257)..(257): n is a, c, g, or t
ctggaaatttaactgcttgcagcttctacactttcttcattaaatgctgtctggctaataaacaagtgccatgttgcagctttattttattttcattttttggagatagaccctcgctgtgtcacccaggctggagtgcagtggtacaatctctgctcactgcagcctccacctcctgggctcaggtgattgtcctgcctcagcttcctgagtagctggggttacgggcgtccaccagcacaacccagctagttttngtatttttagtagagggggtttttgcccatgtttggccaggcttgggcattg

SEQ ID NO: 625489 - DNA, 382 bp, Homo sapiens
gatccggagcgaatgcagagcaccgcttaactcgaacgtgcgacgtaggaagctgcagattccggtcaggacgagccgctccatctgcgtagcgccccgcccgcagcggcttcatcccccgacgagtgatgggatggctcgtctgtgagctgtagtagcaatagttggtggcttgcttgcgcccgctctcgatgcgcatccggcgtccaacttcatcatagaggtagtcgagcagcacatgctcgtacttggtttgagccacctgcttccgtctcgtacggcgaagcgcctgagcgcgctcccacacccctcggtcgacgatcggctcatgaagcgtcttgtagacggccccgttgacgtggaactccccgatgtaaacagg

SEQ ID NO: 625490 - DNA, 379 bp, Homo sapiens
aggggggggttggtaaggctttgggggcccccgcccgtggggtggtgggttaaaggaccatttttttcattggggagggccccggcccttaacccccaccccggggtattgaaaaaaaaaagggggggggggggggggattagtttgtccccgctaaagggagataaaaaggggtagttagtttttggggccgccgccttttaggggaaaaaaataaagccttgggcccgggggagatttagaaaattatccttggcccaattaaggggtattttttttttttgggtttcccgaaaagcctcttaattttagggtttttcctcgaaggaaggggccccttttttttggaactggattaaaaaccccttttttttttgga

SEQ ID NO: 625491 - DNA, 101 bp, Homo sapiens
tggagagggagtctggctctggtcacctaaggctgggagtgcaggggcatgatctgcggctcatggcatcctcctgcctcccggggttcacaccaattctc

SEQ ID NO: 625492 - DNA, 987 bp, Homo sapiens
  misc_feature (528)..(528): n is a, c, g, or t
agcgtagaggcggatgcaggaagcctctgtgcatgctctatctttatccctcggggtcaccggaggggagatggtcccctagcgtgggcgtagaggaggagctcagatgggagccgccagatgaggaaaccaagatgatgcctaataagctctgcatcagacgtcacatgctacgctctgacaggcgtcatactcatgcgtgttccagtgaccatcgcttctgtcatagcaaccgttgtaatagtgctagcatctccagagctgttgggaggcgataaagatgatattggtgccccgacccgcttggacagacggggcgtcaaacgcttaggtatagcgattacctcggtgcctagctggacctagagcttttcatgaatagctggtggttagcgcaattggggcccaatagcatggtattgtctcacggcagctgtcgcaggaggagctcagagtgcagcttctgtctctgtctccatatagcttagggccgaatggttgcagggtcgatagagaaaaccctacagntggggttcgtgtttgaacgcccctcgatctctgtcggttcctctatcgcgacacccttaacgtgtaaccgacttcaggggcatatgtgtaaccgacattctaagggtctcacagaacgtgacacaacaaggagatcgcgaattggcttaaaatgctttttagcgaaacaccgctgtattataatcgacgcccacaaattttgggtgggagacacccaaatctattttcttaacgtttgtgggtcgggggccccattaatttgcctctaagtaacgcggcccaacggcgcgtggatcacagggggagtccgcgcgtgcgaacggtttgtatcgcactttaggatataccaccctattgtatccctaaacctaaatacaatatggggttccaacacggtgtatggccccccccctggtaggagaggcctccgtagtggggacatcgccattggggagtacg

SEQ ID NO: 625493 - DNA, 96 bp, Homo sapiens
  misc_feature (17)..(18): n is a, c, g, or t
ccatggatttgctggtnngcaggtacaactaggcttaataggggctcgaattcgagattcaagcttctaacgttagaagcttgaattcgagcagta

SEQ ID NO: 625494 - DNA, 85 bp, Homo sapiens
acttagctgtcatattgtcttctcgaacccagatgtaaggacatgcttctttaagaagccatataggcccttctgtcgtcttctc

SEQ ID NO: 625495 - DNA, 395 bp, Homo sapiens
tcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggtcaggcatgcaagcttggcttggcaacttctagataatttaaatccagccagaaagcatcagtaaaaattgttcctgaagaaggtctcttttgtcttactacatgtagtccactactgcagatgcattgttcatcgtgattatctttatccacacaacatc

SEQ ID NO: 625496 - DNA, 360 bp, Homo sapiens
  misc_feature (360)..(360): n is a, c, g, or t
ggcacgagctggtatcccttcctcttttaataagggcactaatcccaccaagggctccatcctcataatctcgctaaacctaattacttccccaaagcctcacctcctaataccatcacatgggggattagggcttctttaactttttaacttttaagttcagaagtacatgtgcaagtttcttatgtaggtcttgtgttgtggggtttgttgtacagattatttcattacacactcttaagcccagtacccattcgttattcttcctgatcctctttctctaccctccaataggccccagtgtctcttgttcccctctatgtgtccatgcgttctcatcatttagctcaccttgtgtgn

SEQ ID NO: 625497 - DNA, 1672 bp, Homo sapiens
  misc_feature (4)..(5): n is a, c, g, or t
  misc_feature (8)..(8): n is a, c, g, or t
  misc_feature (12)..(12): n is a, c, g, or t
cagnngangacngtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaataacctcatcaggttatatttgcccacataccctaagcaca

SEQ ID NO: 625498 - DNA, 541 bp, Homo sapiens
atccgcaaagtttgtttcccatctgggttgggagatggagaacaattttatcgcccccccagggtgttggggcggctccccgggaaaccccctggtttttccaaaggtaaaaacctggtaaggtccttgggcatccggagaaattaaaaaatttttttcccccgccccgtttggggggcccagccaaaagaatttttggaaaggggtttaagggggggggggtttaagttaagaaaaaccccctttcccaaactgggaaactttggttttgggctcccggaacccatcgttttgggtttcaaatttccccccccccttggtttccccggccgggcattttttttggtgcggggtgggcccggtttcttcctctcggccaaaaaggccgggacggggtgctttggggccaaccccaaattctccaaaagggggccccggggggggttcccccaaaagtataagggggtttccctttttggcgaataaattcccttttttttcccaaagacccataaaaatttttcatggaaatggcccaaca

SEQ ID NO: 625499 - DNA, 639 bp, Homo sapiens
  misc_feature (4)..(5): n is a, c, g, or t
  misc_feature (8)..(8): n is a, c, g, or t
  misc_feature (12)..(12): n is a, c, g, or t
cagnngangacngtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatattagtgataactaatttactacaggaaagagggtagtgagacaagtggattaagagtatcgcgtctcggtacc

SEQ ID NO: 625500 - DNA, 120 bp, Homo sapiens
ggctactcttgaggatcccaactcagtgtgctgagctgctaactcagtgtgctgatgctgctaactcagtgtgctgatgctgctaactcatgtgttacctgagctctgaattctgtaatc

SEQ ID NO: 625501 - DNA, 224 bp, Homo sapiens
gcatcacatagagcaactcagcatgcacatcacagactgccgcctgatcaagacggtcgtccaggtaccccaacctgtgcataccggaccagcccgaaggagagacatcatcattgtggcctgtgacgggatgcccatatctgccagtccactttgatgcttctgtggacggactcctaccttaggtcacagcagtgagatatgtgacatccctcaacctatga

SEQ ID NO: 625502 - DNA, 255 bp, Homo sapiens
tgtgtcatctagaggatccggtcgcgagagatacgcgacctgacaggtatgaggcaggctcccaggctgtcgggaaagacaggactgtctgagctctggcgtcttgggcgtctctgtcacccgtgaaagcaagaccttctgatgcagaatgtccaggagcccgcggcaggaaggaagaaccatgttttagagatccatctttttcccactcaaccgggggggacttgtggccttcagtttcacacacgtattcct

SEQ ID NO: 625503 - DNA, 512 bp, Homo sapiens
  misc_feature (35)..(35): n is a, c, g, or t
cttgattccttagttctaatctcacgttttgtttntaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctcttaaactgcttctaaaaatatctctgttggcctttctagccctttttctgttcccatccagtgccccaagcgcttttggtttttaagtgaggggctgggggtttaccaggaagtcccgggtaatttccccctgtaacctcgtaaaaccaagtcaaaggttgggagtgaagaagctaaaaagatggtaagccttggtccaattaaagttaaggtaaaaa

SEQ ID NO: 625504 - DNA, 260 bp, Homo sapiens
  misc_feature (80)..(80): n is a, c, g, or t
  misc_feature (173)..(173): n is a, c, g, or t
ctctaaggatcccatcgcacgacagagcagtagtcgaacttgctttgccttattctacatccctcgatgctcagctgaancgacaaaactcctcaggacagcttggtctcagaagacagtggatcttcagggcttcccattagactccattcttgatgctgtgttgactgtantcccaaagagacagtaacggggcatcttcagtcccaccactccagcacacacaggtcctgtgtggatgccaatgcgcaagcgcagct

SEQ ID NO: 625505 - DNA, 124 bp, Homo sapiens
tcctcctcactgttagatggaatcatgtggcattagttatttcgtgagtcacttatgttagtttagcatagactgtcctagaagttcatccagtctagtatgcaatcacaaggattttggaaga

SEQ ID NO: 625506 - DNA, 316 bp, Homo sapiens
caaaaaggggaaaaaaactttttatcccccccggggggggggtttccttagccctttggggcccccccaagttttaaacttcccgggttttggcaaggggggtattttttaaggggggcccccggttaactatgccggttttttttggggggcttaaagcccccgggcccccaaggggtttttatttttttttttttggggttaaggggaaaaaaagaaattggggattccccccggattccggggggggttccccccccccctttttttcccctttggtttttccccggccaaaaaatttttttttttttcccca

SEQ ID NO: 625507 - DNA, 822 bp, Homo sapiens
ctaccctggaagaaagggatggataggaagtagacctctgtttcttaccagtctcctcccctactctgtccctaagctgattgtacctgtgcctcccccataaaatagatcctgccatgtctaatgtgatgtgtgaagcttggcacgagctagtttatgctactctagtctccacttgctcaatgcttaggagagagatcagctccgtgagaggctggggatggtaggatagctggggattaagtgtcgtttacaaacggggttcgcagctctgtggtgcctagagtctacaactcgctaaggcggagcaattcattccggttcaccttgtgggctttgcaaagtcggccccggtgttacagaggataaatcccttctagattcagccttgcctggggtatgtctatacttacaatgtgacgatgcgtcgcaacggtatggccccttatcttgtttgttattaaaggactgtggacccatgggttgtttgcgtcccaggtggctggcattccggatacccggggtgcacacaggtgagcgcctgcgattaccttgtgcggcgtcgcccataagggcggggattttatatgtttgtgaaagcctatttagggagtcttgagtcagaaattggttgtggtttttaaagaagagaaagaggggcatacgctctagatgtggggctcaaggtggaaatatgtaggttcgtggcacctggatgagatgagcttaggaggaatcagcgataagtgaaccttggtggttgagccaccaagtcggttgtgaccaggttttcaaataagcccggcttgttttgtttaaagg

SEQ ID NO: 625508 - DNA, 155 bp, Homo sapiens
atcccgacacatagatataactgtggctttaaaaatgcatgaacacctttaattatcccgaatgaattagatttgtcttttcctcacccaccttccctccaaaacatgacataaacaatattttttggcacttgtgatccttgtggccctttccc

SEQ ID NO: 625509 - DNA, 448 bp, Homo sapiens
cgttctgcacatgtatctcagaacttaaactataatttaaaaaaaaattatcttcatctatagaaattagaagtataagttgatcaggttaatcaaaaaattctgtttataacttggagctaatgttaactgtcttgtttcttagaattgtacaatgaggtgccgggcacggtggttcatgcctgtagtcccagcactttgggaggctgaggcgggtggattacctgaagttgggagtttgagaccagcctgaccaacatggagaaaccccgtctctactaaaaatacaaaattagctgggcgtggtggcacatgcctgtaatcccaactactcgggaagctgaggcaggagaatcacttgaacccgggaggtggagcttgcggtgagccgagatcgcgccattgcactccagcctgggcaacaagagtgaaactccatctcaaaaaa

SEQ ID NO: 625510 - DNA, 1325 bp, Homo sapiens
  misc_feature (46)..(46): n is a, c, g, or t
  misc_feature (74)..(74): n is a, c, g, or t
  misc_feature (103)..(103): n is a, c, g, or t
  misc_feature (108)..(108): n is a, c, g, or t
  misc_feature (115)..(115): n is a, c, g, or t
  misc_feature (117)..(117): n is a, c, g, or t
  misc_feature (119)..(119): n is a, c, g, or t
acttcacttcttcaaccagtctactccacagccagcacactacacnactgccatcaccttcagttcccactacnttgggtaccatggtgacttctacatccangatcncatctantntnagtacagatatccctacctcacaaccaacaaccatcactccctcatctgtgggcatcactggttcattacctatgatgacagacctcacctcagtgtacacagtctccagcatgtctgcaaggccaacaagtgtcattccttcatctcccactgtccagaatacagaaacctcaatctttgttagcatgatgtctgctaccactcccagtggaggatcaactttcacaagtactgagaacactccaacaaggtccctcctgacaagctttccagtgacacattcattttcctcttccatgtctgccagcagtgtagggaccactcacacccagagtatctcctcacccccagccatcaccagtacactccacacaacagctgaatccaccccatcacctacaaccaccatgtcattcacaacatttacaaagatggaaacaccttcatccactgtagcaactacaggcacaggtcagactacattcaccagttcaacagccacatcccctaagaccaccacactgactcctacctctgacatttccacaggatctttcaaaacagccgtgagttctactccccccatcacttcttcaatcacctccacatatacggtgacttcgatgacaactaccacccctctagggcccacagccactaatacgttaccatcatttaccagtagcgtttcatcttctacgcctgtcccaagtacagaagcgatcaccagtggtaccacaaacaccacccctctatctacattggtgaccacattctccaattccgacaccagttctacacctacatctgagaccacctaccctacttctcttactagtgctctcacagattccacgaccagaaccacctattccaccaatatgacaggtacattgtccactgtgacctctcttcgacccacctcttcctctctcctcaccacagtaacagccacagttccaacaacaaacttggtaaccacgaccaccaagatcacctcacacagtactcctagcttcacttcttcaatcgcaaccaccgagaccccctcacacagtactcccagattcacttcttcaatcaccactaccgagaccccctcacacagtactcccagattcacttcttcaatcaccaataccaagaccacctcacacagctctcccagcttcacttcttcgatcaccaccaccgactcgatcgtc

SEQ ID NO: 625511 - DNA, 434 bp, Homo sapiens
tcagacgggagggctgatgagaggtagagcagcatgcatcgaggcctgagggtgcagggcgccctctctgggccgggaggaattgctcctagctagagtaagtgtgccacgagggtcccaggcagagctggagagctgggaaccaggaggctccacagtccttgccggctcatggacctccttcagagcacctttctacagactggacggcccagctccgtggggtggcatctggtttctggtgctattcgtgccagagttagtcgagtctcctcctcagtggtgtcaacagtgtccatgcttcccggtttctatcctcgtactccaagagtaagcctttctttagctcctaatcaagggatcgaggggctctaaccttcttcttgtccttcaaagcaggccaaagcgcagttgccatcagggtgatccttcta

SEQ ID NO: 625512 - DNA, 146 bp, Homo sapiens
tgttccatagacagcccgacacagccaacacagaaagaaagggaaacgattccagagacgttccagcataagggcctatgctagggccgtgctggcgctcgtgggcagtgtgctgcctgacctctgacgctgcgtctgctgcagga

SEQ ID NO: 625513 - DNA, 165 bp, Homo sapiens
tgggtttgtttttttgggcccaggggggctgccaaccccctccctcctgcctgggggggcctggccctcctggttgttgcaacgggggcttttggagcttgtccccattggacagtttccctgagggacccccagttttttcataaataaattccttccccgcca

SEQ ID NO: 625514 - DNA, 141 bp, Homo sapiens
gtatagtcggtgcaggaatgtagagaaagttagttggcatgttggactaagagctcacgatggaagccagccgctgttgtcacttcaggatctgatagagggaagttgtcgtcctgcgaaaagctgggcaactcgctcgag

SEQ ID NO: 625515 - DNA, 110 bp, Homo sapiens
gtgtgcacggtaatgaccaacctctgagatgtaccttcacaccagtgtcttctgggctctttgatactaaacacgtttctcattcaagtgaactgaaatgcttcaggtgg

SEQ ID NO: 625516 - DNA, 1130 bp, Homo sapiens
gactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggtgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttatggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccaggcagtttgggagaaagaagggtttacgtttttcaaacttacagataacagttgacatcaatgcttctctttcccagaacaatctggagtttgccagaaaactctgtaacacaggagtcgtgctgtgtgttgaactgtaactcttctctccaggcgtcgaggtggaccttggcgttactatgggcaggttggcgcctgccatccagaacgctgggtgccatttggcaaaacgcataaaccttcctttaacaggggaacaacgaaaagtcgcccaggtacctcccaaacataggcatgagcacgtggacactatattggccccaagaaattcaacaccgaggcaaacgcatctggaaacacaccggtacacatgggagggataccaacgggcccggtgctacacgaccacaacggctataaacacaacagccacgactcacccacacatatgg

SEQ ID NO: 625517 - DNA, 215 bp, Homo sapiens
gcgtgacctgagccccggtcccagtccctagtagtctgctgcggccgcggcctctcagccatgggcgccgtctggtccccccctgctggttggagggggtatcgccggagcacttttcgtttcggctagctgcggggccggccctggcgacaccgggcaaggccggggaatccgaccaggagcaaaggcgcccctccttggggacctccaattcc

SEQ ID NO: 625518 - DNA, 380 bp, Homo sapiens
  misc_feature (131)..(131): n is a, c, g, or t
  misc_feature (139)..(139): n is a, c, g, or t
  misc_feature (149)..(149): n is a, c, g, or t
  misc_feature (151)..(151): n is a, c, g, or t
  misc_feature (170)..(170): n is a, c, g, or t
  misc_feature (368)..(368): n is a, c, g, or t
  misc_feature (379)..(379): n is a, c, g, or t
cggctcactgcaacctgcattcaggtgattctcatgcctcagctactcgggaggctgaggaggagaatctcttgaacccaggagtcagaggctgcagtgagccgagacctgggcaacagagcaagacattntctcaaanaaaataatanantaaagaagtaaattgccgncgctgggaaacccaccaaaaccaagatggcgatgagagtgacctctggtatcctcacagctcattacatgctaattataatgcattaacatgccaaaagacactcccatcagcgccatgacagttttcagatgccatggcaacgtctgaaagctaccctgtatgttctaaaaagaggaggaactctcagttctgggantcggcccaccnc

SEQ ID NO: 625519 - DNA, 1148 bp, Homo sapiens
tgcgccgccgcgggggtgcgttatttattcctttgtcgtccctctgctcgttttctttggtgtgtgtgtggtgcggctggccccccccccccgcgtttttctctctctctcatatgttactcttctgttcggctacgcgtagcgtcattttctttttttgtctgcgcggcgttggtctccctcactctttgtgctggtgttgtcgcacctctctggccgggcgtcccttctctgctcgttggcgtccgccctcagcggggggggggtcgtcgcgcctctctttgtcgcttcctccccacccttccctcccgcttcttgcgcctcctcgccctctcgcgttcgtgtgttgccgcctctctctctcgcgcggtggtttccgctcactccttcgttttttgtgtgtggtgggctcgctcctctctctctccccccgtcgtgcgctcgctctcttgtaccactcgctctctctctgttgggtgggtattctctctcggcgcggctctctcttgttcgctcccctctcgcgggcgcgggcgcccccgcgcggcgcgcgcatggctctcctcgtagcgcgcacgcccgctccctctctttttctgtctatataatttctttctctctcctctcctcatttcttttttcgctccgcccccccgcctcctctctctctgtgggttcgtttcttcctcctctttgtttgctccccccgcccgcgcgcgaaagaggggtggttattacagtgagagatatatatattgtgtgtgggggcgcgcgcgcccccctctccccctttttcttttttctggcgttttctctcttctgtgttccccgccgcgcgaggctgtctctctctcctctcctctcctcctctcacagaaggtgtgtttgtttctcccggcgcccctctctcttcccacccctcctctctctctctgtgcggttgtttatttgtgtgggccccgcctcctcccccccgccggttctctctctctctcccgcgggcgcccgccctctcttttttctctttgccttcttttccgcgccgccgcccgccgtcccccccccccccccccccccccctctcttctctcttctttttgtgtttgtgtacacccgctgtgtgttttgtttgtgtgtggctcgccaca

SEQ ID NO: 625520 - DNA, 993 bp, Homo sapiens
  misc_feature (224)..(224): n is a, c, g, or t
  misc_feature (236)..(236): n is a, c, g, or t
  misc_feature (239)..(239): n is a, c, g, or t
  misc_feature (243)..(243): n is a, c, g, or t
  misc_feature (263)..(263): n is a, c, g, or t
  misc_feature (271)..(271): n is a, c, g, or t
  misc_feature (288)..(288): n is a, c, g, or t
  misc_feature (302)..(302): n is a, c, g, or t
  misc_feature (311)..(311): n is a, c, g, or t
  misc_feature (313)..(313): n is a, c, g, or t
  misc_feature (319)..(319): n is a, c, g, or t
  misc_feature (344)..(344): n is a, c, g, or t
  misc_feature (353)..(353): n is a, c, g, or t
  misc_feature (364)..(365): n is a, c, g, or t
  misc_feature (368)..(368): n is a, c, g, or t
  misc_feature (384)..(384): n is a, c, g, or t
  misc_feature (386)..(387): n is a, c, g, or t
  misc_feature (393)..(394): n is a, c, g, or t
aatatctggattgaagacctcaatggctgataggcgacgaggaaggacagccctggaaatggtccaggcagctggaacagatagacactgtgtgacatttggtattgcacgaggtaagaccataccctaggtaaattctcgtacgttacatgatcatgaagaacccggaagtggaattttgtggttacactacgacccatccttcagagagcaaaattaatttncgaattcagacncgnggtncccttccagctgttgagccntttcaganaggcctgaatgagctcntgaatgtctgccancatgtgctngncaagtntgaggccagcataaaggactataangctaaaaangcaagcaaaanngancccacattctagtccntnntgcagnntacaaggagaactgtcctgctcaggatacttctcttcctgcatggtgccagcaacccagaattagcacacgcttcgtggtcaaccgcatactctgtccttcagacccggcgtgattctagctgcccgaccccttgccagctgctcgccatctctgccaacgaaccctcatgtatcaccttcctaatccaatttcccatacacaaatctcacacaaaacacacaccacaacaacacacaccaacaactcaaacctaacaaacgacccacacccataaaactactgtctatacatgggaaacacacggaaccacggcacaacaagaagacaaacccgccacaacatcagcaaacaccaacccacagaaactaaatgaagccagacacacggcaatttctcacaagactcccaccagacacaaaccctcacacggagacccccaccacccacacaccatccctgcgtctcgcacacaacaccaccccccatctaaccccaaaaaaaaaaccacccgaaccacacaaacaacaccacacggcaacacccgcgccacaccaatgacgaccaccggccccccccccgcacaagcattctacagac

SEQ ID NO: 625521 - DNA, 564 bp, Homo sapiens
  misc_feature (224)..(224): n is a, c, g, or t
  misc_feature (236)..(236): n is a, c, g, or t
  misc_feature (239)..(239): n is a, c, g, or t
  misc_feature (243)..(243): n is a, c, g, or t
  misc_feature (263)..(263): n is a, c, g, or t
  misc_feature (271)..(271): n is a, c, g, or t
  misc_feature (288)..(288): n is a, c, g, or t
  misc_feature (302)..(302): n is a, c, g, or t
  misc_feature (311)..(311): n is a, c, g, or t
  misc_feature (313)..(313): n is a, c, g, or t
  misc_feature (319)..(319): n is a, c, g, or t
  misc_feature (344)..(344): n is a, c, g, or t
  misc_feature (353)..(353): n is a, c, g, or t
  misc_feature (364)..(365): n is a, c, g, or t
  misc_feature (368)..(368): n is a, c, g, or t
  misc_feature (384)..(384): n is a, c, g, or t
  misc_feature (386)..(387): n is a, c, g, or t
  misc_feature (393)..(394): n is a, c, g, or t
  misc_feature (557)..(557): n is a, c, g, or t
  misc_feature (563)..(563): n is a, c, g, or t
aatatctggattgaagacctcaatggctgataggcgacgaggaaggacagccctggaaatggtccaggcagctggaacagatagacactgtgtgacatttggtattgcacgaggtaagaccataccctaggtaaattctcgtacgttacatgatcatgaagaacccggaagtggaattttgtggttacactacgacccatccttcagagagcaaaattaatttncgaattcagacncgnggtncccttccagctgttgagccntttcaganaggcctgaatgagctcntgaatgtctgccancatgtgctngncaagtntgaggccagcataaaggactataangctaaaaangcaagcaaaanngancccacattctagtccntnntgcagnntacaagcaggaccaccctcaggatggtgcagaacccagaattgtgattgcagcatgtactgtcctgtaggaaagaaaatgtggctctagctattgacccatacagctgttggaatctctgcaagtatatttgcctaataaattctctcttttgtttaacaaanaaaaana

SEQ ID NO: 625522 - DNA, 567 bp, Homo sapiens
tgctgatgagtacaagtgtgacatctcattcacatgttagttgtgatgatgcagatggatattggtttcaattagaaggcggatccttagtacggcattttctgaattctgtattaatattggtgttaaagtagacatagctgaggctcagatggaatcctggagtttagttatcagcagcttggcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttacttcggtttaacctatacacaatgattaagtgcatttaatatgggtaatttaatgaaaaccattccttgcccaatggatgtataaatttttgaaagaataagcagaattatataatatgaaatgctatgtaaagttttctatgtaaaaatattatgtataatactata

SEQ ID NO: 625523 - DNA, 229 bp, Homo sapiens
  misc_feature (158)..(158): n is a, c, g, or t
  misc_feature (190)..(190): n is a, c, g, or t
gaatttaggagttgtaggaagctaatttagacaggaggctcagggaaagttttgctgaggaagtagaaacagaatcctcaagatttagctagcttcacaaagaaagcaggagatacacaggacaggaagtggcccgaggtaggcaggagctgactggntcaagaaactgaagcgtagtgaggggcaagtntgctggaaggctaaatagggtgatgttgctaaagcaagg

SEQ ID NO: 625524 - DNA, 1735 bp, Homo sapiens
  misc_feature (1103)..(1103): n is a, c, g, or t
agcaggcgtctgtcatctgtgcttcaacaagtgtgattggacaggagacaagatccggtggactctactatccatgcctccggaacgacccatgccgagtatataccatcattccgactctgacaaagcataccgtgagaaccagtcgtatactcagtgctcattctacacgttggcgttaccttggggaccccattgacccacgccaacccagacacccaccatgctcggatataatgtgtacacattcataatgtcccataaccacaaagactcaatatgaaggcacatccctccaagcatctcttcagacttcgagcgacaagtgttccatagttcccaaccacgtaccctgcctgtgcaagagagcacgcctccgcattccaaacctaacggcctccattgggcttcaaacgtaatcttgaataagctccttgcacaacgctgcgcacattctccgataaatcaaacagctttaatcccccattccatacccattactactctgctggaggaccttactacactgaagttactatccgaggatgcctccttggcgcgcaacgcagaatcgtggcctacggcgagccattccctgtcggcggaacaccgctgccaaggcttgggaagaggccccaaacacacttctatccatattatcctacctcggaccgagagactacttacacggaggccccctgtacagcgagccatgcgaaaacaaggtgctggcccagtgaatcgagtgctgcccaataactagggcaagctacacgacataccatccccctcttctgaacaactggaaacttagggccataagtacagactcgcccagaggaccgcgcactatgcgggagcaacgctagctctccggctccgatgcccttacacttctctgcttcttccccccagcaggaggaaagctacagtgtccgacactaagcagatagcagcgccccactagtgcgccgtctgccaaacgacagcaagcttgacaaagcctatggagcgcgcggaactaaacatagcgacccccaccgccaaacataaaacgcgaaccccccaaacccgcgcgatacgaacagcgctccgcatcgcgnccaccaacataggacgcacaccacccgactggacacacactgctacaaacacacaacaagaggcactcgcggagcgacacgctccccaacgtcgcggacccccacgcataatccacgtcggtgcgacaccttaggcgactcctccatacattgacaccacaaaccccactcgcgacgacagcactacacgagataatgggccccccatgaggccacaccccctaagtgtcgaaaccacccaactcccccgcaacgacacccctctctcgacgagcatagaagacgacagtactaccccccaattcagcgacacagaagcatatccctagccgctactaccccacctcaacgccgacatttcggccacgcgacaccaacggtctgacaaaaggcgccccaacaaccttccacagcatccacacacccgaaccgctcgcacgctcggaagaccaaacccctaagacaaacccccacacacgaccttctcccaccaaggagcgacatgcgcgaactatggggcgcccccagcgaactagagacccactgtggcgcgctcagcgcgaacaacgcaggagcaaccagacatgccaaagacacgagacgaatgggcgcccgcctctcacaaccccaag

SEQ ID NO: 625525 - DNA, 215 bp, Homo sapiens
aggagttagtttcaggagagtgagaggtgcattttgtgagtcaggcgagtagaagtttctatgagagattcgtgcgtgtgtagttagcggtcgtagattcatagtagtagagtctgcagcagtcagagagatgatgggaggataccctcgtaattgcacagtttgtagccgtcacggagtcatcacgatgcattggccagggggtacgagctcga

SEQ ID NO: 625526 - DNA, 856 bp, Homo sapiens
cttcaaggtctgaagtaggacttttaccttaaaaaacaacaacaaacaaaactgtttaaccaatcttcttatctatcctgtgtgatagttaagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtatattaataatgtaagttctgatttaacagaatggtgggaaaactggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgacaataaagttttagagaaatgttcaccacacacaccccgcctccccccccccccaccacacctccccaccccccccccgcccgccacacaacacacaccacagagggcgcccccacaaaactacacagcgggcaccccctctacccccccccgtctccagcacacgccactacaacagcccacacaaacacacggcgcgcgccgcacccaaccgccccggacaaa

SEQ ID NO: 625527 - DNA, 356 bp, Homo sapiens
  misc_feature (23)..(23): n is a, c, g, or t
  misc_feature (253)..(253): n is a, c, g, or t
tagctacaaatgagattacatcnaactaaaaagctactacacaacaaagaagacaataagcagagtgaaaagttagcctattaaatggaagaaagtatttgtaaaccatatatctggtaaaggattagtctccaaagtatttttttaattcctacaagggaataacagaaaactaataatctaatttaaaaatgggctagagatttgagcgaacattccccaaagaagatatacaaatggtctcaagtatatnaacaatgctcaatgtcactaatcatcagggaaatgcaagtcaaaatcacaatgagagggaagaggcagagcaaggtgaccaaatagaagcctgcagcaatcgt

SEQ ID NO: 625528 - DNA, 135 bp, Homo sapiens
ggctcggtacctactttccacaggactgatataagaggtatgatgtagggctaagtggtttgtgctcaatttagctttcaggagaaaataattgacttaacatttgatactaaaacccaaagcctaacagttaat

SEQ ID NO: 625529 - DNA, 820 bp, Homo sapiens
gctttacggaggaagtagaggtgatgcttcagatacatctgtgaatgtgaatgccagagcgaaggcatacctgaaagtgccaagtgtcagtgaaggcacggggacattcgagtgtggcgctgtgctagagtgcgaatgaagggcgtgtaggtaggacattgtgaagtgcagcacagatgagacgttatactagttgaagacatggatgcttgactgcacggaagagaaaccctttcagaatatctgcagtaacaatggtcagtgcgtcttgcggacatgtgtgtgtgtacggaagaggggatactaccagatgaaattcatgctggcaaatgacggggagtggtagatagttgcaactgtgatagatccaaatggtgttaattggtggaggaaatggtgtttgcagtgtgtcgggtgtgttgagtggagatcctaaaataaattgaggagtgcactgtgaatgttctttgtgatacctatgtactcgtggaagcctagcaacggacgagatctgcaagtggacggggcgtctgcaacggtgtgttgtctggttagggtgtaccagaattctgagggatatcaacgtgggaaatcgtggtgtcgcatgtggctagatcatgccattaagtggtttgggctgaccattaacggattgtgttgcggagtcgaggcttaacacaggagaattagcctcctcctttgcacccagtaagtgtcctacttcaaagttaccaggtacaaagttggactaaattaggcagggggcaactcgatctgtcgcccgtagcaaacgatttccatggggatattaacagaagag

SEQ ID NO: 625530 - DNA, 397 bp, Homo sapiens
gctgtgttatacccttaagcttgatatcttttctgtttcctggtttcttccattgtttatcaaccttataatgtcttttattcagagctcccaaaagcctatattggagtgatatacaattactttttaaataaatagaatgttttatataataaatggtatttttggaaagtactggattatgcaatatgaactgtaaatgtctccagagtatattacatgattgtcctaacaaaaaaaaaaaccctttagtactttattaagtatttctcgtattcaaaattatctcacctgtgtgctgaactagactgtaatccctttggtggaaggaaatttggtttggtatgtggttttaaatctcttgcagtttctctcgatcagtgccaggacttcagac

SEQ ID NO: 625531 - DNA, 620 bp, Homo sapiens
  misc_feature (8)..(9): n is a, c, g, or t
  misc_feature (320)..(320): n is a, c, g, or t
  misc_feature (342)..(342): n is a, c, g, or t
  misc_feature (379)..(379): n is a, c, g, or t
  misc_feature (383)..(383): n is a, c, g, or t
  misc_feature (395)..(395): n is a, c, g, or t
  misc_feature (415)..(415): n is a, c, g, or t
  misc_feature (423)..(423): n is a, c, g, or t
  misc_feature (433)..(433): n is a, c, g, or t
  misc_feature (462)..(462): n is a, c, g, or t
  misc_feature (470)..(470): n is a, c, g, or t
  misc_feature (480)..(480): n is a, c, g, or t
  misc_feature (495)..(495): n is a, c, g, or t
  misc_feature (499)..(499): n is a, c, g, or t
  misc_feature (514)..(514): n is a, c, g, or t
  misc_feature (609)..(609): n is a, c, g, or t
caggcggnnagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccagagtgggactgtgtcttgcttcatgattcctctctccattactctccctgcccttctctgttggggtgccttatcctgagccacctcctctccccgcttgcctntgctcccctgaacctgggaganagatgaggagactggctcagcaaggcccctggaggtnaagnttggcctttgcntcctgttcccatcccccagncctggctnctaggtactnccaaatgggagggagtataccgtgacacncacttaanagcggtctcnaccccgttcccctanacangaaatccttggaaancaaaatgctgcctgagtaagggatgaagctttgagcctcctgcccctgcttttctgcccagggagggagaaggaagagggggagctggttttttntggaggttacc

SEQ ID NO: 625532 - DNA, 237 bp, Homo sapiens
gaacagctgtgtcgtgttccctgtgaaactgagcaggtgtgtgttggcgcgctaagtgccacatgctcgtgcgtagaggaggatgtggcctctccggctccgcgctagtgcgcctgtgatcccaacctgctccccgctcctgttgccagcagcactcgctgcactcctttgtcatatgctctgcatcactgtcatactcccaccttcgtgaacaaagttgtgtgctttattcgtaac

SEQ ID NO: 625533 - DNA, 138 bp, Homo sapiens
gctcggacctgtttcttttttctctcaatatattgatcacatggactccatccttaaaatgagcttcatgaagcttcttaaagtttggagtagtgatcgcagttcttttattttttccaggtttggatgactcatctg

SEQ ID NO: 625534 - DNA, 543 bp, Homo sapiens
ccccaccaggcttgtgaggaagcgcctgcagacagtttctgagccatatccacccctgggaaacacataattaccagtctcaagccctggtggaattggggctgtcttatatgtgcgtataccccttactggactggggaaggaggcggtgagggctcctttctacctacagagcgctgagcctccagtctcgatgcccctgcatgccccatgtggtaggtgctgagctgcaaaccagcatcacaccaactgtgacacagggatgtacctatcttggtgaagggtgggggccaagaattgagcatgacatcttgcccagtaggcaccttctgtgagatacctcaccttgtacaaaccatatgcaatctaacctcagcccgaggcatgctccccaacgcgctcttctgtgcttatgggttggacccctgctgaggggacaggagagggagtgtcgaggacctgggcctccagaggctggatctgcttatgctgtggcttatactgagggacctgggctggtgaggtgggcctttcacggtgtct

SEQ ID NO: 625535 - DNA, 301 bp, Homo sapiens
cttcgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtacggccctaaataacattttttatttgacagcaccttgcatgaaattctgtagggtccagccctacagggtctgtgggtttttctcccc

SEQ ID NO: 625536 - DNA, 93 bp, Homo sapiens
tctgaggacacggccgtgtattactgtgccctcaggccgtattacgatttttggagtgggataaactacaatatggacgtctggggccgaggg

SEQ ID NO: 625537 - DNA, 287 bp, Homo sapiens
aataaaaaggaataaactctcgatacatgtcaaaacctaggatagatctcaaagggattgtgctgaatgaatacaatcaaatctgattccattcagcacaatccctttgagttctttccattcttttgacatgtatcgagagtttattcctttttattgctgaatagtattaatattctatagtatggatgtaacatagtgtgtttaaacattcgcctgttgaaggacacttgggttgtttccagtttcaggttcttacaaataaagctactctgtgtgttcatgta

SEQ ID NO: 625538 - DNA, 389 bp, Homo sapiens
  misc_feature (161)..(161): n is a, c, g, or t
gatcctcctattggatccttctgagttaagtatcaatcactgcatctgaatatactacgatactactttgagaagagagatcatcttcacataacttttaatacactgtatttttataactgttctgttttattatagttgttgttactctcttcctgtgnctaatttataaattaaactttatcgcaagtatgcatgtataggaaaaaacatagcatatatagggtttggtactatctgtgatttcaggcatccattggggggtctgggctcatatcccctgaggataagggggggactactctgacatacaaccaagtctggtctctgaaggaagtaaagccaaacagttctcaccagctggtcacaatctcctttgtaagtgagaa

SEQ ID NO: 625539 - DNA, 368 bp, Homo sapiens
cgcggtctaccgcctttgtccagtgcgtgcctagacgcggtgttcttgctacgctgagtgccagtcccgcttgctcaagccacgttcaaagtaaggctgatctgatctgtccttcgtccgacctttgcccttgtatggcagtctcgcattgtacggggtctttggtactgctctgggtgcttcgcctcaggctcatcctgcagtgtctcctctcgtgggttgtcgtgtgacagccgtgtgccctctattggtacagtctggatggtcctcactggtcacctctctcgtggtagccgccatggttcgcaggtgtatcgtcagagatagtgtgagagcgtgtagagagatagagagagagagagagagcg

SEQ ID NO: 625540 - DNA, 547 bp, Homo sapiens
aagataacaaccagtgcctagaagcacgacattgttgctagaatctaaaatctataccttacaaattacccaagttctaagcttcgtgtatttcttttttattgtttttgtttttttgtttttagaaggagtctcactcactctgtcacccaggctgtagtacagtggcacaatctcggctcactgcaacctccaccctccgagttcaagcaattctcctgcctcagcctcccaagcagcctggactacaggcacaggccaccacacccctgactaatttttatatttttagtagaggcggggccccaccatgttgcccaggctgttctcaaactcctgacctcaggtgatccgcccaccttggactcccaaagtgctgggattacaggcatgagccaccgcgcccagctgcttcttgtattttctgagtttatttatttctctgatgctcatattagtatatttgtatgccttattcagcatgccaaggaaaccaagggacggtgattgtaatctgtttggttatacacaccagcggaggctacca

SEQ ID NO: 625541 - DNA, 285 bp, Homo sapiens
  misc_feature (9)..(9): n is a, c, g, or t
  misc_feature (85)..(85): n is a, c, g, or t
  misc_feature (92)..(92): n is a, c, g, or t
  misc_feature (217)..(217): n is a, c, g, or t
cggagtggnacacagatggggatggggcgttgtcagaagcggaagctcaggccctcctcagtggggacacacagacagacgccanctctttntacgaccgcttctgggccgccatcagggacaagtaccggtccgaggcactgcccaccgaccttccaacaccttctgcccctgatttgacggagcccaaggaggagcagccgccagtgccctcgtngcccacagaggaggaggaggaggaggaggaggaggaagaagaggttgaagaagaggaggaggaaggag

SEQ ID NO: 625542 - DNA, 387 bp, Homo sapiens
  misc_feature (14)..(14): n is a, c, g, or t
  misc_feature (36)..(36): n is a, c, g, or t
  misc_feature (42)..(42): n is a, c, g, or t
tttttggataaacntggaattgaatccttttgaaangcttgnaaccctacatttgtccctcaagtcttctccaaaaaaacgtatcaaagaactgaagctcaccaaatcatggcatgcaatgagatgccagaccggtcattcctcatgattgcttccttacccctctctagttctgttttcttacacattgttacatttatttcttactatataaacctctaattttagttggtaagagagatggatttgagactgatcaaagccttcttctacggcaataatcattgtctccgtgattggctttctgtgcagcaagcagcaggacctagactaaacccctggtgatttggtaacaatcatatagtcttgactcctaaatctgacttc

SEQ ID NO: 625543 - DNA, 507 bp, Homo sapiens
  misc_feature (35)..(35): n is a, c, g, or t
  misc_feature (72)..(72): n is a, c, g, or t
  misc_feature (74)..(74): n is a, c, g, or t
  misc_feature (76)..(77): n is a, c, g, or t
  misc_feature (96)..(96): n is a, c, g, or t
  misc_feature (120)..(120): n is a, c, g, or t
  misc_feature (246)..(246): n is a, c, g, or t
  misc_feature (485)..(485): n is a, c, g, or t
atcataccacatctggcctctgctcagaatcctcncgtgactcccatctcattcagaggaaaaagttctcgncncnncctccctgatctgacctcnccacctttctgacctcacctgccnccacattcccctgactcactgtgttccacccacagtggcttccttgctcttcctcaaatatgccatgtagagtcccacctcagggcctttgctctggccgttccccctgcctggacttctcttccncgagatatccgcatgactcactctctcacctcccttaggtctgtgctcagatgacacttcctccgtgaagcctcccctgtccacctcatctaaaactgcagcatcttccccacccctagcacttcctatcttccttccctcctttatgtttattcttaggaacttgtcatcatctgacatactatacttcacccgtgtctcttctttgttatctagaatgtcggttccacaagggccgngatctttatctgtgtagttcac

SEQ ID NO: 625544 - DNA, 564 bp, Homo sapiens
acggtggctccccacactttgggagcctaaggtgggcggatcacctgaggtcaggctttcgagatcagcctggccaacatgatgaaacccaatctccaccaaaaataaaaaaaattagccaggtgtggtgccgcacacctgtaaccccagctacctggaggagacaggagaattgcttgagcccgggaggcagaggtttcggtgagccgagaactgccactgcactccagcctgggtgacagaatgagactataaaagaaagaaagagagaaagagagagagaaaggaaggagagaagggaagggaagacaattagagattacttcaggagattcaacatccgcctaatagaaattctagacagaggaagtagagaatagagaggccaggtgcagtggctcacacctataatctcagcaccctgggaggctgaagtaggaggattgcttaaggccaggagtttgaggctgcagtgagctatgattgacgccactgcactccagcctggaaaacaaagcaagacctcgtctctaaaagtaataatacgccgggacggtggtccca

SEQ ID NO: 625545 - DNA, 155 bp, Homo sapiens
ctgaaatcccatgaagtgcttggttcggcctatgtattggtggcaggctggacacagctgaatcgtctttctgggtcaccctgtaactcactgtcccctttcccgttctctacccaacgctacttatccgcagatattggatgccggctgccccc

SEQ ID NO: 625546 - DNA, 199 bp, Homo sapiens
agcgactcttatgagaagaagatctgctgagtcagagcgagtgcatgagatcttcaaacgcatctcagatgaggagtgtttatgtgctgggcattggagcccctgttatgcacgtgcagagtgtgatgattgtcacaggtgcttgcctgtgccccctgatctccgttgcggccttgctgtatgtgcatgcattggctct

SEQ ID NO: 625547 - DNA, 763 bp, Homo sapiens
ggagagagaactagtctcgagtttgatttttttttttgggttctaaagggggtaaagggggtgctatagggtaaatacgggccctatttcaaagatttaggggaatatttctaggacgatgggcatgaaactgtggttggctccacagatttcagagcatggaccgtagtataccccgggtcgtgtagcggtgaaagtggttgggttttagacgtccgggaatggcttctgttttaagcctaatgtggggacagctcatgagttgcaagacgtctgtgatgtaattattatacgaattgggggcttcaactcgggagtactactcgatggtcaacgctcaaggacggttcgcaggttcgccgtggcttcctaggaacttaaggggggacagttaatgatcgggcacgttcaggaagacatcaacctcccgacgattacactccgcatgaacctcctcgacggttgcacgctacaccaatgtcggggcgccacaaccagattctccgaccgggccacgggcacgggacacgcccagcccccccgcaccacgacacatcctacaaaacgaacaagaccatacgcacaaggcacgagagagccaaggaaccgtccttacgaaacagatgacggacccctgccatacgtaccccacgggccccgactccaccccgcagccgtcgagcaaaagatagcaacctaaacgctcacgtccgaacggtcaaccacaccgaccatcccggaacaagaacccgccctgcaccgc

SEQ ID NO: 625548 - DNA, 917 bp, Homo sapiens
gaggggcggttggctctgtagggtgagcttgtatgtgtccctgtggctggacgtggttggttgattggcaggatcctgctatccgctagcaggtcaagatgcagatcttcgtgaaaacccttactcggcatgaccgtctacccttgaggtgagagcccagtgtacaccatctatgaatgttgaaggccatgatccaggataaggaaggcattccccccgtaccagcagaggctcatctttgcaggccatgcagactgaataagatggctcgtactctttctgactactgatattccatgtagggacttctgactccgtgcctcgctggtctttgccgattctgaagagagtgcgttatgcacgatcttcaggagaagaccctgggcgtcaaagagcagtcagcctggaagctggcagcccagggactgcagtcgaaagctgttgataggcctgcgatcctggttaaagtgggcattcgtcccgaactagtagaggctcggtctttgtctggccaagccagcgtgcaagatgtccgcatgtcttgtctgaacttagaacttttccagaccggtggtcagtcccgtgactaactgtgattcttggggtctgcagaagtggaggagtgcctatctgtcgttgattcactgtgactgtatactgcatctccctgagagagtggagtcccatatgggcaccacccatatatcttttaaggactcggcaccttgtgttaagggaaggtttccctccccgaccaaacgggagggatacttttcgggaggccagcggcggtaaaaagtggcgtgcacactgtctcctttactattctggagtgagggcacgtgctcggaacttggcacatagttcggtgtgctctctacctttttttttggccgattgatggttttgggcgaaca

SEQ ID NO: 625549 - DNA, 546 bp, Homo sapiens
  misc_feature (385)..(385): n is a, c, g, or t
ggatggtctgcccagaacggggatgagcactggcgagacctatctcgtgctatacgctgacgctgacaagccctacaggagtgtgggctatctccctagctccgtggaatcactacagaaggtgccagaggacccttacactctgctcagtgaggaacaagcccacgccgaacaagttcatcctcaagacttcctggacaagacttttttctatagcggcactgtgagcctcagttacccaagtggaagcggtctttctaatgcttgagactgatgacgacacgtttgttgcttactctgtcaaacaagaatcccactagaactgtcttgctgtaggcactggattactagatgacctgaagaatgaacgcgtaaagtcagttgngaaagcaggtaatattgacgacacggtatcaatcaaactagtgtgtacagctcggctctcgagttcgacttgtcatgaccaatgagttagtgtgaccactcttacaacccaggcattgtctatataccgcccaactaacttaatttccatgtctctctggg

SEQ ID NO: 625550 - DNA, 184 bp, Homo sapiens
ggctcggacagtaaacgcgcatgtcgcacgcccgctcaggtgactggctgcaacatgaacacaagtcattgattcgtaataagcacaggctatatttaacgagtatttcactcaatgacagtggcacctcccgatactctggtttcgctgatcccagcctatcgagccgccatgttcaatcgcg

SEQ ID NO: 625551 - DNA, 708 bp, Homo sapiens
ggagagaactagtctcgagtaatcagagggtagtctctttattttaaaaatatatatttataaattggtttacatatcgtctcctcaaataaaaggttcaaaatcaccttataaggtaacgcagctggaaggaacaggggggaaaaacaagggggacaaagggaccgtcgggtggtatccctccaacccaggagcccctggaaggtccacggggcagccggcaaggcaggccaggcggccccaggaatctgcccagtgcacaggcccaagctactacaggagccttcacggggaggaacaggacagccatgagttgtgaggaaaaaaaaagccccctcagacataccccccaggagtgtgctcgcctcgtggaagtggggacaaacaacacacaaggggggtcgtcttagttgggaccctccaggacctgggggagacacgacggcaaccaagacggggactagacccgcgagggcgggcaccgagcgccacacggggagtgctcctagggcataagcaaaagaggggcacccccagaacacgagaggactacacgccttacgaaaaagaggaaggcgcacacgctgggtggcccccaagtacgcccccaacacaggcaacggggctcctcgatcgctggcgaggcgcaaaagtggtcgggcgcgcaacggggtgcaccactagggagaggcaaaaacgtctgccaaa

SEQ ID NO: 625552 - DNA, 255 bp, Homo sapiens
acctagaggatccctctgctgactattatttgtaatgtggtgggtgagtagccccattgtgttgtggtaatatgtagagggagtatagggctgtaactagtatgttgagtcctgtaagtaggagagtgatatatgatcagggagaacgtggtatctagcacagagagttctcccagtaggttaatagtggggggtaaagcgaggttagcgaggcttgctagaatgtcatcaaacaagctatatagtgggagatag

SEQ ID NO: 625553 - DNA, 100 bp, Homo sapiens
agcacagaggaggctaatggcagagcccccatcacctcaggcttctcagttcccttagcctgtcttactcaactgcccctttcctcccctcctctgtgct

SEQ ID NO: 625554 - DNA, 131 bp, Homo sapiens
tctacgagagcatcactgaaggcgctcacgctgaggactctgagcttgtgaagaagctcactagtggacacagagtgacacggttgattgacagagccagctgcctccttgttctgtaattccaggagggg

SEQ ID NO: 625555 - DNA, 130 bp, Homo sapiens
gtgaaggatcgctatcgatccatgcaacgccattatgatgttcttgcgacctaacataataacataatgaagagaggagctaagtagttagcttgcacgcgagctatgcccgtggatcaccatcgatcca

SEQ ID NO: 625556 - DNA, 282 bp, Homo sapiens
ggaatgagaaagagtactaatctgtcaatcctgtcgtgtcgggcgggtgaggtttcccgtgttggccaggctggtcttgaactcctcacctcaggtgatctgcccgccttggtctcccacaagtgactgggacttacaaggcgtgacgctgcttgcttttgacacggctcctacacatgttggactggcctaccccttacttttctgaccctacccactactgtaccaacttaattcggttctgacaacctttcgaaaaactcatctgaccttaaaactcta

SEQ ID NO: 625557 - DNA, 1036 bp, Homo sapiens
  misc_feature (395)..(395): n is a, c, g, or t
  misc_feature (811)..(811): n is a, c, g, or t
  misc_feature (1036)..(1036): n is a, c, g, or t
agcggagggagctgattggagcccggttgcccggtggcaacctctatgattcactggcagtctcgctgcgtgtccctcgcggctgacacatgcggacagacgtacaatggctacatccagtatgccggtggaagactcgcgctgcacggctccgctagtctgcctggcacatagctggggactccccatcttcacgccccgctggagtagacatgtcacgatcggctacggcgcctcatcgcggatctctcatctctcactcgcgtgtcgtgatgccgagttcgcggcggttggcgccaagggaatccctgcgtcagcggcttgactctcctgtgtcgtgcctagcttgacgacgcatggagaacatattgtggctctcgagaggacaacggtcncccatgcgttccgttcctcatggccacgggtagttgcttggatgaagcacttggcgccttgacccacttcctgcatttctagcaaggaaagcaggcgatggtctgaaaggggggcgattggcctagcaccgcatgacccgatcccacagcaggagtagggtaccatctcctttatcgctcctggcaaactcctcatgactagtcgacgcatgggcgcgagctaaagcgtagtggatccgcgcaacgcttccgttcactcataccgcgtggaacgagattcaatcagatcgctcatcgaactctagaagtttcccaagagccattagtcgccatgcttccttagccatggccccattgggccacgacgaaatcggcttatgaaagtagccttgctacccaagaattcgcctaccaangacgttcgctttgcgatgagagtcggcagtatcaatgctggggaggcccgggtttgcgttgggcgtcgttcttaggcgcctttcccggctaaccgggtccttggccccatactactgtgctaagcgatggatcgggccctgaattgtgctttccttagtgccagtggtggcccccgcgaccttggcgccgactttccattgctagttgcagttgcgttagcccgn

SEQ ID NO: 625558 - DNA, 252 bp, Homo sapiens
tgggcttgactcaggatttaaaaaggggaacggtaaaggtaacagcagtcggtgtggagcgagcactcccccaaagtttcacaagtggtggccgaggactttgatggcacattgtgtgttttttaattagctcatcccaaattatgagagtgcgttgtcacagagaagctcccttgccactcctaaaagccaccccactttctctctaaggagaatggcccagtcctctcccacgtccacacaggggaggtg

SEQ ID NO: 625559 - DNA, 375 bp, Homo sapiens
  misc_feature (64)..(64): n is a, c, g, or t
  misc_feature (93)..(93): n is a, c, g, or t
  misc_feature (100)..(100): n is a, c, g, or t
  misc_feature (137)..(137): n is a, c, g, or t
  misc_feature (147)..(147): n is a, c, g, or t
ggccaaggtttttgcctctttaatgcccatctctgccctggttcccccggccaaattgcctgcnagtgcccttcgttcagaaatcacatgagnccaggcntggtggctcacccctgtaatcccagcactttgggagnccaaggtggncggatcacctgaggtcaggagttcgagaccagcctggccaacatggtgaaaccacgtctctactaaaaatacaaaaattagccgggtgtggtggcgcacctggggtcccagctattagggaggctgaggcgggaggattgcttgaatccaggaggcggaggttgcagtgagctgagactgagccactgcactccatccagcctgggcaacagagcgagactacatctc

SEQ ID NO: 625560 - DNA, 397 bp, Homo sapiens
ttttggtattccgtgtacaccatccttggtgttttttgcctttgtgccttcaacctgttgttcctggcctggggaaccctttaatttcttttaattcttctcccccttttttttttttttttttttttaacctacaaatagctttcagttcaggcactgtttaaagccccagggtgggttaggtggtttaggataccaactccccctcaacatttttccttaatccaacagtaccgtaatttgccgaaacttgcctggtttttcctaatggactttaagccctttaggggcagggacagtgttttattcatttttgtgtttttagtgcagagcctggcccgcttttggtgtttaataaagtgtgttgatttgaaatgcccccggcccaaaaaaaaaa

SEQ ID NO: 625561 - DNA, 330 bp, Homo sapiens
agattggacagccgtctgaccacgttgtgactgtcatgcctgtgccgaaaaatacaaaatttagccaagtatggtggcgctcacttgtaatctcaactactcgggaggctgaggtgggaggatggcttgagcccaggaggcagaggttgcggtgagccgtgatcacaccactgcactccagcctggttgacagagccagaccttgtctcaaaaaaaaaaaaaaaaaaaatttgtgagggagttaagaaagaggaaacgtagcgatggtatttaatagacaacttgcttattaatcctaaaagttccatagatggcatagatggttacggg

SEQ ID NO: 625562 - DNA, 259 bp, Homo sapiens
tcccttgctctttcagcggattcgttcgctacttgaacgcacgccctggatgggggactgacagctaactcctatagcgcagagggaggggtggtggcacacgggcggagggcggtggtgtgggcagcgcgaggacctattctttagttgagaagcaaggggcagtcatgggtgtggagagggcagtgccaaaagaaaacctagacagcatctacgagaagttcttgaagacgtccaggtcgaaggcggtgttcaagga

SEQ ID NO: 625563 - DNA, 793 bp, Homo sapiens
gactggtaatagtaagtacacagaaaaacacagaatattataacactgtaattgtgctgtgtaaaccactcatatcttaagtagaaaggctaaaagataaaccaataaaaaataatatctacaacaacttttcaagacgtagtacaaaaatagaaacaacaaaaagttaaaaagtgacaggacgaatttaaagtgtagagtttttattagtttttcctctgctttcttgtttatgcaatctgtattaagttgttatcagtttaaaataatggcttataagatattatatgcaagcctcatggtaacctcaaataaaaaaataacaaatatacaataaataaaaagcaagaaatgaaaacataccaccagacaaaatcaccttcattaaaatgaagataggaaggaaggaaagaagaaagagaagattacaaaacaaccagaaaacaaataataaaatggctggagtaagttcttacttatcaataataacattgaatgtaagtggactaaactctccaattaaaagacagactggcaaaatgcataagaaaacaagacctaatgtctcgtttgttgcctgcaagaaacacagtttcacctataacagacacacatagacttgacaagtaacagagacgggcgaaaggattatcccattgcaaatgggaattgacacatcaaaacaggagtagctataatttatcagacaaaattagatttccgggacaaacactatgcaacgacacaatcagggcttaatagtgaatacagggtccatctgcagaggcctacc

SEQ ID NO: 625564 - DNA, 595 bp, Homo sapiens
ataatctgatagttctataaaggagcttcccccttcactcagctctcattcttctccttcctgccactatgtatgaacagatgtgtttgttgcccctctggtcatgatggtaagtatccgtgtagaccttgtcgcctagcacatgcgaaaactgtagatcaagtaaaatccctctttatccttattatatagaggctaacataaaaataagatacaacacataacaaaacacatggaatccagtatggcgggtgcgcggcgcgtccgaatcacatgcttcttgaaaaccaatctatggggtgacctggcactcgctgggttgtgactaggataaagcgggccatggtgtctccttcggcatgtctgcggtggggtctggggtcggctaggcgctccagaattaaaatcggtccgttgtgggccaccccgggtcgttgtttcctgacgttcactcgattgggttgcgggtccctggggctctatctcctgcagttctgcgggtgatcttatgttatattctggcccgctggtggaggttgatgtgtttggtcttgcttctctagttctttaatgtgatgtagggtgtccatcagat

SEQ ID NO: 625565 - DNA, 182 bp, Homo sapiens
  misc_feature (12)..(12): n is a, c, g, or t
  misc_feature (21)..(21): n is a, c, g, or t
  misc_feature (37)..(37): n is a, c, g, or t
  misc_feature (128)..(128): n is a, c, g, or t
gaggcgccgggngttgcctgnaactccttggagtggnagattccacccacccagctctgcccatgcctctccttctgaaccttgggagagggctgaactctacgccgtgtttacagaatgtttgcgcnttccgcttctttgcctctccccgggggaccaaaccgtcccagcgttaatgtcgt

SEQ ID NO: 625566 - DNA, 332 bp, Homo sapiens
  misc_feature (134)..(134): n is a, c, g, or t
ttagcgtggtcgcggccgaagtacggatgctacttgtccaatgattttaaaagggtaggttgcgggtagtcgttcgattgagggtaagatggagaggtgtgcggctaggaatcaatagagtgatggggttattntgcgaaatattatgcgtttttggtggtatagtatggatgatttgtagtagtgctatgatgattatggatagtaatatggcaaggacgcctcctagtttgttagggacggatcggagaattgtgtaggcgaataggaaatatcattcgggcttgatgtggggaggggtgtttaaagggttggctagggtataattgtct

SEQ ID NO: 625567 - DNA, 357 bp, Homo sapiens
tcttgctcccaaagtgctgggattatgggcgtgagcctccgcaccctgcttttcagttcttattaatatcatttacttggaaaaatgatacagatctgtctgtgctgacaattcattcttcctaatgtagcgccggcgatggaaaactttaaaaatcaaagcttaatcacctccctgggaaatacaaagaggaagaaaggagcacagaaattgtgcagagattagggtaccttgtagggttaggatttcaaagaaaaatcgaagcaccatgccagggtatgcctttcacaatggggctgggatgtgtcatctgaagctgcccatggctaaggcactcacaacagggagagggaatct

SEQ ID NO: 625568 - DNA, 138 bp, Homo sapiens
ggcaactctactctcattgtaccattctatcgcatggcattctaatgttaccgaacgaaaattctaggtatatacactacggaaaggcccaaccgtgtaggccctacgggtactacaaccttcggtgacggcataaac

SEQ ID NO: 625569 - DNA, 332 bp, Homo sapiens
ccttcccaccacaactatctgtaagagagcatgctgcatggttgctggtaaaacaggaaatgggaaagcagagtctgtcgctgggaagagatgatatagttcagctgaagcctacaaatggataactcaccccctgttttcagaggaactgggtgttcccattgatggaaagagcttgtttgaagtgagtgtggtctttgctcacccagaaacagttgaggattgccacttcctagctgcgatatgcccagattgttttaagccagccataaaggaagaggatttccttaagcagtttccttgtcctccactcaccggctgttgcgctgttc

SEQ ID NO: 625570 - DNA, 632 bp, Homo sapiens
cgagtggttcccctttgtttacttcttgttcggttgggaaaaagccggccggggtttccctgtgcctgagcggacctttcccgctaggattcactcccccttggacactgggccccagataccctgatgctgagcccgggactccaacatcctgtgggacctgggccctagtccttctgcctggcctggaagtccccgatctagcctgcctccatccgtattcatatttatagcccggtaccttctcgacgccgtgagacccaattgagctatggggggtcacacccgccctcttctgacactaacacctcagctgcctcccccgctctatccccacctctccccactagtggaaactaggtgctgcacgcccctgggacccggcaccccccggatgagcctggccgcccgtgaggcggacttgagaaggagctccccgcgaggggcttttgggccgactctggtccagaagcatcgtgttctggccttttggggatgaactttttgttttgtttcttccctttttagtttttccaagatagggaggtaaggggggacatgagcctttgttgctatccatcccagaacttatttgtaccttttttttttccataaaacctttcccatgacca

SEQ ID NO: 625571 - DNA, 89 bp, Homo sapiens
  misc_feature (60)..(60): n is a, c, g, or t
taagatggagtctcgctcggggggtatagcggggtaccgaggctccgaattcggaaatcnatgggtctataagctggtttcctggggtg

SEQ ID NO: 625572 - DNA, 911 bp, Homo sapiens
ggcatggtgggtgcttgtacccagctgttcaggaggctgaggcaggagaatcaattgaacccaggaggtggaggttgcagtgatctgagatgtgccactatacttcagcctgggcgacagagggagactcccatttcaaaaaaaaaaaagggttaggttgaaaggaggagtggtgattggggttaaaaagaaggctttaaattggttaagccattcagcatgtgtgaaccttcgttaaaattgccctttttgttaaattaaattaggtccaagagcgcgtgaattcttggcagaaagattaggaaaacgtttccccgtgttttggaatacattgcataggtttccccttggtttttatggtaaggggggggtttgtggtcatggtccacccaggtgatagttatattttgtgaccttttaaattggttttaaatggttaaaatttctaatccttaaagtgtgacagaacttgatttattgtcctcctctcccagttctcttcaattcatgagagtgcctccttaaaactgttacttcgggagagcggttgtcgagaagactcttgtactttgtaacaaggcttgttttgtttggctaaactattggtactgtcggcatgggtaattagaattaaatttcccccatagtagttaatttttattagtggtgtgtcaaacctggtgtgttattactttttttaaccatggcttaaagtctatactttctatggagtaggagtgggttcctactccctggttacctggagaacagggccggacggtacccaatgtccagtacaggcaggttttcctaacaatttttttttaccaccgtttataatccaccgaaggtggggactttggtgccatagagaaccggcggggaaacgcgtgtgtaataagtcttctcaa

SEQ ID NO: 625573 - DNA, 1234 bp, Homo sapiens
agcggcgtgtggcgaatgggaccagcgttgcgacacctgatgcctcggcatggagccaagtgtctgacggaggagcatgcccgatatgcagtagcaatgagaggctaccgcacagcagatttggaatgcccaggctcgagaatgtcagtcggggccctcggatccaagacgcataggaatgttgacggagatcgggaggattcgtccactcgaagatgccatgggacctctggtagggatcagctcaggcgacctgctgggagctatgtagtaaggtagcatcgttctgagctatcacagctcaatagaattggagtctcactggtagggcgagcaaacagattcatccagagaggtcgcgtcatcttcgacgagaagcgacacctaatagtactaacctatggaaggctccacctccgtgtgatggtgctggagagccaagtctgctcaccacgcgatctgccaggcacctcaattcgaaatgaggagtaagatgcaacaccctacggaatcctttgagccctggtgcatgctcggtaggggccgttcggactagggagtcaagacttaactgaaggttccggggaccctccttgtcagaggctacttttgaacgcaggatatgaaagacaggcaagtgtagtgtgaccacgggggactggcattcgttccgggcgacacttgccattggactccttctcatgcgtgctttatccaagcggtgtgcgcacgatagtccgggtaattcttgtcctcggtctatttcacctgcaaggccactttgatggcgagccccccttaacctcggcgcattggagcgagtgcttagcatggagccaattctcgccggaggccccgtgtccttgtggacccctttcccttgcttccccccgttagaagggaaccatgcccggttccttccatgtacgtttccagggcgatggaacccaaaagcgttgcggttggcccttttcgcatttcgcgaagggaattcatcttggggcgtgggtcggggaacaatagaaacacctacatgtttatgcccaattgggaaccggaatgcctggacgtccctgcgaagtcgttgtgccaccccggtagccaaggggctttgaggataactgggacattcgacggccggaaatgggtccccccctttacaaaccgggggcacacggaagcttcctctgtgcccagggtgtccttcctgggagctaacattgtcgctcgttcc

SEQ ID NO: 625574 - DNA, 148 bp, Homo sapiens
cggtcagctgtctcctggaccatgggatgatgctgtgtctactgccagggaccatgttcgtgtctgtggggcctgggctgctgtgggaagctgttcgattcctgatctgaggcctggcatgcgtggtactgccagtggaatgctgttg

SEQ ID NO: 625575 - DNA, 121 bp, Homo sapiens
ctggtactgtacgtgcgctatgcctgatcgagtgtcgcactaagttcggcatcaatatggtgacctcccgggaagcagggagaccacaggttgcctaaggaggggtgaaccggcccaggtc

SEQ ID NO: 625576 - DNA, 172 bp, Homo sapiens
  misc_feature (39)..(39): n is a, c, g, or t
gacccgtattcagctcgaccggcggccgatacagcatgnagccgggcgggcaggcgacgtcctcttcgacctgttggcgggggatgcgccagccgggcagcatttcatggctgggggtgatcacgctgttggggatcggcagatggctcagcaggccggactgctggatcag

SEQ ID NO: 625577 - DNA, 738 bp, Homo sapiens
  misc_feature (559)..(559): n is a, c, g, or t
  misc_feature (686)..(686): n is a, c, g, or t
aggaggaagatgaggaagatgaagaggatgaggaggaggaggaagatgaagaagatgaagatgaagaagaagatgatgatgatgaataagttggttctagcagcagcttttttttttcttgtctatcaagaatttaacccccctgtacacaactcactccttttaaagaaaaaattcgcactcgactgctgagtaagcttagcttttaaactgcacagggaatttttttgtatagttaacacactatccgaatgagtctttagatagccctgacctggcagtattacacaatagccactaaccttgcctggtacagtacgccaactgaaaatagagcttctcaatttaaagcagtttcttcttgttgcacagcacaatttacctttacattgggatgctccttttctatcttccgcaacttctagcacgttttacaaataagtgataccccgccactgaacacgcctctgactttccaatgacccttctggcggcaattctttacagggcccagaatgtgattatataggaactccttccttttaattaaattagaagnctttacataggaccaaaatattaatcctttgataatctgccccttttcaaacctcacatcccgaaaaagcccaacaacccctcccctgcaatcccagagcggctaacaatttctgtttttatccaangttaattcttgcagtaagtaagtgtattatgtgggacgcaagatgtggccac

SEQ ID NO: 625578 - DNA, 363 bp, Homo sapiens
taaggataactcatttattaaagggataaaggacggaattaactggacaaggtcacatttaatacaggattctggacacagaataatagttaaacttgggttgggcgtgggggttcaggcctctaatcccaacatttgggagaggccagggcagacagataaccggaggtcgggagtgcaagaccagccggaccaacatagagaaacccggtctctactaaaaatacaaaattagcccggggggagggcacgggcctgtaatcccagctactcaggaggctgaggcaggagaatggctggaaccggggagggggaggtggcagggagccaacatcacaccatggcactccagccaaggcaacg

SEQ ID NO: 625579 - DNA, 436 bp, Homo sapiens
catttttactccagcagccagctctgggcaggtgtagtcttgacaaaaaccttgtcataactacaccatgtatctttcactttatgccccatgacttcactgataccactgcgtgggatgcttgtagaagcctgttctaccattctgatacatgcacaaacctggaagcacaagggataacactacgggatgggaagcattatatacatgctcctttcttctattcttgggttaaaaaatgaggtgtaattgataccttttctcagacaatccctagtggcactgaggtttacttacccacagggtaaccagctcagtaacttggttttgcattgactttccattcttccttggtcactcttctcattcgggtcactcttgagtcctgagatcgctgctccaaacaagcgacctttccttaactcaaggagtctag

SEQ ID NO: 625580 - DNA, 161 bp, Homo sapiens
catcggaaccagctgaggttagcgtgcgtcggacagatccatcaatcaaatgctcacccgcgcatacctggattcctgtcgagactgacgctgaaggtcacattgacgtctacgtctgaggctgctcgaagcccatcttgctagcccagccacccttccaa

SEQ ID NO: 625581 - DNA, 142 bp, Homo sapiens
cctagttctagaagtttaatagccaaacaggatattgacattgatgtagtcaagatatagacaatcctaccactacaaggatccctcctcttgtgcttttataactatacccgcttccctcctgccccacctctgccctcta

SEQ ID NO: 625582 - DNA, 408 bp, Homo sapiens
  misc_feature (120)..(120): n is a, c, g, or t
  misc_feature (175)..(175): n is a, c, g, or t
  misc_feature (225)..(225): n is a, c, g, or t
  misc_feature (234)..(234): n is a, c, g, or t
  misc_feature (247)..(247): n is a, c, g, or t
  misc_feature (252)..(252): n is a, c, g, or t
  misc_feature (254)..(254): n is a, c, g, or t
  misc_feature (258)..(258): n is a, c, g, or t
actgtggtgagatacttgccaaatgagaggtttaaggagtacataagatcaacatgtacacttaatgtgttaccgagatctgcagtgcgagcgcagacagcaatcatcacctaccatganaggaaaaacagaccaagaaatggtggcatctgtgtggacaatcatacctcaccgntcgatgtgatcatcttggccagcgatggctattatgccatggtgggtcangtgcacggnggactcatgggtntgatncngagngccatggtgaaggcctgcccacacgtctggtttgagcgcctcggaagtgacaggatcgacacctggtgaataagagactgactgaacatgtgcaagataaaagcaagctgactatcctcatcttccaagaaggaacctgaatcaataata

SEQ ID NO: 625583 - DNA, 240 bp, Homo sapiens
cgaaaagccacgagtattctgaaagatgtcactctacagagcacagtgtgtaccattccgacgttacactggtgggagtttggcaaggtgttgcgcaggccaaagcaatggggctggacacaaggttcggttggcccacaaagagtgctgaattttcgcttgcacatgcttaaaaaccgcagagagtaattgctgaactcaagggtttagatgtagattctctggtcattgagcatatcc

SEQ ID NO: 625584 - DNA, 469 bp, Homo sapiens
catgagagaagaaataaaaactttcccagcaacagctaatggagttcatcagcagtcggcctgcctattgaaattgctaaatggagttctctaagctgatataaaaggctgctaatttaataaaatatatgaaaacacaaaaatcaatgctataaataatatagagtcatactcagaaaaacctagaagtgtaatagtggtctgtaaaataattttatctctaatacaaggttaaaaactattaaaattagagctcaaggccaggcacagtgactcatgcctataatcccagtactttcaaaggctgaggtgggcggatcactttgggccagaagtcccagaccagcctggtcaacatggcaaaaccctgtctttaccaaaagtacaaaaattagccaggcatggtggtgtacacctgtggtcccagctacttaggaggctgaatcatgagggataacacgttcgcgag

SEQ ID NO: 625585 - DNA, 477 bp, Homo sapiens
ggcgtcatgagccttctctgtgactagaggataacgctccatccaatccaagatagaaactcagctcgtggtgggggcttgctggcaatgtacctgtcattaccccccgcctcgactcgagaattaagttgtacctcgtttactaggttggtggcagcaggctgtgatcggtatcctacagccttaccctcgtgtcctggatcttttccttccatttcctgtgtacagccttttgggggacactgccgttaccccactctagctagcatagctctgtctgtaggtgctccataaaggtgataggactgaccacaccgtcacctttcccggaaacccaagagggagcgttccacagagggagcgtgtagtggggggaactgttttataaattaatccgtttattgaaaggttcacaaggacaaagaggccacagcaagagtcaggcacagaaattaaggacgcccatcgtgccgcttc

SEQ ID NO: 625586 - DNA, 103 bp, Homo sapiens
cgtctgcatattagatggtgttgggttaggttacatctggttactgtcctgggaaaatcatttttatagagatggccttccaagtgcgtgccacgttgcgtgt

SEQ ID NO: 625587 - DNA, 490 bp, Homo sapiens
tatatcagctcggtaccggggtccagagtactggacacgccagcatggagtattgacatgctgtggatcagaatatgagcgcgtccaagcagcgtggcaacattctctttggtgtggtggctgctgtggttggccgtgggcttgttacatctggccctggcgggttcttgcttgctgctagctgcagcacgagcgggatggccaaaatgtggttaccacgctggtaagaaggagaccaaggacctgtatgcccccgagcccagtggcaaggcctccaagggaaacaaaagcaaaggcaagaagagcaagtccccaaagcccgtgaagccagtggaggacgaggatgaggccgggctgcagaagttcctcaagttcaacctgatgagcgatgcccctggggacagtccccgcatccacctgcccctcaactacccaccaggcagccctgacctgggccgccactatcgctctaactccccactgccttcca

SEQ ID NO: 625588 - DNA, 613 bp, Homo sapiens
  misc_feature (125)..(125): n is a, c, g, or t
ttccgagttaatcagaacaaagagagaggggtgttgggtgtatatgtatatgcccttgatgtatacacttatcaaagcgtatcaacattcagtgaaagacgtcgcactctccataccatcagtanactcagtcccagaagtggtatcatcttattgggagcggtgtataggtggaataaaaagtgccttgcatatcgttattgtacacaaaggtaaagagtatcctcaaagatcgtatatatatgtaaacaagtaatgcaaccatcttgtgcctctcttgaacagtccgttgctggaccacagaggctacgatagactgtaccaaagtaaacgggcggtcgtttaaaaatatggaacattaatttacaaggacccgttaggggcttcaatgatgctgagtctggaaaaggggaggagaccctagggaggactccaggcagctgtgctccagggctccatgtcctctactggattagggataggcacctctgaaatctccaccctgatgataggaatgaaacggagtgaacatgagcccagctgagagaggagcaggaatgtgtgacacacagctgctctccttgtaccagctttgtgattgagccctctgtct

SEQ ID NO: 625589 - DNA, 375 bp, Homo sapiens
aaagggggttttatttgtttccccagcccccccccggggtttcttttttttgaaaaaaacttttttggccccgggcccccttttttattttttaggcccccccccacctggggggcagggggggggaaaaaccccaggccttaaattttattttctttcctttctggagccccaaggagggcaacaaaaagggggggggtttcccccccccccccccttaggaaaaaagggggtttttttattttccccccccctttttcccccgccccccggggtgggccccttttggggggggcaggggggccccaattggcccccccttaaaaagtaaaaacccccaaccaaatttttttttaatttaattttgggttccca

SEQ ID NO: 625590 - DNA, 565 bp, Homo sapiens
tcacatatgtcagctagctaaaaaactaatcgcaagcattattggctctgaatgctaaatgtgcctatattataatttggatgccgaaggaaatatccaaaataactgcaaaggatggttagtgaatctttaagatttgtaacttgaaatatctgtttattacaggggaaacactagaaattcccgatacagcaatgggcctgactttattagcagcaggaacaagcataccagacacaattgcaagtgtgttggttgcaagaaaaggtaagaactaggtccctcaagctgcaatggtcattctacaaggctagaatgagtaaaagtagctttaaaaatgtttacttccagccgggtgtggtggctcgcgccatgtaatcccaggattttgggaggccgaggcgggtggatcacgaggtcaggagtttgagaccagactgaccaacatggtgaaacccagtctctactaaaaatacaaaaattagccgggcgtggtggcatgtgcctgtaatcccagctcatcaggaggctgaggcaggagaattgtatgaatccaggaggcgga

SEQ ID NO: 625591 - DNA, 139 bp, Homo sapiens
cgtcccgtcttgtgagagggtcttggtgacgggcagaagcaggagcaggctcttggtgaggggcagaagcaggaagcaggctcttggtgaggggcagaagcaggaagcagggccttgtgtgaggggcagaagcaggaag

SEQ ID NO: 625592 - DNA, 281 bp, Homo sapiens
ctgagtatgacggagatcagcacattttctggggaaagatctgtgaagggcgaatccaaccgattttctgaattgcccttcagtgcacttggagactgtgtgtggtgctatgatattcaagcagcggcagccggaacgcagtgtggcctagttaaggcagatgattgttagagcagctcaggaccttgagtcctgagctgttagacccaaagtggcaggaaatcatggaagagggtacggctcgatcgtatcaggtcatgtgttctgtatttccccaaaaa

SEQ ID NO: 625593 - DNA, 100 bp, Homo sapiens
caaggatgaggaattgagaacgaaggaaataagggaaatggggtgaatagcaggtggatcagagagatacagtaatgggggtcaggtgtggtatcagttt

SEQ ID NO: 625594 - DNA, 964 bp, Homo sapiens
cgtggtggctcatgcccgtaatcccagcacttgggaggccgaggcaggtggatcacaaggtcaggagatcaagaccatcctggctaacacggtgaaacacccccctctactaaaaaatacaaaaaaattagctgggcatggtggcgtgcacctgtagtcccagctgctggggaggctaaggcaggagaatggcgtgaacctgggaggcggagcttgcagtgagccaagatcgtgccactgcactccagcctggaagacagagcaagactccatctcaaaaaaaaaataaataaagaaattccttttggaattgcaaggggttacaaaagaaacccatagaaaaggttttggcaaacaggttttgtaaaaggttgggaaagacacctgagctttatagagaagtatgagagggtgctaaagtgggcaacatcttatgagttcgagaaaacgggtgttggccatgggtaacaaccgagatttttggcagaataggatcaccatgtgcacatgttagaatatataaagagtggtggcaaaaaaagtggatagttcccgagttaaattagatacatgtgagtctgtccagacatgtgtgttgagaacaaaaggtgtgtggacgtttgggggtatataacgcaggaggaagataaaagggggcatgagaagtcgttttagacaatgaataattagggggttgttgaggggccaaaacgggtagagattgtgttccccaatgagaggggggacatagggggatgaatgttgtgtaaacagttgccacagtagttggttggagaggtgttaaataagttagaaggagtattctccgcgagggtgggtctgtacaaaaggatatttataaacatgtaggggggtgctcagacaagagtatgaactgtttgtttcgagagatggtacgtgatggaatattttgtgtgaagaagtggtgggggtttgaatataa

SEQ ID NO: 625595 - DNA, 448 bp, Homo sapiens
agggggaaacagtgagattcagaatatgagcgcaagacgcctgtttaaaaggtcgtaaactgactagcatgctggcgaataccattgtgtacggtagagcggacatcatgtcggaagatcaggtaaaaggccatcatagacaatcaggacatacatagtggggcacagatcagatttacggagacggaagatgaaaaatgtggtcaggttgggaaacaagtaataactagtattacatactagatgagaatgatcccagtaggaaaaggggagaaaataggtagttcaggagagataaggaaatagctggaaaatgtacttgctaaataaaagctgctggaatgtagtgcacgtgggaagaaactgactttagattagtagttcagatagttcacccggggtcaacaagatgggcagcaggcagtgtgggtttgtaaacggtgttgcg

SEQ ID NO: 625596 - DNA, 314 bp, Homo sapiens
cgggcagtacggacgtgggagggagtggcagagaatgtgtgcacagcacagagcggcgcatatcctggaactaaagcccattcactctgagtgtgtgtggctctgacccacgtgaggcggggagtactatatagacgatgagtacggagacctgatgactgccatacttgttaaacgatgacattatcgtgattcctagacaatggccttaggacgggggcctgcaaagagaattttgggggtccctccatctctagattctctataaaggcctgatcttcctgatgaggaaaaagttcacattctttattttt

SEQ ID NO: 625597 - DNA, 405 bp, Homo sapiens
gaccacacccatccgaaaatatttattatcgatagtttacagttcaagcgaagcttttctttatatttaactaccaggatggttggccttgtgttttatgttaaactagccaaagtatgagagaatttacaagctcacgcctgtaatcccagcgttttgagaccaagctggtctcgaactcctgacctcagctcctgaactcagcctcccaaggtgctggggttacaggcctgagccaccacacccatccgaaaatcagccgggcgtggtggcgggcgcctgtggtcccagactgctggggaggctgaggcaggagaatggcgtgaacccgggaggcggagcttgcagtgagccgagatcgtaccactgcactctagcctgggcgacagagtgagaatccctctc

SEQ ID NO: 625598 - DNA, 106 bp, Homo sapiens
agcgcggcctcaatggcctggacgcgaatggcaggtacacggccgacggccaagaggagcaggagtatctagggtaaccctactaataacccggtgtccattcgat

SEQ ID NO: 625599 - DNA, 388 bp, Homo sapiens
taaaatgtaactatgtaagtatcagcatgtgtatatcccagctgatacctcacacagtgtggcttccaaagtagcgcatagacgaactataggaccttggggctaagctcaaaccttccattaagggtgtacgtgtggaactcacagcgtatagattctaaagctacgaaggtagcacatctcatagtacaggccttactccaactttaaatatagagcacattcacaatataagacaggctatcatctggccttacatacagaccagagaatgcaattaaaacctcttcccgctctcaaggcaccacatttggtgtggacagtgacgctgtgagtatgtatgaaaaacatagcacatgcgcgatatatatgataggcaaaatcacac

SEQ ID NO: 625600 - DNA, 144 bp, Homo sapiens
tttctatacatgggcaagatcgggttgtaagagctcgtgagatttaaggccatgccctgtatcatggtgaacttaccaaagcaaacaactcctgtgagatggtcctgcaccagccaaccagagaactcttttggtgacactcct

SEQ ID NO: 625601 - DNA, 818 bp, Homo sapiens
gaggatcacgaggtcaagagattgagaccatcctggccaacatggtgaaaccccatctctactaaaattacaaaaattagctgggcgtgatggcacacgcctgttgtcccagctactcgggagactgaggcaggagcattgcctgaacccaggaggcagaggttgcagtgagatcgcgccactgtactccagccaggcaagagcgagactccgtcacaaaaaaaaaaaaaaaaaaaaaaaaaaaaaacattgggggggggcccggaccccggagaaaaagttttaggaaaacattggggggggggggggggcccagtgggaggggaacagggggcacaaaggtggttacccacaggaaaaaaccggggccaggcacaaaggggcgggaggatcttccacccaagtaaaaacaggcgcccggggggacaacgcgagtgcgtgtctggaaacaactccaagaaggggagttcgggcaggacatacggggattattataaaagcggggcgtccaaagcgacagctgcagaatttcaaattaacgccccgggcaggggggggaaaagacacaggcagaagggacaaacggaaaagggaatagaacatacagaaccaaaagaaacacagagagacgaaaccaacaaaaaagagtacgaaaaacacgagagaaggcaaaaccaaagacagcgaaccgagaagcacaccagtaaaacaacaaagaaggagaaaaggaagacaaacggacgaaagacaaaacaacgaacaggaaagaaggagacagaacgaacaagactagaaggacacaacgacaacaacgacac

SEQ ID NO: 625602 - DNA, 510 bp, Homo sapiens
  misc_feature (24)..(24): n is a, c, g, or t
  misc_feature (55)..(55): n is a, c, g, or t
  misc_feature (62)..(62): n is a, c, g, or t
  misc_feature (115)..(115): n is a, c, g, or t
  misc_feature (156)..(156): n is a, c, g, or t
  misc_feature (489)..(489): n is a, c, g, or t
ttcattcccaacccctcatgatgnccttgagggattccgaacctccagtggaggnaagtccnctgtagatgtgggtggaaaccagccaagagaaccaagaattaagaagaggganccctgacgatcctgacctgaattgcctgccaatcctcatgntccaaaccttgaatgaatgagaagttgccttccttatggaagatccaaagaatgtggtttgttgagatggaatcctactccctggttaacatgctgtgaacattgttgaaatggcaacaaaggatttagaatattacataaccttagttgatagcagcgtcagggtttgagaggattgactcaattttgaaagaagttctgtggataaaatctgtcaaacagcatcacatgctacagagaaatctgtgaaaggaaaagccagttgatgtggcagacattcttgtcttattttgagaaattcctcagcctggatcttgcagtgagccaaagaantccactgcactccaacctggg

SEQ ID NO: 625603 - DNA, 812 bp, Homo sapiens
  misc_feature (1)..(1): n is a, c, g, or t
  misc_feature (194)..(194): n is a, c, g, or t
  misc_feature (497)..(497): n is a, c, g, or t
nacggaagtattcctcttcctgctcttctgagaatcagggggcgccctcttctctacgacgcacactacttctgttggcctcccggcacaacacacacgaggagacctctggtcgacacccccctctgtggggccaacacaggtggggccactagtggagtttctcgaacctcacagcggcacacactctcacnacagagagagatactcggcggcgccccacacttttcgcgcacacacgcagctttgtttttgtgtatcaaccctctcgcggggagaacctcgcgcttgggagagagcacctcgcccaacatctgtttccacgggcccctctttcttgggggacaaagcccccgtcgggagatgaagaacacaccactcggagactctctctctgtgagaaagggatatatataatctcgggtctctcttgtagaagagactctctcgttcccgcagagaaatttttatatctcgtcacacatgttttgttgtgngtatatcacaccttataccacgccaccacatttgagaccgcgctgtgctggtctgtgcccgcaagaatgtctccgcgggagattctgttcgcgaccacagcccacgcttacaaagggtgttggagatgagcacacaatatcgcggctggagagtgcccgaacgaaggtcggggcagattttcatctgtagacccagaagagagccattataaccccagaaccttgtggagaagattgactttgaccgtgtgtcccagcatcatggcctcctccccagtaacttccggtgtttaataaagaagtgttgactccaga

SEQ ID NO: 625604 - DNA, 768 bp, Homo sapiens
gatttgttatagagatgaggtcttgctgtgtttcccaggctggtctcaaattattagcttcaagtgatcctcctgcttgggcctcccaaagtgctggtgattataggcatgagccacgtgcactccagccctcatatttatgcttgtgttgtagaagcttaggtaaacgagctaattgtggagaaaaatccacaaggaatctacagtatgtaatagaaatacatgtttttctctgctctctttcccattcctcaggggtaatcatccttccaaattttttctcttcatatacaagctgtaagttgtgtgcaagtacaggtatacgtcttatgcctacacatatatatgtttagtatattgttgaacaaaagcacgaatcttaactatgattatgggatggtggtggtggtgattgcacaagagacagggatctcaactccagacgcgtgggcgacaagagcgaagaactccgtgctcaagagaacaataaacagagcagagaaaaacacgctgccgagaggtacaatcctaactctcccggggaggacagggaaaaaaacagaaacagagataaaccaagcaacaacggggacccacatgtgagcacacatgaaaccagcgcgacacccaaggacacccaaagcacgacagactacagatgcacaaacaggggggcaaagcagcacaacggggcgagaattgccacgaagtaagaggaaaagctccgaaattaaacaacactaagtcaacgaacacgccacaggacac

SEQ ID NO: 625605 - DNA, 126 bp, Homo sapiens
gtaaatatttctggctcatttcatcttgcatgtacttgtgtaaaaagagcagctgtgaatttgtctttagctgcatgggccatactagtcttacgaaatcttttcctactgggcccacagtcttcg

SEQ ID NO: 625606 - DNA, 291 bp, Homo sapiens
ctgagaattgctactccacaaacagagtgctactccacaaacagagtgtactccacaaacagagtgctacctccacaaacagagtgctactccacaaacagagtgctacctccacaaacatagtgctacctccacaaacagagtgctacctccacattccactggctatacactgtttgtggaggtagcactttgtttgtggaggtagcactctgtttgtggaggtagcactctgtttgtggaggtagcactctgtttgtggaggtagcacactgtttgtgaggtagcact

SEQ ID NO: 625607 - DNA, 958 bp, Homo sapiens
ctcctcacacccaatggaccaatctatcaccctaaaaaaaaaaaaagaaaaaaaaaaaaaaaaaaaaaaaaaaaaaatttgggggggccggggccccacggaaaaaccttttcagaaacactatcggttgggggggccgggggccccaagtgggtgtatagggcacacagtcggtcctacgcgggttccctagaggagaaccggggcacgacacacaggcgcgtgggatctctctacaccaagataaaaacacgccgcggggggacacacgagagcgtttgagcaacaactccagagagcggagctcagggagagacaacacaggggctctttcacaccaaggggtcttccaacggagacgctcggaaataatccaataatatagcgcgccccggcgcgaggggcataaacaaaacagagcagcaccaaaaagacagacagaagacaagcacaacacgaagaagaagcagaaggaacagaagaacagaacgacggagcagacaagcaacgaagacgacgaacgagcgaagtcgacacgcagacgaccagagacagagcgcaagcgaaccaacgcagcacgaaagaacagacgagaagccgaagaagcggagaaaagcagaagaacagaagcaaggaggaacagaagaactaactaggacaagagaggagagaagaagaggaagagagagcggaggggagggggaggcaggagaggggagagagaaactgagaggagacggagagagagcatgaactaagaaggagacagagatgagaaagaggagtaagaaacaagaacggagagaaaagatgagacgcaggaaaaggcaccaaagcaggaaggagagcagcgagagagagaagaggaggagagagagacgagggacacgaggagaggagcgagaggagtggggaggaagcgctacggagacgaagacggacgacgcgcagacgaccg

SEQ ID NO: 625608 - DNA, 796 bp, Homo sapiens
actcgtggagaccagttttctgggctgttgagtgatgctgactcccaaagggtccattgttgttgtgagggttgccgtcattgttaatgaatgcttattgaacacatgctgcgtgtgcaatatctgattggcactggaaacatagagatgagtcaaatatcacatctgcctcagggattacagccttgtggtccttaacagcgacttggcgatgtaaaggaggcgtgttgagatggaaacgaggtcataacaagaccttcgtgatgaacttggtgaattccagactgatagaaaatcatgtagataaataaatgaggaatgaacattcaaatgcattttgtacatgtttaatattaaaatagtatccatagttgatataattgttagtatatggttaataataaataataaatacagttcttctcacttgtgaaaaccctgtagcacctccacagagccctagagtttctcaagacagagcgagaaacctctggcttagatgcttttgaggactggaccatctctgatactctgtacaactgatgggttattctgtgaaaagtgtcgtttggaatattgcatcttattacagaagccatgatctttaggatctctagggatcctggaagggagtgataaagttacagaatgtaaatataggggaaagttcctttcagctatagtcaagatagcagttgtgtcaccactggagactgagccagggttctgcagtcaggtaaaccttaggcaagtcacttgcttggcatccccatgtggatactggagctaatacccc

SEQ ID NO: 625609 - DNA, 400 bp, Homo sapiens
ggattacaggcatgagccatcgagcctggcccaaagattgttttttgttttgttttgttttttgagatggagtctcgctgtgtcacccaggctggagtggcacgatcttggctcactgcagcctccgcctcccaggttcaagtgattctcttgcctcagcctcccgggtagctggcattacaggcaggccctactgcgcctggctagtttttgtattagagacgaagtttcaccgtgtttgtcaggctggactcaaactcctgacctcaagtgatcctgagcctcagcctcctaaagtccttcgattacaggcatgagccaccacgcccggcccagattggttttattgcatttgttctgtgggataggtacttgggtatttcattttgttctttttttt

SEQ ID NO: 625610 - DNA, 228 bp, Homo sapiens
cggtccgccttgcttcacatcgatctctactataacccctcccatagccaccaatggcacctaaacatggcctctattatcttgcaccctagcctagccgattactaatccctatagggaagcataaactaaactcccctatcggaactggggcgggtgccaaacattttattttgggcccctgccctattttctttaacatactataggggctcttaccttcccctt

SEQ ID NO: 625611 - DNA, 1086 bp, Homo sapiens
ttacgcttccagatggttcactactatttttctgcttattgtggttccattccaccagaggggtctcccaaaaccaggactttcccagcgcgttaccggcctccttttattatcgccccttggccctttacaaaagacgggaacctaactggcccctgaggtatttttagcgccccccttttttttttttaatttaaatgtttattattaagaggtgtttacacaaatatgagacatttcaacataaaatataatcattaattctccatccatataaccatgatgaaactcaagtccattaatgttaagattcattttcacggtaacaatatggaacatgtcatcatcatataaaacatcctagagacctgcccaaagtgaaatttacaaagtagttattactgttactgtaaagatgaggtatagcatttgcctgttacatttattctaaactaaaaatatatacaacctcaagactttcactagcataatttcttttatgagtgagaaagtaggagtgcagaccagatttaaaagtttgaccagaaagaaatcacgaggtttttggttcttctgtcttttctttcattgccaagtccccgtatttgtccatcaacatatagcagaagagtcactagttattaaccattgtcaaaccaatgaaacaagttctttaagaaaaaaaatgggttttatactttcaacgggtgtaataatttacaaataatcatccaccaacaccacttataaataaactgaattgtttcatgtttgatatgcatgcatttgaccctagatatttattaggagttttctgtctttaagataataataaatgtataagaagagcatattttagctggtaagttcaggaatcatcaggtcttttatttctcagatttttataagcaaatacatttttaaagtgtaattttagaaagaaatgagacatacataaaattaatgtattaaaatagatttctgcactggaagctccctctgtttgctgtactgtttcccatacttttcacagttttttttcccctaacttctatgttaaatgccaccatttcagaaaaaaagaaa

SEQ ID NO: 625612 - DNA, 362 bp, Homo sapiens
ataataagtaagctctttttatgaaatggtcttctcacacagtttaccgacatgacagatttcctactggtctggcactgatacatctgattcaaatcggtcctgataccttcaccatcctatgattttcaacaagctactatatttcattaattcatattcagttctattttaacatcaaaatcataatgtttcctactgttgagagtgtcttacagttcagctgcagtctggacacagctgttattgcctgttcccgagtttacatggttgtcatgtctgtcatcgtgactgaacaaatacaaccctgaacaaataaatcaagggccattttaaggagaaacatgaatttcagtagttgt

SEQ ID NO: 625613 - DNA, 783 bp, Homo sapiens
gaggatcatatattttctagctatcaagtcacctgtatgccctactcgtcttcaagcagaagaagagcaaaaacagtagcctcagctctctgaagtgacatgaaaagagcctctggatgcatttccatttctcttttattctccagcagacggggccaactatatccaaaataaagatcacagagcagcaagttcatacaacatgcatgttctcctctatcttagaggggtattcttcttgaaaataaaaaatattgaaatgctgtatttttttttctactctaacctatgataattatttacaaaattttaacacgtgaccaaacaatgcagatcttagggatgattaaaaacaacatttgatgatagcagacattgttacaaggacatggtgagtctatttttaatgcaccaatcttgtttatagcaaaaatgttttccaatatttcaataaagtagttatcttataggggatacttgaaaccagtatttaagctttaaatgacaggaatattggcatagaaaaaagtagcacagcgctactggatcaatccctaatgttcactatatcaaatgtcctggcagcgcagcacatactttttcatgaagacggagttatgcagtatcgggttggtactgccccctctgcgtgtagtccacccctcccttggcgatacagcgcccctttaacctgaacataaaaattcgcactaattgcgctatccgcggaactctgcccgcggcctctatatcgagggatatccgtcacccccacgtactcgg

SEQ ID NO: 625614 - DNA, 717 bp, Homo sapiens
  misc_feature (216)..(216): n is a, c, g, or t
aaaacatggttacagtcaagcttcacaaacattacagactcacttggagttatggaacaagtaagccatgaagtcttctaccttttagtaaaaggtcctccggagaaggaagtttccaggcctgcggaagtggtggagccaccgtccggctccagagcgctaagtgtgtgcgttatgatacagcagggcacaaaacttctgtctcccacgaagacnacggcgggggggacctttttcgcggaaccggggggtgagacttttaaagaagaaaggcattggttgggtttgtgtgttgtgtccttttaaaaaaccgggttttccccaaccaagaagtcggggttatattaccccaatttcataagttccaagcaggttctggacatcttgtggagatctcaccggtccagaagattcataacggcgtggatacgaaataacgtgtggacttcgcgtgtgagcaagtgttcggcatgtttacacgtaaatacttccctgtccttgttttactgtttctggtggccgctcttcgagctctgctgcttctccttcatgagcgtggcgttgctcagggcggagttgctgatgtagttccgcgtctcgtccacttgatagggaccctaggtccggtcccggacttggacctggggaccgaggaccaaatcgaagggggaggaccaatggggaacacccggttggtcaacccagacactgcgggac

SEQ ID NO: 625615 - DNA, 105 bp, Homo sapiens
cacagttcgtttgatctccagcttggtcccctggccaaaagttccaggccacttattatactgctgacaggaataaactgcaaaatctgtcgacgcggccgcgaa

SEQ ID NO: 625616 - DNA, 149 bp, Homo sapiens
  misc_feature (29)..(29): n is a, c, g, or t
ggcacgaggtggaacccatctctactaanatacctccaaatattttgccgggcatggtcgcaggtgctgttagtcccagcttttcaaggaggcttgaggcaaggagattttcatgaatccaggaggccggaggttgcagaagggttaga

SEQ ID NO: 625617 - DNA, 1373 bp, Homo sapiens
  misc_feature (32)..(32): n is a, c, g, or t
  misc_feature (105)..(105): n is a, c, g, or t
  misc_feature (148)..(148): n is a, c, g, or t
  misc_feature (200)..(200): n is a, c, g, or t
  misc_feature (264)..(264): n is a, c, g, or t
  misc_feature (331)..(331): n is a, c, g, or t
  misc_feature (380)..(380): n is a, c, g, or t
  misc_feature (626)..(626): n is a, c, g, or t
  misc_feature (628)..(628): n is a, c, g, or t
  misc_feature (638)..(638): n is a, c, g, or t
ttttttttttaaaaaaaatttttttgagatanagtctgactctgttgcccaggctaaagtgcagtgggcaacagagcaagaccctgtcaaaaaaaaaaaaaaggntatgtaacatgcccaaagtcacataattggcaaggagcagcanatctgggacttgaacataggcagattagctccaagcctatttgcttaacctntataccacaatgccttcttgctatggtaaaacatctgaaaagacctattaccctataggtcctntaaggaggcatgtcgccttcctcttagcaatactagattggctccaacagaaggctgtgggcttctntggcacatgcacctgggtaggacccgagaatatctgtggagtctgaatnaacccaaaagccaatatccatccgttcataaggaaccccagcctacaacgcaaaagaggaaattttcctaagttgaaataaactgtaataaattgcagaggttccctcgtcctggttttcacttcatgttttggatgctgcatgctgggtgagcggagattccaggcactggccaggcagctgccctgactccaagggctgccatgaacaacttccaggccatcctgactcaggtgagaatgctgntntccagccatnagcccagcctggtgcaggccctcttggacaacctgctgaaggaggacctcctctccagggaataccactgcactctgctccatgagcctgatagtgaggctctggccaggaagatctctttgaccctactagagaaaggagacctggatttggccctcctggggtgggcccggagtaggctgcagcccccagcagccgagaggggccccggccacagtgaccatggtggcagctcacagtgtgccaccatggagttggggcccctagaaggtggctacctggagcttcttaacagcgatgctgaccccctgtgcctctaccacttctatgaccagatggacctggctggagaagaagagcattgagctctactcagaacccgacacagacaccatcaactgcgaccagttcagcaggctgttgtgtgacatggaaggtgatgaagagaccaggcaggcttatgccaatatcgcggaactggaccagtatgtcttccaggactcccagcctggagggcctgagcaaggacatttttcatagagcacataggaccagatgaagtgatcggtgagagtaatggagatgccagcagaagtggggcagaaaagtcagaaaagacccttcccagaggagcttccggcagaacctgaagcactggaagccagctgagcccccactgtgggtgactggcagtctcctagtgggaccagtgagcgactggtccaacctgcctga

SEQ ID NO: 625618 - DNA, 511 bp, Homo sapiens
ggagagggggtctcacaggtgggctaggctgtctggaatggctggactcaggtgatctggccggcctttacctcccaaagggctggggattacagggggccaccactcccggccccacagtagtaagtacatctttaaatgggagtccatctcctcaaacccggcggcggcttaattcactaagtttatgtaatattctgaatctctggtggtcatttaaacaaggtccagagcatctgggtgggggggattggtctcaaaaaaccattttctttcctcatccataagaagcaactcctcgtcggttaaagttttatcatgagatggcagcaattcagtcacatctttaggttccacttctattgctaggtctctttctatttccaccacatcggcagggacttcttccacggaaggttggaacccctcgggcatctatgaggatggatatcagattcttccaaatggctgttaaggttgatattttgatcttgtcccaggaatcagaaat

SEQ ID NO: 625619 - DNA, 109 bp, Homo sapiens
tcatctgcgtccatctgaacagcgtcattgtttacacgtcgttgactgctgttttgataaccaacaagaggtcaatgtatagaaatcccgctgattggacgaagactgg

SEQ ID NO: 625620 - DNA, 500 bp, Homo sapiens
  misc_feature (426)..(426): n is a, c, g, or t
  misc_feature (438)..(438): n is a, c, g, or t
  misc_feature (470)..(470): n is a, c, g, or t
tctcagccaggaacagggaagataatctcagtttgccttgtcttattcatcttttctggtgggtctagccctctctctcctcgccagtcccagatcattctttgtctttgtggtagctggaaatacagctcagatcccacattaaaaaaatatatatattatactttgagttctgggatacatgtgcatgagttctgggatacatgtgcagaatgtgcaggtttgttacacaggtacatacatgccatagtggtttgctgcacccatcaacccgtcatctacattaggtatttctcctaatgctatcccgcccctagccccccacccctcaacaggccccggtgtgtgatgttcccctccctgtgttcatgcgttctcattgttcatctcccacttatggagtgaggaacatgcgggtgttttggntttctctttccngtgttaggtttgctgaggaatggatgggtttncagctttcatccctgtttctggtttccaat

SEQ ID NO: 625621 - DNA, 737 bp, Homo sapiens
  misc_feature (97)..(97): n is a, c, g, or t
ccgggaatcggtcttatggccgggggaggtggtgtggggacccctggccaagagggctgaggtctgaccctgctttaaagggttgtttgactaggtntcgctaccccacttccccttattttgacccatcacaggttcttgaccctggatgtcagagttgatctaagacgttttctacaataggttgggagatgctgatcccttgcaagtggggacagcaaaaagacaagcaaaactgaagtgcactttatggcttgggactgatttggcggacattgtacagcgagtgaagtatagcctttatgccacactctgtggccctaaaatggggaatccagagcatatctaggtgcctcaccccttggagtcaaatgttttataaactcatagatcagaagtgcattgggatgtgacgaacgtagcacaatcgccccttttcgagcttcttgagaaatggacgctattttatcagattatagcccatcaatatttgcgactcttggatggaccttgtcttctaaaaatttgatccttcgggaattcttttctgcgaactgtggtccatgtcatatgcgtgatgaagggtctttggagcccttgtgtgaagtagacatgttttcaaggttctcttccgacagtgcggtatctaatttggcgacaacccgtcttctgtggttttatagaggggatatgagtcgcgccgcgccccacaactcttccacatgatctttttccct

SEQ ID NO: 625622 - DNA, 121 bp, Homo sapiens
  misc_feature (46)..(46): n is a, c, g, or t
taaaggacgagtccgaggtagtgaaaggggatcaggccttgtgagnggatgcccctacaactccagcagcgtcgagtatagacagatgagcagagtcaggtatgggagaggtaggggctcc

SEQ ID NO: 625623 - DNA, 444 bp, Homo sapiens
cggttttccccccggggttttcccatttcccccccccttcccgcccaggggggttttttttggcccccaaaaccccgggtctttcccaaatttttttacaccccccccccctttccccaaatggggggggggggtttccgggggggggtttttttaacccaaccttttttttttacccccccatttccctggggccccccccccccttttttttcccccctttaaaaaccccggggccgttcccccccccgggttttttttttggcccggggggggttttcttttttcccccggaacaccttttttcccttttgcccttttttggggccccttttaacccgttttttcccaaaaacccgggtgggcccggcccggatttccccggttttttttccccccccgccccccgggggggtgggggggcgggtgggggggggggtggga

SEQ ID NO: 625624 - DNA, 135 bp, Homo sapiens
atcctattgctcacagggaaacaccgttgcttcccatcctcggcatctgactttagcctggattgaaagtgttagacctgaagaattcgcagcttaccgcttttatgctgaggaaggcagagaacaggattgatc

SEQ ID NO: 625625 - DNA, 622 bp, Homo sapiens
  misc_feature (184)..(184): n is a, c, g, or t
  misc_feature (362)..(362): n is a, c, g, or t
ggtcttgaacttctggcttcaagcccttcctcctcagcctccaaaaacgctgggattacaggcatgtaatctgcgtgtgcctgggcctcagcacatttttgaaaacgaagctttccaagataattcagatcgttgctaccagtcactttaatgctggagcataattagcactattcctttacanatgtgtgcctctttgaaggataaacgcaaacttttaagctaatatttgctttaaagtcactatactgaagcatatcagaaaactcgtagtgtacaagacctcattcatggtgtaccttaagtattagctagcacgcaatacgagatactagattatggacccaggaaactagaaaccnttagtcccgctacttataaataatgactaattcaactctcttcctgagatagaatgctttcgatatcacgcttgatcttacgcttgaacaataattatcaattaccattttgcacgaccaacgttgtgataccctttgaaggatgttaaggtttcttattacgtgttttacttcgtcctatgttaacactaagggaaccgagaatagttgacatcacatacgctgaaggatgtggtatcccagacgaaactggcgagatc

SEQ ID NO: 625626 - DNA, 402 bp, Homo sapiens
tctagagcaggatctagctgactctaagattgcagatttggtagcccagcacaatgagagctcagaggggactcatcttactcctgctgcttctggctgtgttctgttccacagctgttagcctcacatgctaccactgtttccaaccggtggtttcttcatgcaatatgaacagcacttgctctcctgaccaggattcctgtctctatgctgtagccggaatgcaagtgtatcaaaggtgttggaaacaatcagattgtcatggtgagatcattatggaccaattagaagagacaaaattaaaattcagatgctgccagtttaacttgtgtaacaaaagtgacggatccttggggaagacaccattgctggggacctcggttctggtggccattttgaatc

SEQ ID NO: 625627 - DNA, 369 bp, Homo sapiens
  misc_feature (60)..(60): n is a, c, g, or t
ccccccggtttcccttaagggacaaacatcccttaagttcaaaaagagagaaagaggccncccacctaaaagatcgcagttttcccctggtgcagtggcctcacaccctgtaatccccaacattttgggaaaccccaaggtgggtagatcacgagatcaagagatcaagacccatagtgacccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttc

SEQ ID NO: 625628 - DNA, 417 bp, Homo sapiens
taacaatgccatctcttcatattgttccatttaacaaaactgcagcccttcatctatccttaagtcccttggccaatggtacagagccagagtatgctactccctagcaggaaatcaacaggatgacctattaaacaccattcagaagatgctaagacccatgaattgcaacaggaaagaaaagacagagaattagtcagacaggaatcaaggttcctagagaaatggctgactccatgcatggtgcagtatattgatcctggaacatctgttttgccagaaagcaaggaagccatcaaagtccaacaggatcacgtcaaaaagacatgaaagtcaacttgaagagataattattaacctagatgagacaatgtaagcatccaaaccaataaagactgcaatggcctgaaatacaaa

SEQ ID NO: 625629 - DNA, 748 bp, Homo sapiens
  misc_feature (44)..(44): n is a, c, g, or t
  misc_feature (70)..(70): n is a, c, g, or t
  misc_feature (105)..(105): n is a, c, g, or t
  misc_feature (107)..(107): n is a, c, g, or t
  misc_feature (111)..(111): n is a, c, g, or t
  misc_feature (120)..(120): n is a, c, g, or t
  misc_feature (129)..(129): n is a, c, g, or t
  misc_feature (198)..(198): n is a, c, g, or t
  misc_feature (206)..(206): n is a, c, g, or t
  misc_feature (248)..(248): n is a, c, g, or t
  misc_feature (276)..(276): n is a, c, g, or t
  misc_feature (290)..(290): n is a, c, g, or t
  misc_feature (309)..(309): n is a, c, g, or t
  misc_feature (343)..(343): n is a, c, g, or t
  misc_feature (399)..(399): n is a, c, g, or t
  misc_feature (454)..(454): n is a, c, g, or t
  misc_feature (502)..(502): n is a, c, g, or t
  misc_feature (507)..(507): n is a, c, g, or t
  misc_feature (518)..(518): n is a, c, g, or t
  misc_feature (520)..(520): n is a, c, g, or t
  misc_feature (555)..(555): n is a, c, g, or t
  misc_feature (561)..(561): n is a, c, g, or t
  misc_feature (565)..(565): n is a, c, g, or t
  misc_feature (581)..(581): n is a, c, g, or t
  misc_feature (589)..(589): n is a, c, g, or t
  misc_feature (597)..(598): n is a, c, g, or t
  misc_feature (602)..(602): n is a, c, g, or t
  misc_feature (608)..(608): n is a, c, g, or t
  misc_feature (619)..(619): n is a, c, g, or t
  misc_feature (634)..(634): n is a, c, g, or t
  misc_feature (713)..(713): n is a, c, g, or t
acaaacacaattttgtacacttaattaaatagaatggaatgacncgctcctccgcattcctccccgagtnaatggtttggaagccggccactccatccccgagtngnaatngaccacggncctggctgntgccacttattttggcgcctgcaccccacgtccctatgcccgaggcgcaagctctgctctcccggggancccaagcntggcgcacacgcggggagggcggggccatggagaaggcactncagggagcaccaggcagagccggtgctnaggccggccggcantagggcgcgaggtccccancccaagccggcctctcctccacacctccgccttnctcagagacctgcaccatgggaccccactccatcctcaggacggttcactgtaganctaccaagacccctccagaaccttccggggaatcccaccccctctcctttctgancagctcaaacacctcactagcgggtacaagcctcgggcgcgacctcanaccanggggaggaaancngccttccgggcaaaccccacgaaaccctgaaagcncccganacangctgggcattccagangaaggagngtgtgctnngctnccccanccccacggggntcgggaaggtcaggnccagccagcaggggtcagaggcggctcagctgtccggctcaggaccccacctccgagggcgcctccgttggggccatgnaggccgggctaggcccgcctaccgcagcccccagg

SEQ ID NO: 625630 - DNA, 530 bp, Homo sapiens
gtccataggcgagcggggacaagcgtcttagctcatgaaaagtaagggagacaaacgtagcaagcagaaagcaaacacagattgggcaattttgactaggaacgagacttttcagcatagcaatatcacacgaacagtactaccttatttcccttacgtggaaataatatgaaaaacacttattagatatactggacaacaagagaactaagtactccaactctactgcagcattacaaaaaaaaacatcccttcaccacagtgtaagatttaagggcaacctgcccaaggatgcatgttatatcaaacacagcaagatggctgctgccctgccaagtacttccaatccctacccaggtcctactgaaatacgggtggtcccaattagttttatggaaataaatctttaaagaaaaagataaagcatttaaaaagacaagtcaaaatgcatcaggaaccacatatccaacacaaactttatcctcaaatgagttatgttggcctcgcactaatatcgcacttagacagga

SEQ ID NO: 625631 - DNA, 110 bp, Homo sapiens
agtcttcgtgcagatatagtctttggagagacagatcatggcctaccactgccctgatagaaactgaacatttgactatcaagttatcatgcattggcaccaagttatca

SEQ ID NO: 625632 - DNA, 203 bp, Homo sapiens
ccatgaaatgatcacaccaggccatgcaaaactgtacaatattacaacgagaaaaaccctacaaaatttataaaagtgaactgatattacactatcaaactaaaaagacaagtcatttcgttttcatgacgatttcaaggcttgatttgatgtcagcttcccccggtaactgcacggtgtccatgtggagggggccgcgcgga

SEQ ID NO: 625633 - DNA, 730 bp, Homo sapiens
caggttcaagcaattcttgtgcctgggaggtagaggttgcagagatcatgccactgaagctctactcccaggttcaagcaatttcttgtgcctcagcacacccaaggtaactgcggacatacgaggtgtcacgctactcacacctatggctgcatttattaggatagctattacggaacagacagggcttgcagaacacaagtgtaaagcccaagagattaggctctcagaagatcactagcagactacacgggcaaagcccagccacagcacattgagcactcccacaaaaaaggtagcataagagactaaacaaagaggttatagcacgccgaacacgacgaaacacacaaagcgcgaagtatcacaaagacgtatactccaagaaaggagaaccaagcgatgacaacagcaacgtatcggcaggaacacgaggagaaggtcactcctacaaataccgtaggggggaaaaaccccccccttgggagacaccttgacacataccgagacgggcagaaccaaataccccactggaggaaacccaatagtaaaaacagcaccagcaaaaatcaccgtggcatatggggggacggcatacaccgaaagctgaacccacactatgcaattaaggcaccacaagacgattcccattcccacagcggactagtagagcgccatatgtaaaccggtgaaggaaatgaagggacgtatcccaccacaatcaacaccc

SEQ ID NO: 625634 - DNA, 124 bp, Homo sapiens
tggacacaagctggtcactaggtggcagatgcttgaagcaacttctgaaatatttctgatatattcaagaaggaatctggtcaattgtcagctactacagcccatacaccatgcgatcgaccta

SEQ ID NO: 625635 - DNA, 161 bp, Homo sapiens
ctacatatcaactcgagcctgtaccaggaagaatgctatggcttagagctgtgcctgtgtaaagttgtttaccaaaatggctgctggaaaagcctccccaccaccacagcaggcacattggaggcctggagcagggtgactacagtcaagggcgtcagagg

SEQ ID NO: 625636 - DNA, 128 bp, Homo sapiens
tgagcggagctgcttcctgcttctgccttcctgcttctgctgcttcctgcttctgcctgactgtcctctcactggctgcgtgctctctactgttcccaaatccaattcacagtggtcttgtgtgagtg

SEQ ID NO: 625637 - DNA, 1161 bp, Homo sapiens
ggcgtcctgcaagtgggcgtggacgatcattggcatgtgcgcggtgccaggccttccgcacgcgggaaggccgcctgaagtgctgctatgcaaccttgctgcatgcgctgtgcatcaccaaacctgtgtgtgatctgtgcgggtgaccggtgagcctcacctggggccaacctcttcctggaacggacgttgtgacgtgtgtgcttgctggagtgagctggccagtgaactgtgccagatcgataaggaggccgtgcagaagtacgcctacctcaacgtggtgggcatggtgggctccatcgacaatgatttctgcggcaccgacatgaccatctggcactggactccgacctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgtccttccagaatctccacagaggaaggctggcaggagccggatgtgtgtcaaactctcgggagaaacgtgcccggaacaaccaggctgaatatcatcatcggtcggctgacgcgagcaattgatacccaaaataaacccatcacctctgacgacaatcacaccagctcgagacacgcaccttgcgctcatagacaacgttgtaacaacaatacagcacgatcgagagcagaaggagccccttgtgagatcagacaggacacagaccaagcagacattgggacttgagtcaccactcgactgactcgacgggccccatggaaacccaccagtgaagtacgaggacgacgcacgcgggacaccaagccggagacgcatggccgggaactgcacgtgcggagcgcgactaacctcaaggaagtggacacagcggtcgcgccgacagagcgacgagaactcagaagatgcgcactaacacgagtctcgacaaagaaagggcagcgttggaccctaggcagtaataatacggaagggaagagaaaacgaacaaggaagactaccaacacagagagaccgggtaagaataacccacaagaaacgagcgaccgaaagcagcaaaagtggggatcacaacacaaaagagaaggttacagccagcaagacgaaagaac

SEQ ID NO: 625638 - DNA, 296 bp, Homo sapiens
gtatgtgtccttagctcgccagtggagaaaggaatgccaaaaatagctcttctagctttctgctacaagctgaaaacattatgggctttcattcaaagcctcaggatggagtctggcgacagctgcaacatgtttgttccatgccctggcgtggcaggttgctatatgcttgttgtgaggcagcagtgtatttcaagctggggtgttaaaggttagaagggggcgcatgggtagggttgtgcgttatgccgtattatcccatgcactggacgaggtgggtacctgagctcgaagtt

SEQ ID NO: 625639 - DNA, 371 bp, Homo sapiens
cagattctgtcagaagatgatgttggctgagatgtgggccagctgtacttcactgcttcattacaagggtaaggctggccaggtgcgatggctcacgcctgtcatcccagcactttgggaggccaagatgggtggatcacgaggtcaggagattgagaccatcctggctaacaaggtgaaaccccgtctctactaaaaatacaaaaaattagccgcgcgtggtggcgggcgcctgtagtcccagctactcgggaggctgaggcaggagaatggcgtgaacccgggaggcggagcttgcagtgagctgagatcgcgccactgcactcactctggcctgagcgacaaagcgagactccatctcaaaaaaaaaa

SEQ ID NO: 625640 - DNA, 557 bp, Homo sapiens
ggtatcgaatatgccgccgaagcccgggccaaaattgtctatgagcggttgatgaacgtcactgatgacgcgggtgtaaaagatgcgctggggtttgggatgacgcgggaaatcgctcaccagatatccttcgaaaaagcgctgcatgcgatccagccgaattttccccagggcaagttgccgggcaaaccggagttcacgcaggtgtacttcaacatgtcccaaggcgcggagaacctgcgcgggccctggaaccagggtgacggttgggagtttgtggaaaacccacaaccggcggtcgatggcggtgacggcaccgccagcgtgcagttggacgccgacgatgaagcggtgctgagcgcgatgaaaatccgcacgctctcggaccccaacagcgacccccaccaccggcgctgacctgggggcgggcctcaagcccaagcccgaccttggattgagaacagccgcacgctgaaggggcgtgcggtgctttcgacttttctggacgaggacaacgacagtggaaacccacggggaaacctgctcgaatgcctacg

SEQ ID NO: 625641 - DNA, 429 bp, Homo sapiens
tgggaaacaggttgagatgggataggactagcaccattataagtccctgtcagctctacacgactcgttactgagtgcctacagtggggactccggacagtgctgtggagcaatacttgaagctatacctcttttaccatgctggttctcccaaaatctgcctgggtatagttccctataagtctctcctgtgttccctcacaccctccttcatatgaaaggtgccatggaagaggctacagggccaaacgctgagccagctgccctttattctgactcctttagtacaactccgagtgaactggatattcctataaggttattacttacctgtttcaaagccaagagctcacacacacaaaaaatgcacaaacaatgcgatcaacagaaaagctgtacatgtgtgtactgtagaccacggtgcatggg

SEQ ID NO: 625642 - DNA, 141 bp, Homo sapiens
atgtgcctgtagtcccagctacttgggtgggagcgggggctgtggcaggagaatcgcttgagcccaggaggttcaggctgtactgagccatgtctgagtcactgcagtccagcctaggcgggcagagtgagactttaaccc

SEQ ID NO: 625643 - DNA, 136 bp, Homo sapiens
ccctgtgggcttttccacaaagagaacctgtgaaaggtctccgagggtccctttccttggcgagctggggccccccaggaggggagggcaaatacttctccagcaaccccaatcatccccagcacagtcggcagct

SEQ ID NO: 625644 - DNA, 113 bp, Homo sapiens
agagtagatctgtcaacacccgcatcattgaatggtctttgcactgtgcgcagtcgcgaaggtctctccacgacagagtccaccttggggaccggtcgtgtactttgccagca

SEQ ID NO: 625645 - DNA, 246 bp, Homo sapiens
atggcgtgccagttgaccaccatgtgccatcttgatgtctcgctggctccgctttctctctggatgttggcaagtgtgggctggttgcgccggtcagcagagaggtgccggtgtcaatgagtggcctgggagccctcagcgcaggcgacgtggcctcgtccgttcgtggtgatgctgtacacggtgatctgccagtaaccctcgacggtaacaggcacccagttcagacttccagtgtggagagag

SEQ ID NO: 625646 - DNA, 179 bp, Homo sapiens
tgaatgttggtttctacattatcaagcagtagatgtaagaggcagagaaatctaaatccaaattgttaggtgtcacttccattgaagaagaaagaagttctgttttcatatgttcaacttgaacaccatgttttcaggaacagatctatcatgaaaaataaaatgtgtttctccgaata

SEQ ID NO: 625647 - DNA, 499 bp, Homo sapiens
caccctcatcccgggagaaacagtgaggaggaaggaagttggccttcatttataggatgaagaacacaaagataccaaaggaccagtgaacgtgggatcttccacacgagggtgtggaggagaaggggaagagaggggaaccaggaatgagtgtacttggcctctgaccctcaggcacccggcacagcacccagcgcacaatctgagatcaacaagggcagatccccagaaccaggcctgccctcctagactcagctagggaacccctcacagaatgggagttcccagaatacacagtcagggtgacccaagggtgggggctgggatacagaggaggggaagctcaccctagagccctcggactcacatggtttagaaggcaggggatgaaggcagtcagctgacaaatgtttcaatccctactgtgtgcaacaccctatgcctgaatgcacagctgctcatcctgtgtaatggggaacatggaaggcatacaggaggc

SEQ ID NO: 625648 - DNA, 334 bp, Homo sapiens
atctcaagaataaatcacttaggagtgtcatctacctctgattttatgacagaccagagtgttcataatacttcagggcactggagaactcatccatttatcctctttcgggtttaggaaaatatatctagcgactgacacagattgcatatcctagaaagtgagcttatactggctgcaagggcacaagcaatgtttcagcaagcagtggaaatagtaatgggccactcatgacatcaaacctacatgggcactgagcaccctggccattaagagtcagtcagcagtttctttacctgcaagattgcttgacctgcaagcattattagtaggg

SEQ ID NO: 625649 - DNA, 303 bp, Homo sapiens
tattgtacaacatactaggtgcaagtaaaggtaaggagcaagattatcaagcaaatggaaaacaaaaaagaacaaaggtggctagtcttatattagatacaacagactataacaatggtcaaaaaggacaaagaagggcattacataatgataaagggttcaattcatccagaagacttaactatcctaaagatacatgcacccaacattggagcatctagattaggaaaacaagttcttagagacctacaaagagacttagataactacataatggaagacttcaacaccccactgatagtg

SEQ ID NO: 625650 - DNA, 205 bp, Homo sapiens
tccggatttgaacgtcactatgtaacccaaaccaaacagaacagtggctgagtcagaagggttgttgcagaagtggtaaatggtcagactggagataaattttgaagggagcaccaacaggactttgtctaaaaacaaagtttaggccgggcatggtggctcatgcctgtaatcctagcactttgggaggcccaggcaggcaaat

SEQ ID NO: 625651 - DNA, 462 bp, Homo sapiens
  misc_feature (161)..(161): n is a, c, g, or t
ccaaaaaaaaagaaaaatataaatgcaaacataataaaataaaaggaatatttcccagcttctggaaagaaagccaagccaatgatctctcttataggtgacatgggatagaggatcccattccagattcccccaggtgctccatgaaacagcacagactntggttttccatcatctcagctccggggccttaaggcctcccccttacctctcctctgagttcctgtggaatccacactccagaggtggccgccccacagcctggggcctccccagggagctctcatttgggactgccccagctctgatgtgtcaggagaggcatttgcctttagccacctgttcatttgggggaattctcctataggctccctgtgttcccagttctacattcaaatcattctgggtcttttggtccttgtgataaaacatgaaacagcagaaataaacgtttaactatta

SEQ ID NO: 625652 - DNA, 706 bp, Homo sapiens
tttgtctccagccagagacagttgcatcctgggagcagtactattccttactcatctctgttgtttctacaacagccaaaatgatgctaacacctagtaagcatccagtcctttgcatatagtagatgcacacactataggtataataataataatcgttcaaattcacatagcactttctatgtgctagacactcagcactttacaaatattgactttatgtctcacaacaaccctgtgaagtaaatggtattatcatcaaccccatttgacagatgaggaaactgaggcaaaaaagattgggtcggccgggcgcagtggctcaggcctgtaatcccagcactttgggaggccgaggcgggcagatcacttgaggtcaggagttcaaaactagcctggcgaacatggtgaaaccccatctctactaaaaataaaaaaagttagtcaggcatggtggcaggcatctgtagtcccagctactcaggaggctaaggtaggaggatcgcttgagcctgggagacggaggttgcagtgagcctagatcatgccactgcactccagcctgggtgacagagcgagatcctgtttcaaaataaagaaatggcaagatctgtgcgctggtgggtgacccatggaaagggtcagggtgtggcaggagagaaggacttctgccttgagggtcggcaatgtcagacaagggaaacac

SEQ ID NO: 625653 - DNA, 1049 bp, Homo sapiens
  misc_feature (1034)..(1034): n is a, c, g, or t
aggtcctatcactgaagtagattatcggctagtcaaatgggttcctaacagcacctccctcatgggttaaaacaagagggttaatgtgatgtgtatttgcttaatttggcttgttatacagtaaacacacagcaaacgttagctattgttatcttcatttcctttggagaagttatcttatttctcaccttattaaaaataaaccctaactcatacagggaccctccttaccttggtcctttcacccatgaataccataataacctatactgcaaaaaggaggctcaggaggaggatgaggtatcaataggcctccgggtcatttttatgatttaggtattttttgaaaagggtaggctctcttgaaacttccaaggtagttgttgtagtattttattttcctttcataagaaatgctttctgaaatgtattgcagtgaacaaataacaaaattgacaaatgctgtaagccttttacagttatctgaacacacagaataaagtgtaatcaaatttgtgcacattaggtttgctttttcctgtacctagctgtctcttatgtgttcagaaccatttcttccaatcacctttttttgtcttctggctataatttatcattatctacaaattcaataaatggagcatgcatatttcatagttgagattcaataattcaggacaacagtactagaaaagaaaaaatacccaacaaaatattaagcctcatatatttttgtttataaatctaagcatcatttccaactcagaaatatgtttttaaagtatccctttaaaatacatacttgaagctgtctaattacacaaagctagatacttggctactcagatttgagggaggggttgtacaggttggagggaatttacaaaattaaaatgtatctttttaaaaccaaaagaaacatatacattcatttctaatccacagagcctacttgcctttacagtctgctgataaacactgattttttaaacattgtatataaaattaaataacatgaaaaaataaatatgctntattatataacacat

SEQ ID NO: 625654 - DNA, 284 bp, Homo sapiens
ttcttaattggaaaaaccctggggcaaataggtgcatgagtaggtggcctgcagtaatgtatacgcggttattgctgtacggccagggctattggttgaatagagtaagctgatgatttagataataactagtatggagataaggggtgtagataagccttgtggtaaagaagtagactaaggcatttttaatcttagagcgaaagcctataatcactgcgcccgctcataacgggatggccatggctaggtatataaatagtaagggtgattgagcacattct

SEQ ID NO: 625655 - DNA, 1350 bp, Homo sapiens
catctctgtttgtcgaacttgcatgaagaagaggtgaaagcagcaacaactgaacctacatgaagtggaggaggtggtccccgacactggcaacccacagcaacacgctgctgcagctgcagcaaggagcatcaacacgcaagggcacagagcagccgttgtggcacgcagctgtccccatgccagcgcagcaagaagcccgtgccagccgtctgcagggcaagctctagactgtcccccgccggatgagatgaagccacatgaccgctgatctgagggcaagatctataactgctgtataggagcgggcatgcatgctgcttagccatcactggcagatggaccatcggcggtcagcccatggcatctgcagcacacagcacacatcaggcaggcctattcccagcaagcagcaacagaccagcaaggcatgctacaggctctggcagtaagtaatcacggcctgggcaattgcggaaccatcccagacaagacgtgctacctaggaacaactcaaggctgcgagacaacatactgaggcaataactacgggcggcacctaacatggcatcaacaccctgggcccatatgggccatatggtaaaagcgcacactgatttaagcgagcctagtagagatagagcgagccaattcacaacgattttcaaaatactagaacgctaggtagaaatcccccaaagggggcccctcccgcaataccattggcttaacgcacttgcacgacattctaaacgagagggttcacaacgcaataccccccaatcacaagggaatccgcaaaatctaacctcacacacacatattggaccactaactctggcctagcatccattggcacaccaattccatcatgggtaagttataggggagacatcggaacctggatagtgcttaagctaagagatcacaaacccacgctaaagaatttgccaatctaggagcaaaccaccccatcccacacgaacaacattgtacacacgctgaaacaaatacgataactacgacacatttgcacacagtgtatccagtggttgaacacagtaccccataaatgtgacgaacgccagagggcagaaaccggcacaaacgggctaaacacagcggagcgcagtgtccagcacaaacacgtatcaccacgcgtggagcacgagctgaccaagtggggagccaacgcagcgaagagggaaacgcacagcaccgcacgcacccctagaacgacacgatgtcagaacaaaaggcggcacgagacaccacacgtcgtaggccccgccgcacacgcgaaaggggagccacaacgacacgaaacatgcaagacgcagcaacaaacag

SEQ ID NO: 625656 - DNA, 182 bp, Homo sapiens
tgtatcagcgcgtaggctgacagacaccaacacaggacgtcatggcaaacgacgaactgaccacttccgcgccgccgccatgcccaaggtagcggttgagggatcgggccgaggataaaacccatgaaaccgggtcaaggcaaacgccgacaccaggccccagggccgaggtcacgcaggct

SEQ ID NO: 625657 - DNA, 431 bp, Homo sapiens
  misc_feature (1)..(1): n is a, c, g, or t
  misc_feature (3)..(3): n is a, c, g, or t
  misc_feature (14)..(14): n is a, c, g, or t
  misc_feature (321)..(321): n is a, c, g, or t
  misc_feature (403)..(403): n is a, c, g, or t
ntntcggcacagantcctgcctcagcctcctgagtagctgggattacaggcatgcgcagctatgcccagataatttttttgtatttttagtagagacagggtttcaccatgttggccaggctggtctggaactcctaacctcaggttatccacccaccttggcctcccaaagtgctgggattataggcatgaaccaccgtgcctgggccaaagatgtaatttaaaatagttagaagggacttgggcatgggcaggcttccgtgcatggcattttcacccccagagcttcctgaatcctgtttttcacacagggaagttttntagggtcttttctaggaacagctaggaaatagtaggctggactccccgcccaagggccccaacctttcaaaaccctggaggntttttcagggctggcattcctttgggtg

SEQ ID NO: 625658 - DNA, 740 bp, Homo sapiens
gtaagaggcgtcgttgtgttttggaggccgtgaaatcagccgtttgatttgggctgcgggtggacgcaacgtttgtcatggagcgccgtctacacaaagtgagttgcccgccctgttgacgatgtgtgtccatgcatgatttcgagagacggaaccgactagtgagccggttctacagtcacccggtgctggcggttgttgccattgttcggcaccgggatgaatcatcctgggtacctggttacatgagatcatgtaaacctatgtgatggcaagttatgcatgactgtgcgcaattgactctaggtccaagctccatgccagctgtcacacatgcagttatgaagtcatctgtcattactattcgtcctgagagcaagtggcttgtattaatgccttgctgctacgtgtaatgcgcgtcttcatgtacttaatgtggatatagtcagttcaaggctgctcttatggagccatatgtcttcatcgaaggtggggtagccatgataccattcttctgttaccgacttttggacttcgtctctcaagttcgccgtggcttgctacttagttctcgtcacctgttttgcctggagatcaagatgtgtctgggatcaactacctgattgttcgctatcaggatgatcctccttggccttggtgctcccagcttgcctcctgttcattggcttgtgtctttgggcttattcatcattttacggattgtctaattaccgttgttt

SEQ ID NO: 625659 - DNA, 630 bp, Homo sapiens
ctctttccttgcctaacgcagccatggctcgaggtcccaagaagcatatgaagccgctggcagctccaaagcattggatgctgtataaattgaccggtgtgtttgatcctcgtatcatccaccggtccacacatgatgagagagtgtctccccctcatcattttcctgaggaacatacttaagtatgccttgacaggatatgaacgaaagaagatttgcatgcagcggttcattgtcatcagcattgacaagacgggagagaatttccgtctgatctatgacaccaagggatcgtctgctgtacatcgtattacacctgaggaggccaagtacaagctgagcaaagtgagaaagatctttgtgggcacataaggaattcctcatctggcgactcatgatgcccgcaccatccgttaccacgatcccctcatcaaggtgaatgataccattcagattgatttagagactggcaagatactgtttcatcaagttcgacactggtacctgtgactgtgactggagtgctacctaggatgatttgtgtgacatcaccgagagaggcaccatgatctttagactggtcacgtgaagatgccaatggcacagctttgccctcaagttcgacatttt

SEQ ID NO: 625660 - DNA, 327 bp, Homo sapiens
  misc_feature (20)..(20): n is a, c, g, or t
  misc_feature (26)..(26): n is a, c, g, or t
  misc_feature (68)..(68): n is a, c, g, or t
  misc_feature (181)..(181): n is a, c, g, or t
cccctgggcaacatagcaancccctntctcaaaaaaaaaaaaaaaattaggcaggcatcgtggttcanacctgtagtccccaattactcaggaggctgaggtggagggattgcctgagccccagggttcaagactggcctgtgcaatatagcaagaccccatccctaaaaaataaaaaacncctatcagggtgggtgcatgccagtagcctcagctactcaggaggctgaagagagaggatcacttgagtccagcaggttgggacagcagtgagctatgattgtgtctctgtacttcagcctgagtgacagagcaagaccctgtctc

SEQ ID NO: 625661 - DNA, 185 bp, Homo sapiens
aggactccggacgaggcgaagatcccagtcccacgagacgctttagaaagatgaaagccggtgatcactcaccggctacagcagggcctttgaaagccgtataaactctccttacaagttcccccattttacctgtcctaaaaccagacaagccttacgagttagttcaggatctgggcctcgtg

SEQ ID NO: 625662 - DNA, 595 bp, Homo sapiens
gcggatgacaaggatactctgccttaagcttaaggacctggcattctcaagaaccagatggaaagcctgcagcggcgtgttttaagacgaagtcaacagtggagtgggccaggatggactcgctgtgtcctccccgatcctcaagggatacctggctggctatgtggtaggccaaactgagggcatcagcagtattttggctctgctgagggcacctgcacctgggcatctatgcggctcaggcatatgctgtgcccaacgtggagaagacattaagggactattatgcagttgcatacgcaaggggcccgaatagctctaggtgccatggaaagagagcaggaatgacgcaagcatcagaccattcaggtgagagaaaaacaattaactcatggaattcacccagaatgatcaatccaaatattgactaatcatcacaaactttatccatggcaacaccatatcagtccttggcaatacccattccatggcaaaaatagatggaacaagatacgtacccttcagacatgacaaaccatggaatagcctaacaatatccccctttcctaaggctcacatgggaactcgacaccaa

SEQ ID NO: 625663 - DNA, 1524 bp, Homo sapiens
  misc_feature (99)..(99): n is a, c, g, or t
ggctgccggcgtctctgtccgactagcgccaccgagacgtaggaaacagcgctgcttccctgcgtgccctatccagtctacctcgttaggcagagctcnagcagctcttcacgatcccatgttccaattgatggacacagagcagacacacgccaagcgagtgagtgccgatgtgaggtgcgccctgtgaattgggctagcaagaatggcatgcggctagctgatatgaccgcctagaatgaactcgtctgcacttccgtgacgtacacgtggcagtgtatcgagtcagagtgcgatcaccgagatgatgaagttgaagagtcacgggcttcgtagccacggcacaggatgtttgcccgcgactgactcacatggcctcgtgaaaagctattagctgtgaaccgagggacctggggacattcattaccttacgagctatgaccgattccaatcaccattgcaccgaaaagatggggaactagaccaaatggggaaagattagatcccagtcaagtgtcgacagggggacgacgcttgagcacatttctctcaaatttgtcccatgaaaccaattctaggacagtcgaagacaactcgacaagtccgcagcgtagtgggctgtcgattgaactcaaccttaaggtccaatgcccagtaacaaagtttggcttcgacgggccaccatattcttgagggaacgcattgagcgttggtgaaatcccgtggaaaggcttcccggcagcactttttatcgaccgggggacaatttagccccttctattagggccccttgaagctttttgcagccagagggttctgtccatggccaacaagttcggttgggtgaccgattcgttgacgctcaagtttccattggcacccacaccacggtgaagcctttgcgagtcccaaatcgctttggaaaagggacttaacgcaaaggttaagcaaatggtgccgaactagcaagtatgttcttaaacatccttttaagaccgttctaaattcgcaatatggcgattaaccttgcgagacgactccccgtgggacagcccatttctgcgcggtaccaattggagcatactttgacatttttccaattgcgtcccacggaagacccgctggtatcattggtgcccggacactgtgggctgtataccatccaccacatgtagacgcggtaagaaaacccgtgaaccacgggtagtatacactcccagtgtttgaaacgtttgcgagccgtaagcgtctcaacacagagataatctctacgacagggggcataaattttccctatagaagaccaatcacctcgtgggagtcggcccaaaaacacccgcggacatagacgacatacatcatttgggacacgtctacaacgattagataaacccatcaaaagattctatccacagaaagcaggcgatatcatcactgtctatttactatacacagcagttggtaggttcagtgtgatcttcacaacatagaacaatgtacgtctcccagtaaccaacaccttat

SEQ ID NO: 625664 - DNA, 182 bp, Homo sapiens
ccgggaggtgctatatgcgggatcgctgtgtctttcggcgcgctcatttcacccggtgggtgctctgcgtcgcgcccatcttggctgtgcgcgggtggtgctcctggcgtgtccgggtctgctcttggctggggcctgactcctgcggcacttgggtcaggtagggaatcagccggttcaag

SEQ ID NO: 625665 - DNA, 828 bp, Homo sapiens
ttgggtgatccccctaacggcgggtttcccagcccacgagggaggctccaccactgagtatccccacttgtcccccgcctatgaggttttttttttcttgtgcggtaccccccgactggtgtgaatgttcatgactacctatccctttccacgcccctctttgtctacccactcttctggaccactggtctcgtacccacgcttggtttttacagacttttctctctacagggtggtgttaccccacgcagttggctgtaagggcgtccaaagtgggcgagcgggagcccacgatacgtcaccctttaaatcgtgtttacccggactgttgtctgttaacactctgcttagtggaggacgtcacgcctccttgtggaagattccccccacttggggtgtgtttgtctcttttgaccctcgctctcgtacccctcttttcacgcggtatattctattttttggccaccacacaaccgattcatgcacttgtcccaacgctctttatgatgtttttttggagattctctcgccgccctctctctcgacacgctgaggcccctcgaggcgatttatttctaacgcacgtgtttgcacacagcgtgcctcgtgtggtgctctctctggtgttttctttggttactttgggtggccacaagcaaatttccctagccccgcggcagttcccttcttttcattttgttgtaaagatttttcacctttttttttgagggctgggggttgggggagtccccctgattatattttaaagtagaaatttgacatttggatattaaactgtaaattaatgtttaattaatggccccttta

SEQ ID NO: 625666 - DNA, 116 bp, Homo sapiens
agctccttgcactgtgagctccttagatcagtcaccaagacaggaaaatgggttttcctaactcagtggttctcaaacttggtttgtgtcaagagcaccactgtttgcctgggact

SEQ ID NO: 625667 - DNA, 260 bp, Homo sapiens
gcttctctctcccggccagtagagtttccactgtaaagtctgctgccagacatgttggagctcccagtagggttaattggttcctttccccattctggctaaagaacttttatctttgacttttggaagactattgaatgcttcgaagtagtgttttttgggttaaatctgcttaatgttctataacatttttgtagttggatatggatgtctttctctaggtttggaaagttctctgttattatccctgtgaataaatt

SEQ ID NO: 625668 - DNA, 358 bp, Homo sapiens
ggggtttcactatgtggcccaggctgtggcccttatattaggtgttccgttcgatcaaatagccttagctggccgggctcggtggctcacgcctgtggtcccagcactttgggaggctgaggtaggtggatcatgaggtcaggagatccagcccatcctggataacaaaatgaaactgtctctactacaaataccaaaaattagctgggtgtggtggcgggcgcctgtagtcccagctactcgggaggctgaggtgggagtatggcgtgaacccgagaggtggagattgcggtgagccgagatcacgcccccgcactccagcctgggcaacagagcgagactccttctcaggaaaaaa

SEQ ID NO: 625669 - DNA, 203 bp, Homo sapiens
caatcaagactcagtataagatcaactttgggttaatgattttgcgcattgtaggccaatatgagtatctcgtatcatgtgtaaatgcacgcttaggtgtgctatgatgctcggtaggttacttgtacctctattaactgcatctttgacctaggatattttcaatttctgataggttttttggggtgtaatactactgcaag

SEQ ID NO: 625670 - DNA, 773 bp, Homo sapiens
agtggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggcatgccgactgcgctgcgagctggtactgctggagacggggccagcgaggcgcgagcccagtcatctatcactggccatacccatcaccatccaagcattctccttccgcggacgtgcgtccaacgccgctgcgctgaccactgccgttcacgacatgtccccgttaccactgtacatccgtatccgctggcacgaacctacgtgcgcggccctggagctagccagggctggccatgagcccagaccaccctactgcgaccgagtcctggcggcgaacatggctggctgtacacagcgcgcctggcactccgccaaactcccgcaggcagctgcctatcccctagagccacgctgcaacgggccgggctcctggctgacagggaacagcaacgtcgccccgctgcctcggacgccgaggcatggccgaggctctgtcggatcggcgacgacggaggaggaggatgaccgaggaggacagacgaggacggcgcgaggctgccgcgcaccaggcggacggcccccccgatctccccggagcctgtcggccctggctgcgtctgccacgccaccgcctgcggacctgcacctgccgccacgccccccccctgcag

SEQ ID NO: 625671 - DNA, 225 bp, Homo sapiens
  misc_feature (77)..(77): n is a, c, g, or t
  misc_feature (101)..(101): n is a, c, g, or t
  misc_feature (122)..(122): n is a, c, g, or t
  misc_feature (145)..(145): n is a, c, g, or t
agttcggcacaggcgacgcagccattgctcaggattatggggtcttaaaggctgatgaaggcatctcgtctcagggngccttctttactcattcgatgacnaaggcgtattcttccggcccnatcactgtaaatgacctccctgnttggccgctctgtggatcgagactttgagactagttcaggccttccagttcactgacaaacatgcgggaagtgtcgccca

SEQ ID NO: 625672 - DNA, 684 bp, Homo sapiens
tctgcctaagcttaaggacctggcatttctcaagaaccagctggaatgcctgcagcggcgtgtagaagactgaaggtcaacagtggagtgggccaggatggctcgcatgtcgtcctctcccgttcctcaatgggatttcgtggctggttatgtggatggccaaactgagggcatacagcaggtagtcggcgccttaagctagtgcgacaaccattgcactggccatctatgcggctcaggcatatgctgtgcccaacgtggacgaagacattaacgggactatttgcagttgctacgcagggggcccgactaagctctaggtgccagtggaagaggcaggatgagcagctcagccttcaggtggagacacttaatctggattccccagcggtcatccattatgctatctccaatttcctgccaccttcatcctatgcctcccttcctgcagatgttggacagtagttcctcagctgcaaccgtggattccttcttccccttcctagctccatgggactcgccccaagactggtggcttcaaggaccacaagccccttactcttcaagccctgaggtgtggagtaggagatgcctctgatcgtcagtattctctctggcaatgtccccacggttctccttcctgggagctggctccataacttgattttccccaaacgtgttgca

SEQ ID NO: 625673 - DNA, 238 bp, Homo sapiens
attgttcagtgctgtgtgcactccgtttatgtttgcctttctgggcctgattcctcaactagcacatcgatgcagaacggttgttactaaatctccaaggcagaaatggctacagtgccaggctcgtgctaggaacggagaggtgctattactatttttttaattgtatttgatttagtctatttgatgtgattcttttcactcccgttgccttccttcttccttctccccctgcttg

SEQ ID NO: 625674 - DNA, 180 bp, Homo sapiens
ggtgcctagaggatccccaggcaaagctcctacctgacattgtattatgtctttatttgctcattgctgtgtccacactaggacgtaaagcttcacagggagcaggtacttgctctgtttttctaactgcgggtacaaagcggaagctcaatagatatgtatccaaaggtaccgagctcg

SEQ ID NO: 625675 - DNA, 1311 bp, Homo sapiens
  misc_feature (401)..(401): n is a, c, g, or t
ggccgcccttttttttttttatttctcatttaactttatgaaaggggtctcaaaattctgtgacaaattttgggctcaagttgtggtttccattaaaaagtacgtgattattaaaaacataataacttaaaacgtgccacagcgcaaaaaagaaaaccaaaggtggtccacaaaacattctcctttccttcgtgagaggttttcacgagtgcatgtgttactcattaaccgagctcttttacttactaaacttaatgtggccaatgtgaaacaaacgagttcgtgagaacgcgttcttccaccaacgtggattaagaaggtgggggtggcaggttattgagggaaataatatctcatttatagcctctcgtggagccttatcggtgggccagaacgtgtgnggtgcaccttgtggcccgagcctccgagcaagccgtctcttgtggtccaactgtgcttttggtgagtgaccagcccacgcgaaaatgtggtacgtggtctacatattcagcgaaacagacaagaggcgaacccaagagggtggactagttcgtgagaaagggttctcaaccacacatgtgggcctggcccgagggaacccatttcaacacaaacgggccagctatcacgcgagatctctcagagaaattctgagggcctatctgtccgaggcgttattacaccagaaacagcggggaatcaatccttattcctatcaagctcagccaacacttggctatgccaaggtggagccggtgtgcgcaaactcccaataccagggcggacatacgccgggcgcaaatatgggcctaggactgggctccagggaataatcaccctagagccagtggaagaccaggtaggcataccatagggggggccacaaatggggtagtcacccaggcaggcgtgcaccgaagaaacaactcggaggaacagacacccagttgcgtgcacacttggtaagccccacattgggctccgccgaaagagagctcgacgccaagcaccagcggggcagcatcgcaaacgaaatgataacaccccagggttaccacagtaaccggggcgccacaccaggggtacgcccaccacagggggctgatagaaacacacgccattcgactgcggcaacacagaagagaagcccaaacacccagttgtgaaaccccgacagaagggaccacgggcaaccacaacacaccgcggaggtggctgcacacaaaaaacaccacgtcagcgtcaagtcgcaccagcaagaccctacacaagacagatgctcgacgagcgagcgcaacgaatggtcgtcga

SEQ ID NO: 625676 - DNA, 237 bp, Homo sapiens
cccgggttcttgggacacgtgcttcttacaaaagtgccgctgcaatatacagagtacctctgcaacaattatggtgtttttcttaaagtgaaagactgggtgggatccaaggaatcacagcagtagatggacaaaccaggagcatccccgagttatttacaggaaacggagcaacaacacacacgaaaggtacactttccaatcaaggaattcttcccaacaacttcaactttagct

SEQ ID NO: 625677 - DNA, 141 bp, Homo sapiens
ccctcaccaccacccacgatttctgggtcgaaggtcagacggaccggagtaccaatggtgtcacagcgggccacatactgatcccgcaccgttccggtctccaaccacactgttaatagctcgtcaaggtggatgagaagg

SEQ ID NO: 625678 - DNA, 916 bp, Homo sapiens
tggttgggttggttggtttttccttttacttttgggtataaagttcctctactgagttaaatttgtggaaatagccagggcctctagaaagcgtgggggggtgtgttcccatttgggcgggggggtcatcacggtccgtttcaggatgagggggccaaactgcgggcgtgtgtaaccacctcggtatataccgctcgccacacaggtggcacaactctccaatatgactgaggcgggcgacggggccaaggggcatgtggatagggggctcggggtgtgtgttacaccccgtggccatataacgcggtcaccgtggtaaggcggggttgtcggcgcgggggttgggagcacacgggtgggcgcgtggcggggttgcgcgccgtacacgcagagcgcgtgtggcgcttatatcttgtgtgggcggtggggtatttttcccacccccgtgggagtagagcgcggggggaatgggcggtgtgggagaggtgtaccccgcgtccagagatctgtgtgcccacatatatcaatgtgggtgcgcggcgctctctctgggggcctctcacaaaagtgggggggcgtcaccctctctgagagacaagcgagcgtttacgcccctgtgtgtgtcgcggcttgcgcgaaaagacagggtgtaaaaggggagagaagcacaggagatattggtatctaaaaagaggcgagtatgtgctgacagtgatgtgtgcagagtaaacccgccctcttgttgtaccctgggtaataaggggggggacccctggggctaagggctaatctcatatttggggcccctaacggggggcagccacctattcttttgagcggttttgacacaaaacggtcgtgggagactacgcctggagctattaataaaaaaactcgcggggggggaacactctta

SEQ ID NO: 625679 - DNA, 528 bp, Homo sapiens
gctgaatgaccgtatggagaacagctgtcctcaccaatcaggaatactaccatggacttcagtgcaagggagaaatcaagttctgtgtatttatctaggataggtccatggacagggcatgttgaggtccatctgtggcagcagtgaacattacccacatctatctatacccttatctggcaatccagtgctacttcaatttggcaactgatgggcacttagtatttgtacacagaagtcctaaattctaacaagatacagagccagcttatcaactagtcaggaaagcaggcaggtgggcaactaccgagaatactaggaaactgtgactgaaggacaagcaaagaactgttaagaggacaattaaaagtgcaattaatatttatctgtgaaggtgccacagagtgggtagcaactgaattgggtcttgaaggaggaggaactgttcaagagaaagaggaaggtagaaaagttcaatccagactgaacatgagtttgccaacttttatccattgtgctgtgatacta

SEQ ID NO: 625680 - DNA, 127 bp, Homo sapiens
caggctttgacgaagcacaagaccctccaacacgatcggtgctgtaatgagcatagacagacggactcacgagccatttcctgagccccagggctgaatcccccctccttgaccccgaacaccgata

SEQ ID NO: 625681 - DNA, 124 bp, Homo sapiens
ggcggacctctctgctcccagattctagaaacttctgttctactttatacttctatgagatccacttttaaaaaacacatagtgttatggctgggcgcggtggctcacgcttgtaatcccagca

SEQ ID NO: 625682 - DNA, 538 bp, Homo sapiens
  misc_feature (357)..(357): n is a, c, g, or t
tctgtccctggtcaactggatttggctttcccgtgctttcccgggaaacccctgtttggggttttgtgggtttggggggaaaagggccctcttcctaaatgtaacccgcaagctctcccaaggcccccggggcctggcttttgttagggtgtggaaaatggtggcccccctttccccgcttgtgttgcccacaagtccccgggtgttgagggggtggttcaacccgccccccccccctgttttaaaaaaggcccctttgcccctttcaaaaaaaaaaggagggcaagcccctaggcctttgggtttttggtaaaggggggccaccccaaaggttttttgggttttgatttgaaaccnggggggggggggtgaaaaactttttttggcccccttggggccccccccttttttccccttttgggttcccggggacaccaaacaaaaccccccggacaaaaagttgtttttaaaagggctttggggttttttttttgccccaaagtttttgtgtttttcccaaaaaattttttttgcccca

SEQ ID NO: 625683 - DNA, 509 bp, Homo sapiens
gggcaattcaaattctacagccatcagactggaaactgaggaaagagccaatgttgcagttcaaatcaaaatgccatctgctgcagaattcctttctgcttgggagaggtcagcttttttttctctatttaggcctaaaactgattggaccacccatattatgaaggacaatctgctttcctcaaagtccatcaatttaaatgttaatcttatccaaaatcaccttcacagaaacatccagaataacatataatctaatatctgtgcaccatggcccagagggttgacacataaagttaaccttcacacagtccttaatgacacaatgcttagcagtgttttctgcgtcttgatagaagtagcgaaactcctgtaaaagatgttttggcactctctaaaaagacttgaagtctttaagccctaagatgtggtttaagagaaagattttttccaaagggggctacttagcagtagattcagtgtctaatgtcttctggcttgcaaatgtg

SEQ ID NO: 625684 - DNA, 114 bp, Homo sapiens
tgcggcgatgaggggccactgtgggagtgagcattattgagatccggtgagggagcttgagacgaagacgggtctcgccgacggtgcctcaagacaagttcggctactgcagtg

SEQ ID NO: 625685 - DNA, 481 bp, Homo sapiens
  misc_feature (129)..(129): n is a, c, g, or t
  misc_feature (133)..(133): n is a, c, g, or t
  misc_feature (136)..(136): n is a, c, g, or t
  misc_feature (147)..(147): n is a, c, g, or t
  misc_feature (154)..(154): n is a, c, g, or t
cgagaactcttggcacacatcaaagagcagacaaaggctaagctctttgcaaagcatcaagctcgagcccatctcttccagacctctaaagagacccgggtttgttttgggggccccccttcccccctncccnggncttcaaagggntcttttnccccaaaaaaaaaggaagggggcctccaaacttagaagtctcttctacccctgaaacaaaaatggaaggttcgactggtgtcattattgtcaatccaaactgtagatctcctagcaacaagtctgcccacctccgggagaccaccactgtactacagcagtctcttaacccaagtaaacttccagaaactgccactgacttatctgtgcatagttctgatgaaaacatacctgtgtcacatttatctgagaaaattgtttcatctacctcttctgaaaatagcagtgtgcccatgctttttaataaaaattctgtccctgtaaaaaa

SEQ ID NO: 625686 - DNA, 623 bp, Homo sapiens
  misc_feature (560)..(560): n is a, c, g, or t
gtcgcgggcacggcgccgccgcgagcagcgcgtcgcgcatatagctttcagccctttctgaccaaagaaccacgctttcctactgagcgctacactcattttcaggctgcctggtcacgacacccaccgcaccattcggccaactcaaggaggcttgatgaacgatgagctgcaacacctgaaaaaccttggcaagacgtcagcgcagtggctgcatgcggtgggcatccacagcgcgtccgacttgcgtcggctaggggcggtcgatgcctaccgagccgtgcgcacgcgcgggtttcgagcttcgcaggttctgctgtatgccattgaaggggcattgatggatgtgcactggaacgacatacccacggagcgcaaggaggccttgaaccgtcagttggaagcgatctcagtacatcagaagaactagagcggcactcaaacccagtgttgatgggcattgcaaacgagcgtttgagaaaactggatgaagcaggaaaacaaatgttgactctcaaatgagaatcgttatgattatcacagctggtcgcgagatcagncgataactgaaagaccattggttcggactctcagattatctcctcagcagggcaccactcggg

SEQ ID NO: 625687 - DNA, 338 bp, Homo sapiens
  misc_feature (254)..(254): n is a, c, g, or t
  misc_feature (285)..(285): n is a, c, g, or t
tcacgaccactaaaagttgacatttgcattggcaataacccccccccccccgcttttttttttaatggcagagtttcgctcttgtcacccaaaccgaagtgcagtggtgtgatatcggctccttgcaacctccacctcccgggttcaagcgattctcctgcctcagcctcccaagtacctgggattacaggcatgcaccaccatgcctaattttatattttttttagtagagacagggtttcaccatgttggtncaggttggtcatgaactcctgacctcaggtngatccacccaccttcaggcctcccaaagtgctggggattatagggcgggacat

SEQ ID NO: 625688 - DNA, 187 bp, Homo sapiens
agtagctagaatacggtgcttgccacacactcggcttattgttaagtttttattttgtagagatggggctcaccatgttgctcaggctggtctcaaactcctgggctcaagtaatccttctgccgtggcctcccaaagtgttgggattacttggcaagagccaccacgtctgtctcgtgcccaccct

SEQ ID NO: 625689 - DNA, 797 bp, Homo sapiens
gccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggcccctgaaaagaggaaaaaaaaaaaaaaagaggccaggcattggtgtggcctcacgcctttgttaattctcagcactttgtgggaggcttgaggcgggcggattcacagggcctccagagtttcaagaagcagcctgttggccaacatgtggttgaaaccccgttcctctacttaaagattacaaaaaatttagccgggcgttgggtggttgcattgccttgttaatctccaagaattactcaggaggcttgaggcaggagaaattcgctttgacccttgggaaggcggaggtttgcagttgagccgagaattcattgccatttgcacttccagcctgtgggcgacagaagtgtgagacttcgtgttcttcaaaaaaaaaaaacaaaattaaagtgtgtggtttgctgcttatattgggggggtgataatatgctataatatgggggggtgaatgccaaatgttctctattctatttggacacttccccacgggaggtttttggcgtttaagagtttcggtgtacccccagaaaaaaaattgtgccctatacccttgaagtccttacttgggtactccttgacacctcaaggggaaactccaataccgggtctggagggtgtgttacaaaccacctggaatgtggt

SEQ ID NO: 625690 - DNA, 289 bp, Homo sapiens
gtgtatcttttaccagcatgtcatgtgatgcatgtgagagacgggctcatggacttcctgatccttaagctatactcaatgacttgagtttccttctagtagaggtcttatgcttatcatttgcataaatcacatttctacagtggtaggtttcgtaatgcctggtgcataagatcaggctttttaattagaagttcgttttcattaccaatttaatatttgtattaagagtgttagaaaagtataacatataaaaccataagccctaaagtaaggctgcctgggcttc

SEQ ID NO: 625691 - DNA, 458 bp, Homo sapiens
  misc_feature (6)..(6): n is a, c, g, or t
  misc_feature (13)..(13): n is a, c, g, or t
  misc_feature (136)..(136): n is a, c, g, or t
  misc_feature (175)..(175): n is a, c, g, or t
  misc_feature (193)..(193): n is a, c, g, or t
  misc_feature (231)..(232): n is a, c, g, or t
  misc_feature (269)..(269): n is a, c, g, or t
  misc_feature (322)..(322): n is a, c, g, or t
  misc_feature (396)..(396): n is a, c, g, or t
ccattnacattgnattagcccttataggtaatctagagccgatttaaagtgtatggtccggatgtgcataggttatccgcaaatactacaccatttccctataagggacttgaaccccatggactttagtatcccngggggttcttggaaccacccacccatagggtcaccatcnggacaactatagtaccgngtttatttcctattaattcaggttccatttagagtctnnaactaaaacctaatcatttagtcacagtgtaaaaacnaatggaaataacagctcaaatcttcaaaatattactatagcattatgtttaanataatctacaacaaaaatgtaccattttccaagcagtactacatttaggagcccttttatagaaaataatttcntgctttgacccccgttcccagtgtggaatctagtatttcggttaacatttgtgtgggcatgt

SEQ ID NO: 625692 - DNA, 88 bp, Homo sapiens
ggaggacaccgagttccccgtgttggcctccagtgtcctgtgcttgcgtgagcctgtcctggctggctggtgatctgatgcccctgac

SEQ ID NO: 625693 - DNA, 197 bp, Homo sapiens
tgtttatcgatgccaccacttggcttcccaaggtgctagcattacaggcatgagccaccacgcccagcctgttctattaaaaacatcttgaccttttttttttttaaggtttatgatataaaaacagtcggggggctttccctcaggtgggatatctgaagtggtgggagcagatgtagctccattttccatttaaa

SEQ ID NO: 625694 - DNA, 284 bp, Homo sapiens
accccatgcacttgtcaacagtaatttatcacacttggtcatgctagaaagatttgcctccaaagtatctgatttgtaattaattcttcttggttttagaaactaaaatgtacgctatgcaaatgtgttagattcaggagatagagcaccaatgaaacacaaaacaaattagggcttaataacgatgcatgtgctatatgattatggtaaaatataaaataagtatatcaaaagggcacgcatgaagaattgaaagaattcatccttggtatattaggctacgt

SEQ ID NO: 625695 - DNA, 347 bp, Homo sapiens
acttcaaaagaaccttggtctccacagtcttttatcttaacctgaacattccctttctatcattcccgggtcttgaatcaaactcaaccaattatcaaccagaaaatgtttaaattcacctatagcctggaaccaaccaccaaaccccaataccctcccatcccccaacccccctgccagccccaacccctgccacccccactccctctgctttgagttgtcccacctttctggatcaaactgatgtatttcttaagtgtagttaattgatgtctcatgcctctctaaaatgtataaaagcaagctgcatcccaaccaccttgggcacatgttctcaggacctcctg

SEQ ID NO: 625696 - DNA, 239 bp, Homo sapiens
  misc_feature (80)..(81): n is a, c, g, or t
  misc_feature (223)..(223): n is a, c, g, or t
aggaaaaattgacattacttgttagaagagcaactctgaaagaaaacaagcaaattccaaaacagaaaagattcacaatnnaaaggtgcatacattaaagggccacactgtgtaatactgtgccaacttatgcgagtctcattgttcaggatgaaatgtgagattgtagtttgaatgctataagcaggttccaagataccccaaatgactgtaagccagactngaagcatgtcaaaaag

SEQ ID NO: 625697 - DNA, 365 bp, Homo sapiens
  misc_feature (309)..(309): n is a, c, g, or t
cactcattttgcagcaaacctgacccacaccgaggccaggccagccccgcggtcctggtgggtgagtgtgtctgggtgctattgctgtggaaacgtcggcgtgtttggtcatggctgccagatgccgtccctaacactttcccatgcttatttgacttatgtcattaccttacttctctgaaacagtctgaattccaaaccctgtgtggccctaaggattttggataagggactatgtacctataatataaataagccatattatttacaatcatgagtttctgaatgttcactttttttatttttggngacagagtcttgttctgtcacccaggctttagagtaccacagtgtgatctcggctc

SEQ ID NO: 625698 - DNA, 359 bp, Homo sapiens
  misc_feature (171)..(171): n is a, c, g, or t
  misc_feature (195)..(195): n is a, c, g, or t
  misc_feature (247)..(247): n is a, c, g, or t
gagaatatggaacaccacaggagcaactgaatctggcattattaactttaaattttttgagcctgcccaaaggccagatgttatcagcagctgaacagcatctacagaaaccagctgcaaagacagaagcagaagaatgatttggcagagagatccaataacaaaaatttnggaaataggtaaaataataacttngggtagaggttatgcttgtgtttctccagggccaaaatcatcagtcagtttnggataccatcaagacacctggaaatcttgtcatggggccagatgccaagggaaggaggttccggggaggttcctggagggacccccccggtttgcagccatgttccaaggct

SEQ ID NO: 625699 - DNA, 313 bp, Homo sapiens
  misc_feature (64)..(64): n is a, c, g, or t
  misc_feature (108)..(108): n is a, c, g, or t
  misc_feature (112)..(112): n is a, c, g, or t
  misc_feature (116)..(116): n is a, c, g, or t
  misc_feature (120)..(120): n is a, c, g, or t
  misc_feature (125)..(125): n is a, c, g, or t
  misc_feature (146)..(146): n is a, c, g, or t
  misc_feature (148)..(148): n is a, c, g, or t
  misc_feature (150)..(150): n is a, c, g, or t
  misc_feature (160)..(160): n is a, c, g, or t
  misc_feature (186)..(186): n is a, c, g, or t
tattccgggtttggtttttttggtttggtttttttcttttggaaaggcaatgagctagtcccanaaaggatccttcagttacataccatttgtttaatgaaatgtcanggcnctgntcanatttntgtcttgttcttcccattggnananacactttcanagcctcttgtatttggaaggctggangggccccgactttggaaaagggttttgggttccctggttttgttttgatttttttttttgttttgattttttttaaactaaagctaaataaagcttgtggattaaacagaataaatttttaaattta

SEQ ID NO: 625700 - DNA, 798 bp, Homo sapiens
  misc_feature (626)..(626): n is a, c, g, or t
cgcagggctcatgcctgtaatcccaacacttgggtggtgaggcgggcagatcacctgaggtcaagagttcgagaccagcctggcaacatgggaaactcggtctctactaaaaatacaaaaattagccaggtgcggtggtgtgcacctgtaatcccagctacttgggaggctgaggcaggagaatcgtgtgaactggggaggtggaggttgcagtgagccgagatcacaccactgcactccatcctgggtgacagagcaaaagtctatcttaaaaaaaaaaacggaaagtcatggtcataagtcatcggtggtacctctggtggcattgggtcaccaggttgggagagaaacacagaaggtgccgacataatttctgggcaagtctcttttcgggacacggcaacatattctcagtggcaacaaatatcaccgagggaacgaaggtctggggacggcaaaatccaggcgttttcacctttgcggggattgcgccgcagacagaaaccttatgccggctcatttcttgttaccaggctgcgtgcgtgggtagctttaaccagtcttcatggccaggctatacggcacgaaagaaaccgagggcgaaagggaaactggaggcccattcngtcccctaatgggcacagcgctcacatccaacacacatcgggccgaattctgcgcgacagcggactcgccggcgggggctcaccccaacgccgggcggttcaagaggcagccgcagatcaaccccaaattggagctccaaactcggcggcgcaaagaagcaaaaagggctag

SEQ ID NO: 625701 - DNA, 275 bp, Homo sapiens
agggggggcccccaaaaggccccccccccccgggggttttttttacccttttttggggggggaggggtttttaatttttcccccctcccccaaaaccgaagggccaaaaaccggtttttggttttaaaaaaacgtttttttttttcccgggggaaaaaatttaaaaagggggtttttttcccccccccccccaaacccgggccagggggggggttttttttttaaaaaaaaaagggtttcccccacccttttccgggggtttcccccccccccca

SEQ ID NO: 625702 - DNA, 147 bp, Homo sapiens
tacctatactgtatgcggcgggagctcgacgaatccctccaggtcgctgaaggttgaccaggatatactactgagctgctaaagtcctaccagtggaagatgctcaggacttccctcctttgctggagcagctgaacgagcagtttt

SEQ ID NO: 625703 - DNA, 538 bp, Homo sapiens
ccgctcgcgtcttgtctgtgtgcctgcgtccctctctcctccgccgcgcgcgcggtgggggcgcgcgcgcgcacgctctcttctctctcgtgtgtgttgtgcgctcctctcgcgcctcgcccgccgcgcacacgcgtggtcttctctcccgctcccctctcgctgcgccctcgcccctctccttctgggtgtggctcgccgccctctccttgctcccacgacctttgtcttttttcttgttgtgcatgtctctccgttgtcggctcctcacctctctcttgtggtggcgcccctccctcctgggtgggggggcgtgccccctcccctccccctccacactcctccccctctctcatcttttcttctccccctctctttgttgtttatctcccctctcacttctgctcctctctctcttctttgttgatttttttttatgatatatttttttttttttactaaataaaatgattgttgtttctcttccactcttttgttagaaaaaaaaaaaagaaagaaaaaaaagggggttgggaga

SEQ ID NO: 625704 - DNA, 506 bp, Homo sapiens
tgtgtgaatgggatcattacaaacacactcatgccttccaacagttcccaagcatactcattccagcattacccaaaagtccaagtccaatgtctcatctgagacaagttatgtaccttctgcctatgagcctgtaaaatcaaaagctagtcacttcctagatgcaatggggataccggcatagggtaaatacacccattacaaatgggaaaaattggccaaaacaaagggactgcaggccccatacaagtctaaaatccaatagggcagacattaaacctcagagttccgaaatgatctcctttgactccatgtctcatatccaagacatgctgatgcaagaggtgggttaccacaaacttgggcagctttgcccctgtggctttgcagggtgcagcctccctgctgatagcttacacaagttggtgttgcgtgtttgtggctatatccaggatgcatggtgcaaagccatcagtagatctgtcattcaggggtcaggaggatgg

SEQ ID NO: 625705 - DNA, 139 bp, Homo sapiens
taggaaggactcatcttctaaggtggtacttgattagaaactaattcttagagaagaaaaaagaggcaaatagttcatttaattcttatttaagcagctgagagggccgggggctggtattccaggccgggccgggcgg

SEQ ID NO: 625706 - DNA, 495 bp, Homo sapiens
ggccagcgcgtctattcaggacactttgcgaggccgaggcaggcggatcattgagccaaggagctcaagaccagcctaggagttcgagaccagcatggacaacaaagtgagaccccatctctataaaaaaaaagtaacaaaattagccaggctcggtagcatatgcccgtagtcgcagctactctggaaggaggctgaggcaggaggatgacttgagcccaggaggttgggatgcagtgaactagtattgtgccactgcactccagccagggccacagagcgagactctgtctcaattaaaaaaaaaaaaaaaaaaaaaaaaaaaaaaaaagggggtaaccggaaggaccccccccgggaaaacagggggggaaaggagaccagagagccggggagagagaccacctcagagagacgagacagacccccctgtgattaaaacggggcggggggccccccaagagtctcaacccggcagggctttaaaggctgtgg

SEQ ID NO: 625707 - DNA, 206 bp, Homo sapiens
tattcctgtcccaggctaaggaatctctggcaatttattactgtgcttgcccaagagaacgaggtatgcgagcgagaaaggtggaatcccaaatgttgacggtgctgccaagactgctgtggtctgagtggacaggtgcctcattagcttactatagccatccccctacatcttgagactcctcctccatatttaacatgcgagtc

SEQ ID NO: 625708 - DNA, 683 bp, Homo sapiens
gattgcggagcttgtctgcggtggcggggcgcctctcgtctcccgcggcccaggctcgaccaccgttctccctccctgtcgcagccgagccgcggcagcaagagccccaagccacacgcgggcgggcaaaggaagccggcccgggtctccggaaaaggttgatcccaggcattccaattagaacgtgggagcaattttgcacaggcacgggtcccaaaaagggagcaaggaaattggccggaaccccaattcacaggggttaggaagtacacttaccaaggggactgctgtgcggctgggatttgggccatttcgaggcccacattacatcttgggcacaccaactttgtgggacccaggttggtgaacacacaggtgggtatgggcgtagacgctcagggaatgcggggcctggcagatttgtacgaccaggaaagcggttaattaaaaggtgggataacgcctaaataggcggggtaaccacaagcggggagtgttaaaaagggagaactcgttttaagaggttacagggttaagaagaataaagttgttgcccgtgtgaggttgttttctgggggaagttaagtgcaaggaaaatatagccgcggaagcagtcttatattgtgtgggcgaggttaaagcggaagggcaattttaaaatgtggagggagattatattgggc

SEQ ID NO: 625709 - DNA, 210 bp, Homo sapiens
  misc_feature (7)..(7): n is a, c, g, or t
gcctctngggccagaggaaggaaggggccccctttccaggggaaaaaaaacccatgggcccttccctaatattggaaagggttcaaattccttcccccgcccctttttttaaaaaccaaaaaaaaaaagggaagccgggcatttggggccccaaagggtttccgggttttggggggaggggccccccaggcccaggggttttttttttta

SEQ ID NO: 625710 - DNA, 150 bp, Homo sapiens
gctgctgttatccactcataccactcgaacatgacttactccagtatccttcgagttctggacggcgatcgatacgaaggccccttcaagccccctcacctggacaccaccaatcccacctgtcacaccctccgcagtcacgaggttgtc

SEQ ID NO: 625711 - DNA, 281 bp, Homo sapiens
tttcggacggcacaagctgaccaggcagtaatgtaatactttgcaggtaggtcaggcctataccatatcaaggacagtatgccattccacagccagatttgaccaagctagcaacagttaggcaatgcaaacaggtctcataattcccatgaacgcatggacaacaccggattcagtggtatgggatacctacagtgtttatttctagtaagagttgtagtgcaaagagacgaggccaggtccccaaggttctctagcttgaccatctagtttaaaagcaa

SEQ ID NO: 625712 - DNA, 200 bp, Homo sapiens
ttggcctctgtggtttccttgcagtatttggcattccttggattatagatctcttccttcatcttcacatggcattctccctagggttatgtctttgtgtccaaatttccctttttgggaagaatattaatcatattgaattagatgcccactgtactgttgaatgagttcgtgctgtgtgaatggaatgtgctctgtct

SEQ ID NO: 625713 - DNA, 968 bp, Homo sapiens
gctgcactgaccagacgcccctagggggccaggcgagggcgggtcccaggtgcagcggatgcagaggagagaggcccgggcgcggcgcgggggatggtgctgatcccgggccctgagtggcagtcagacggcggctgattagctccggtttgcatcacccggaccggggtattagctccggtttgcatcacccggatcgggggattagctccggtttgcatcacccggaccgggggcctgggcgcgcacgagactcgcagctggaatgtgggagtgcggctccgagcgcgttcgctgctaggacccgggtcagggctggatgctgtggctgggatcccgatctcgtgcagcagcgccagcgggccggcccacctgctgttgccctggtaaggctctgatgccccggtggtcgcccggtggccactcggaacgacggggcgagatgcgagccatccctctggcttgctcctgccgggttccctgttcaggtaaagaagcggttggagttggtattgacaaattttagcattccgcagcgtcccgtccagcaaaatcgaacgctcgagttgggtctcagtccagactgacaccctggctgttgtccctggaggccgtctactgctccagatcgtgcaactgctgttggcactgctccgtcttggggccgttgtgctctggatgtccgatgaggggggcgggctagcggtgactgctcttgtctacaggagtgagtattcctggcaagtgtccccgtccggaagccttgccgttgtgaagcctagtgcggttggcccgacagcatgtgggcggccctgaggtctgttggaccaggcctagctttcatcgacctggatccagcttgtgaccgccgtctacgggggcggccccaaggcgacggactgcaatagctgcaagaacacggttcgccgaaagtggaacaccgtggagccaacggagagacgccaggg

SEQ ID NO: 625714 - DNA, 275 bp, Homo sapiens
ctgagccctgcggaacctcggcgcccggacccaccccgcccgtacctgcacttatttattgttgttatttcttaccgcggacgccccgcatgtcgggtcctcccgcccgtctcccgcgcagcgctagcattctccagtccctcagtcccttcccgcgtcggtgcgcctgcagcctgacggcgactgcgcctcacttcagaatcactgtgcaccatcgccggatgtaccccgtcgcctgggcaactgcctgggcctccgactgctgtgtgggcgcc

SEQ ID NO: 625715 - DNA, 765 bp, Homo sapiens
taaagaaacgggaatcactctgttgcccaggttggagtgcggggacgattatgggctcactggtagccttgacctcccagggcttaaagaatgtcctccacactttagccacctgagggagtgggagactacggggcttgtaccattggtacccagctaatctttaaagataggggttcactatatttggcccaaattgggtctgggaactcctgagctcatggtaatccggcctgcctcgggttttcccaaagcacggggactatatagggagtgagccagcaacacacaagccagatggattttggattacacggaggggtgtgggggggcggagaaccctgctgtcaggacgcctcggtactcatatcccctcaatgaggggggacctggtacatatccgggatcctgaggaggtaggcaccgggggcttcaaggccctatccggcacctttgggtttaggaattggtccagtctttgggagtcaaaccttttttgggtgttaggtcatcttattcgcgaaatgggaggtctgggctccttgtcggcccaggttggctcggaaagcggggtagatcttccacgatcacttggaaacctttttgcccccggggttcaagggcattttcgtgcgttaaacctcccgagggagcgttggggctcacagggtttcaccgcggcattccaggttttcacgacgagagtgcgtttcacacgttgtgcagggggctcacacctttgactcagtgtttgccccggggcta

SEQ ID NO: 625716 - DNA, 178 bp, Homo sapiens
ttacaacagctcctattcaccctggggcagggcacctggaaggcctggagggccagcagaccaccacctgttttggtaaaaaaaaaaatttattgggaacacagacatacctatgaatttaagtatggtctatggctgctaacatgctacaacagcacagctgagcgcgggtatccgg

SEQ ID NO: 625717 - DNA, 483 bp, Homo sapiens
cagttattatacaatgcatcataccagtcatccaaaggtggaataccatagtcatcctaatatcaaaaaagtatttgacaaaggtcaaccttcattctcaattatttaacaatttcaagttagtaaactaagaatgttattcattgccatttgccctcattctcaattatttaacaatttcgagtaaactaagaatgttattcattgccattaggaggcctaatggatatcatagatctccctagctgagatcaaaacaaataaaaatgtagatgtaaagcaggtatagataaaaatagacatacaatgtagaatagcataaatataaatatctaatgtgcgtatacatgtaagtagtgtggataaaagtgccacctttgcctgtaataccagcactttgggaagccaagggggcaggaggattacttgagtccaggaattcaggaccagcctgggcaacatagtgaggatccccatctctac

SEQ ID NO: 625718 - DNA, 146 bp, Homo sapiens
ctcccacaactaaactgcctgctgaccatctgcctaggcagtggagctgtggatgcttaatggctttcctcagcaccttcctaatgtcttagttcgcactgtcaccattgtactccagcctgggcacgaagagcaaaactccatct

SEQ ID NO: 625719 - DNA, 106 bp, Homo sapiens
tagccacctgaaccccaaggcagcgcgagaagatgacccagatcatgtttgagagcttcaacaccccagacatgtacgttgctatgcaggctgtgtattgagtacg

SEQ ID NO: 625720 - DNA, 617 bp, Homo sapiens
  misc_feature (329)..(329): n is a, c, g, or t
  misc_feature (462)..(463): n is a, c, g, or t
  misc_feature (496)..(496): n is a, c, g, or t
ggtggtgtgcgagagggccagactgttgcgccaggtacgtgcgtcgagactgcccggctgtcccttccccgaatacagtttaatggcgatgagtcgtcccggtctccccggagtttatcgtgcagacggtgtcttacagtgctcgctgaacgagaacctgattctgcaatggatcgacctactgaatggtggcattccctaagtcagccatccgtcatccgtgtggcaaggtccgcaggcagtgtggtgtgtggcctcgtcacatcagatggatgatgatagcctccactccatagcgttggattatccggaggacaccttcgcgtcgnatgtgaagactgaccaaccagctgcttctctggcgtcggtgattgagcgacgaatacgaccgtacggcacagaccgcaacgtaacgtaggtagcgatggcatgcatgtcacgagtcgcgtcagaaccgcttcnngggccgttcgcgggtgggcagggtgctcgtgcnactggcctgccaacctcccgttccgcctgcatgccccgtcaaagccgctgccgatgggagcacaagctggcttctgccgccacttttgctccgtaccagtgtcccacgtttaccttagcca

SEQ ID NO: 625721 - DNA, 169 bp, Homo sapiens
acgcatgctacatactctatataacactgtagagtacacgttcacgtttagcctgcccacttttgtattcaaattcatgaaactgaaggtttattctgatcataatctgtgtacgtgctacatttgataatttattatttacagcttagaatattgatttcttgaatac

SEQ ID NO: 625722 - DNA, 258 bp, Homo sapiens
tgcataatatgcaggtctaacccctataccttctgcattatgaatttactagaaataactttgcaaggagagccaaagctaagacccccgaaaccagacgagctaccttagaacagctaaaagagcacacccgtctatttagcagaatattggtaagatttatacggtgaggcgacgaacctaccgagccttgtgtattgctggttgtcctcgtatagaatcttagttcatctttcatattttgccctttctggttgt

SEQ ID NO: 625723 - DNA, 221 bp, Homo sapiens
cacccaccgccagtgtgtactacagatggcttatagctgtccacggggttggaagacgaggcaaagggaaggtttctaggccagaatgttcctatttagaggggactcaggttacagtctgtgttatgtatgtataccatttattcaatgctactgtgtatataatggaaaacttaagtccagtttgaaacatctagtctttctaggtgtttaaaagtgta

SEQ ID NO: 625724 - DNA, 136 bp, Homo sapiens
ggtcgttctagaggatccctgctgcttctcctcctcggagacactgggatggccagacgtgctttctgcttccttgtgaagggctactttcaacagctatgaggagagtgaaaacagaggctgttggagagagacc

SEQ ID NO: 625725 - DNA, 419 bp, Homo sapiens
gtgtacccttctagtgaaatgtagaggaaggctcaaaggagtcaacatttagatctggaaggtcacaagtcatgccttgggacttaagaataccctgatagagaaaagagaagaggaagggaggccatatactacaacacagcctctcggaattagctagctccttatttgaactttgtcttgcattgtcctgtatttatcacagtttctgtagaacagctaatcaagtatatggggagtatatctatgccatcctccccttactggttctctgcacccacctgtcccactgcagtaccttccgtgctctgtgacttcaagagaagaaggggggaggagacccggattttatgttggtaagttatctctccttagcagaaggacttgatatttacaagttaaggaagaactgaaatgag

SEQ ID NO: 625726 - DNA, 778 bp, Homo sapiens
gaggcattgaggcagccagcgcaagggtctctgctgagggggtagagaggagcttgaggaaacctgcagatgagctgtaattgtctcttatgtaatagatagaggattagtactaactacattaacaaaatatagtcaaattaggttactaagatattgcttagcgttaagtataattagagcgataaatgtatagagtgagctaaagatattctatgagaaaatatgatcgacttgatgaagaggtactcgatgagggaaagggaaatacgatctgaacggtttgctaaagaacatgaacggaacggtcgagattagaacgccttctttcatgcgtggttacacaaaatgttattcaagacagtacaaatattgtaggagcacagagggatctagcaggagtccccgatcattaatatccaattagaaccgtgccatactgctttcaagcacttacaccatagaacggttgacgttaataacctagctgtaaagtatgagtggaaaggtggtaggtgattacaaataatttgaatggtgaatcttttaataatatgagattactcgcgaacggtgtattgaaattaccttgaaatctcatgaccgcaaggggtgattttgccgtgatttaaacgcctagtgaagcgcatttactaaaagagcagatgatccatgtgatgattttaattgggaagtggtaggttggaaacaattggcagaagatagatagtttgaggtgcgactttggatacagaaggtaggggaggggagaaacgat

SEQ ID NO: 625727 - DNA, 259 bp, Homo sapiens
cacgagtaccgactgcctcgagagccaggacagccatgcgcagagtgttgtgaagaaatacactcagcgctaggagccgctgggctcagggccatcccctccatgtacacactgccgagccatggagagcctcacaccatgccgaccaccgtgcccagtgctgcttgcacgcagacggtcagaaggctcacagggtccccgaacagagatcggaagctgcaggacagcaggtgcgccctcatcgtcggtgatcccagac

SEQ ID NO: 625728 - DNA, 150 bp, Homo sapiens
ccaagataaatcaatgttgttttgcatgctattgttaagctccacaggttcactgtgtttctgccgctgtcctcgagttgtaaccactgactggcaaggcttcttggcatcgatgtagaactgttgtcctttccactacagtatctgact

SEQ ID NO: 625729 - DNA, 241 bp, Homo sapiens
tgatgagctgggccgaaatctaattacgggagattctgctaatacatcaccatgacactaatgtgcaagaaacagatccgtcaggcagtggcaaccattactttttaatagaccactccatttccagcaatcacactaacaaaatcaggacagaggccagtctgcttggcggagatgcaaactcaagaacacttgacaaatgctcccctacacacacatatacacacacacacatggtttg

SEQ ID NO: 625730 - DNA, 108 bp, Homo sapiens
tacgaaccgagctttgtacccgagcgtggcaggtcgtcatcgatcgggcggtggaggccgtgggcgacaccggatgtggtcgcaggcggcaaagcgctcggcactgat

SEQ ID NO: 625731 - DNA, 1022 bp, Homo sapiens
ggggaacattggcgaggtcgaggctggtgttaatcggccgaggcggagatctcagcttccccaggagcagactctgagcccgcaagcgcggcgacggccctcggagcgatggcactgaaggactacgcgctagagaaggaaaggttcagaagttcttacaagagttctaccaggatgatgaactcgggaagaagcagttcagttttggaacccagtttggttcgggttgggtccatccgggaaccagggtgggctccttgtatgttggacctgggacgacgtgagccgaaggatgaccccggaaggttggggtggactcaattttgtgagaaatgccaggcgctacgcggaagctcttttggctgatgcccgtacaaggagcttgctgcctcaagtacaagggagagggagagtgggtaaataaaggattgtccttggacgtttacaatttgagcatcggctaaatgatggagcagcggagtcgggaccctggggatggtccgaagcccccagaaccagtaccctgctgaactcatgcgcagatttgagctgtattttcaagggccctagcagcaacaagcctcgtgttgatccgggaagtgcgggctgactcttgtggggaagttggtaactgtgcgtgaatcgtcactcgtgtctctgaagtcaaacccaagatggtggtggccacttacactttgtgaccagtgtggggcagagacctaccagccgatccagtctcccactttcatgcgctctgatcatgttccccagccagggagtgccaacaccaaccggtcagggagggccggctgtatctgcagacacgggggtcccggattcctccacgttccggggattttagatttgccgaccttgtggtcgggccgtggggaaattccgccgtggtataccgggctggttaacgggggagcccctgttgtccccctggggccagcctcggccgtgtgtttttcgcctgccgggggctccggggcgggtgctctcaacaccttgccgcgtct

SEQ ID NO: 625732 - DNA, 391 bp, Homo sapiens
aatagccacatttcagaggacagctctccttacggaaggggagtatatcagtaaatagtacatatggactacttctggcagaatactgtttagaaacatcgaattatcagcctccaggtcaatataaagtagtgggtttgaggaactgaaatgtggcttgtgtaccaagattgtggcgtgtgttaggcttgcctctcacatggctatgatcttgaataattggccggcaatcacgcctttcgtcaggctttatcttacattttaccgtaattgcgatttcttcttttttttcttatttttgttctgcgctcagtggttcttctgcaggtttgtctgatagactcctcgtgtctcagggattgggtgtctcagggatgcggggtccgcgttt

SEQ ID NO: 625733 - DNA, 535 bp, Homo sapiens
  misc_feature (464)..(464): n is a, c, g, or t
  misc_feature (517)..(517): n is a, c, g, or t
tacatcagctcggtaccatgagaccaggctgaggcaggagaatcgcttcaacgggaggcggaggttgcagtgagccaagatcatgccactgcactctagcttgggcaacagagcaagactccgtctcaaaacaaaacaaaacaaaaaaacaaaaacaaaaaacaaaacagaaaccttggaagtagaacacaggatgttaaggcattgtgggtaaaaagccagaatcagggtcataattttgccaagggtgtgtgttggggtaggggtcactacaggcaacaactgagcttccagcagcctgtaccctttccacagtcccctctccaaacccacaggtgaccctccacaccccaaagggtaagggataggtcatcaatgggaactcttcctgaaaaaaagaaacctttgtgctttgggacacagagccatgaggctggtcttgtcgtttcagcagcacatacaancctgagcttgggtctggtgttcccttctcctggagcctgctaagactactcangctgggtcggggatctcc

SEQ ID NO: 625734 - DNA, 207 bp, Homo sapiens
agccaatgggcccccggagtccggatgcccaccatccggggctgtttatgtttgagcccatcttggaagaaaaatgtgagaacgcctgttcagaacatggtggccaagccgggtccatccggtgccagggagccaaacacaatgggaaaggaggcgcagacgcggcggaaggatagggccgggcatggcccgccgagggagaccgct

SEQ ID NO: 625735 - DNA, 502 bp, Homo sapiens
  misc_feature (101)..(101): n is a, c, g, or t
gtttgtttgtttgttgagatggaatctcgccttgtcacccaggctgtctcaaaaaaataaataaaaatgtgcctgggcgcagtggctcatgcctgtaatcncaacactttgggaggccagggcgcgcggatcacctgagatagggagttggagaccagcctgaccaatacggagaaaccccgtctctactaaaaatacaaaattagctaggcatggtggcgcatgcctgtaatcccagctactcgggaggctgaggttgcgctaagctgagatagcgccattgcactccagcctgcgcaacaagagcaaaactccatctcaaataaataaataaataaataaaacaaaaaaatttgctgggcttggtggcgcacgcctgtaatccctgctatttgggaggctgaaacaagagaatcacttgaacccgggaggtggaggttgcagtaaaccaagatcgcaccactgcactctagcttgggcaacaaagtgagaccctgtctca

SEQ ID NO: 625736 - DNA, 169 bp, Homo sapiens
tctctacatctttgcaggcacactcatcacagcgctagctcgcactgattttttacctgaggtagggcctaggaaataaacatgctaggcttttattccaggttctaaccaaaaaaattaaaccctggttccgcagaaggctgccatcaggtatttcctcacgcaggca

SEQ ID NO: 625737 - DNA, 389 bp, Homo sapiens
cagggtttagcatcctccctgaaaagtaagaatttacagaaatgggcagataaaatccccagggagctgtttgattccatgaagtttgccctccccctttttggcaatgctgatggcagtgttgggaaataattgactgatttcacttcccctccgattcaagcaccagtttcagtgggacgggagatttccagtgaaatagtttggttttccctgaagcatttgcatattaaaaaaacccttccccaactatgtgtttttgcctccccctgttttttcccctcttttcaggaaaaaaagttcccaaagggtggagctgacaaaccccaaaccccttatttaacccccactttgtttttccccagaaattaaagaagggtcagccggga

SEQ ID NO: 625738 - DNA, 258 bp, Homo sapiens
gggtcaagccgagagctgattgagaatagtcgcgatgacaccacttgggtcacaaggacagctccaggaacatgatcactcgctgggacactgtctgtacactctctgtttccaaactaagccggattgcgcaggccttacaacaagcggaagtgtatcgagacacagtccacatgctgttggagtggcttactgaagcagagcaaacgcttcgcttacggggagcacttcctgatgacacagaggccctgcagtctc

SEQ ID NO: 625739 - DNA, 851 bp, Homo sapiens
ggccggccccatcccctgatatcaaagcagggccggtgtggggtccaccacgccttccacctgccccagtgctttcttcggttctctctggaaaagtccagtctctcctcggttgcaatggaccccaaatgtcctgcgaccgtggtgtctcctgcaactgcgctggtcctgcaagtggaaagattgcaactgcaacctcttgcaagaagagctgttgctcctgttgccccgtgggttggtacgcaggtgtgccccgggggttgtgttcgcaagggggcgtcagcgatgtgcagtgatgccgatgatgccaggacaacctttactcacccagatgtaaacagaggagaattggtgcaaacccgtggattttatatgatttataattaccccacttggacccattgcgcaaacatcacctattccttggtgaacattctggtgcacttgtaatacgttcaaccaagttgtagcaccgtcaagaagagcaacatctacatgatcgaacaaactcctgtcatggcgaccatgcgccgccggcaaacgatgtttagacaccaaacgaatggggcgcgggcacccaacgtaagaacaaacggcaaactggccaccagctggtgcaccagacgaacagcctggcggagacagcacaaaggtgatggactactcgaccataataaaaacgcgccgtgggcacacccagcggtgttggaaacacaacacacaggggatagctgaggcacaagacgtgcatcaacgacgcggcgatccagcgaagcgataaaaaccccgccagcgggtgcagagacgacacgcagcgccacgagcgaagaagccgccagccgggacagcac

SEQ ID NO: 625740 - DNA, 693 bp, Homo sapiens
  misc_feature (530)..(530): n is a, c, g, or t
ttttttcttctcacttgcccgcgattttattttgcccctcctcccgagcccccctctttaattttcccccctcttctttttgataatgaccccaccacgtgggttcccaccccctcccttttgttttcccccccccggcggggtattttattaaggatgttttatccccccccctggtggaggctctctgttgcccccgccgcttggcccttggccccaaaaagggtggtgtatacacccccaaaggagactctctttgtttttttcttttcgggggagttctccctctcggaggatatggcgcccctcttttcacgcccccgctttttccttatccccctcacacgtgtatatatcccccccctatcacacatgtggcacaccaccgagttctttctctcccgcgcttgagagagacccctggagaactggagtagcttacacttccgggaatacccaccactgtgttccccgcccaaggcccgctggagactccactatgagacccacaaatgtgtcccacacttctncacattatgccacggtgatatatgaaaggttttgtggtagccaaagcatgatttctctgtgacccaaattaagcctgaaaaaaatgtttccccttcccctatttgattcactagtggaagatagtgttctgccttataattataaactgagatgttagagtaa

SEQ ID NO: 625741 - DNA, 197 bp, Homo sapiens
tttctcttcatgtgtctccataccttgcgctgctgtgttcatctcatctccctgtaatttaccccgtgaggtcacccagagcgtacacccttcatgccacccctgctgtcacttacctctattactaggtcctaccgtttgggtgggccgccacgattatcctaattggctgtgccattcgtgtcttctgctgcctc

SEQ ID NO: 625742 - DNA, 506 bp, Homo sapiens
  misc_feature (12)..(13): n is a, c, g, or t
  misc_feature (35)..(35): n is a, c, g, or t
  misc_feature (82)..(82): n is a, c, g, or t
  misc_feature (100)..(100): n is a, c, g, or t
  misc_feature (220)..(220): n is a, c, g, or t
  misc_feature (233)..(233): n is a, c, g, or t
ttcccgaaccgnngtaacccggggaaccataattngcccccggggcaaatttccggggccccaatttttaaccggggggggncctccgcgcggggggggncctttgtccaatagtagcccttgtgctgagactcagattctgcacctgagttcatctctactgagacatctcttcctttctttccccttcttttacttagaatgtctttgtattttcaanttttttcttgggncccttttaagggggggcccttcccatagcaaagcatcatagattgctgatttaaactgtaattgtattgccgtactgtgggcctggaaaaaattttccccccaaaaattcctagattcccagcagagttggttctttctgaggtctgcaaggaagggctctgttccatgcctctctccttggcttgtagaaggcatcttgttcccttaattgaaaacttttccccttttttttttcccaaaaacccaaattttgggatccttttaatggttac

SEQ ID NO: 625743 - DNA, 795 bp, Homo sapiens
ttccgcgcacgtggctgtttcggtgggtcgctcccctcctcgctgtggttccgtgtccaaccgctccatggggtccgcccccccacgtttcgtgcctcgtggggatattcgtaacggggaggtatacctgccgctcgttataatcgtactctgcttagcgtaataatttggttcgcgacgttgctgctgcccgagacatatgggtttcctcccccgccgcttaatcgttcctctttaggggtgtccacgctagccgcgcgcttggtgtgggcgcccgcctctgagctcggtgagctcgcaccaactgtgggattgtggtatatctcgctctgaccgatgttggggtgtcccctcgccccaccgttttgctcagtggaattgctcaagattagcgcggctccgctccaaacacgccttggttttgcgccgcacgctcatgtggagtgcgatttgtcccccccccacctgggatggcgcttctagacccgcgctgcatccgcagctttgtcccccggggcacgtccttgtaggcactcgcgttcaccctcactcttctctctcacgcgctctctcgctcgtgctcgccggcgggtattggatattcactcggcgcacaacatgttcgtaatactcttctggatcacaaacacaccacagattcctagacgcccatttcttctctgaaaatttgattcccctcttcaattatttatagcattaagggcgccgtctttgtcacgcacctacccacccccctctatcaccccctttttcgagacccacatagtcaaaaca

SEQ ID NO: 625744 - DNA, 444 bp, Homo sapiens
  misc_feature (8)..(8): n is a, c, g, or t
gagcctgnaccgggagtggagagagaaagaagacgggttacagaaagggccatactagccatgagtcggggtgtcacaactgaggccctggggaccttttagtcccttatctccaaatctgaccaattgtgagagtcacctgggtagcctgttaaaaactgatgctggtttaatgggtctgaggcctgggcatctgcattttcacaagcttcccagaggattctgataccagccaggttggaaagtgtcaatctagtcctattttttcacattttagtgagggagacaggcccagaggagaagggcagagcatacagacaggaggtaagagaccaaaatcttgagttgaaagactatatggagactagatctgtggttaggttataaagacataaacttcgtcttaattttcataatcaacaccctcctagccttactactaat

SEQ ID NO: 625745 - DNA, 183 bp, Homo sapiens
  misc_feature (62)..(62): n is a, c, g, or t
gatccctataagacgacagaagggactaattcagaagtttaagtctttcatccagcttctanttgtgctttgcctgtgtacatctgcatgcatagccctgtggcggaaaacgacaccctttgctggaatggacaaggactcgtgggagagatacagcccaaaaggcagcaagggaatgggatt

SEQ ID NO: 625746 - DNA, 137 bp, Homo sapiens
tgctgctcacatacattcggctgtgggtggttgtgttgcttccacacattcatgtgtgtcgggccacgtccatgtccagatggtcagtccatcatccatgggtcgggcacgcattcagcttttcagccatatggcag

SEQ ID NO: 625747 - DNA, 215 bp, Homo sapiens
  misc_feature (114)..(114): n is a, c, g, or t
  misc_feature (209)..(209): n is a, c, g, or t
gcaggggtcagttcccacccccacccgtcccaggcccaggccaaaaccagcgcccagctttcctcactgttcctgtggagaatgtttacgcccaggcgagctcctcgacctttnagggaccatttccccgaccactgcccagccctttgctccctccccaaagaaggggggagggtgggctttatattttcattccaaataaaattttnttttta

SEQ ID NO: 625748 - DNA, 419 bp, Homo sapiens
  misc_feature (103)..(103): n is a, c, g, or t
gctggagagctccctggtgtatggtatgtgtcccaaaagaatgggacaggtgacacacggtccagaaatctgctttctgaaaccccagccctggccctcctgncctcagacgtgtgtaaactttattttttcttcttttttctatttttttttttttggggagggagttcggctcttgtggcccaggttagatgtgaatggggcgatctgggctcaccgaaacctcgtgcctcccgaggtcaaacgaatctccggcctaaacctcccgaatagctgggataacgggcatgcgccaccacactgtggcaaatttggaatctccagtggaggcagcggttctccgtgtaggtcaggcgggtctcgaactcccgacctcgggtgatctgccagttgtgcacagccggggaaccggagctcag

SEQ ID NO: 625749 - DNA, 675 bp, Homo sapiens
gaggcccagcccccatggatctagtgatcctgagctcacgtagcaccccctcttaagaccacggtggaaatgtaccatcttgggctcaatgagtgactggcgagatgagaaaagggccctgggctctgctttgttgcccagtgaatgccatgggacatggtgtgcatgtggtggcgatgtgccatggagctggggtgctcccaggagaggtgtgggaagcagccaagggtttcatgtatatgccccagagtgtcaaggcacatcccccacagagcttcctcagggcccagccctgtgctgtgttcagggcctccacccacctgcccatgggcccctccccaggtgtagatggcatagtggcatatgtgccggctacctgtgcatggccacctctggagagctggtgccagtgcgcggggccctgaggctcactgtccatctcgtcccctgatgcagtgccagcctgcagggccaatgcgtcactgcagggagcacacacagtgagtcgggtgtggctgtgcctgtggatggccacatgcacctggacccacccagccaacggattgtgtgcacgctgggagtggcccagaggatactgagatggttgtcagatttggggcaggcagtgagtgggcctccctggtatccctcctccggctccacttggattcagag

SEQ ID NO: 625750 - DNA, 551 bp, Homo sapiens
gtgccagataaaactggccgcagatgtttgtagtagctttattcataactgccaaaactggaagcaaccaagatgtccttcagtaggcaagtggacaaattgtggtacacccagataacagactattattcagtgctaaaaagaaatgagctatcaagccataaaaagacatagagaaaacttaaatgtatcttactaagtgaaagatgtcaatcagaaaaggctacatgctgtatgattcctaccataagacattctggaaaaggtaaaattatggagataataaaagattagtacccgcctgccaggagttagggagaagggagacatgaatagatagagcacagaggatttttagggtggcgaaactcctctgtgtgatactataacagtggatacatgtcatatgtacatttgcccaaaacccataggatgtaaaacaccaagcgtaaaccctaacgaaaattatggacttggggttgtaatgatgcgtcaatgcaggctcatcagttacaacaaatgtatccctctcatggggagactatgcaagg

SEQ ID NO: 625751 - DNA, 651 bp, Homo sapiens
tctgtccagccggcagcaccccaggccggatggacgcttgttcctggttctgtgccccggtgagcgctcaacgccctgcctgatcctgcctgaagatggtgccactggtggctgatgtgtatcatgtggaccccagatgcccaagctcatttgcctgcctgctcagtgcttgtggcactcatgcagtgtctgtgcccccattcatgcttgcacacctgtggtgccaagccatgctggccagtgaaccattatgagtgtgctaggtgcttgtggtagtggtggcatgtgtgctggaatcaccactgggcttgcaccgcattgcaagatggacaagtgtggttgcagatgaaatgttggcaccatttgtatagatgccccagttgcatgcagacaattatctaaccgaagagcacaaatacttgggcacaactgggctggtgtgttgctttggggttgacgcagataacaaaattttgggttacacttacgattacttggcgtatccgtacactctacggagaaccacaaggttgtaggattcttcaccaataccttgggcttggttcagcaacttggtgaattccaccaaagacatcaagaagttaggactcggaagtttgggaaacacccaaagaaacaaaaggaaacttg

SEQ ID NO: 625752 - DNA, 688 bp, Homo sapiens
  misc_feature (22)..(22): n is a, c, g, or t
  misc_feature (130)..(130): n is a, c, g, or t
  misc_feature (153)..(153): n is a, c, g, or t
  misc_feature (170)..(170): n is a, c, g, or t
atggcttctctgtgcatatctnaatgccagcatcacattcttgcactttggggttgttattaagtaaaataagggtgacttgaacacagacactgggataccatgacagttgtcttgataagcaagatgnctacaaagtgtctgagggatggnaagtgtttcaggcatgnagacgctggacaaagggagaattcatgtcctggttgggactgagctgtaccatgtgagattttatcatgctactcagagcagtgcacaatttagaattatgagttgtttacttctggaattttccatttaatatttttgactgtggttgactgtgtgattaactgaaactgcagaaagtgaaaccgtggataaggagggtgggtatactatacttagttctttaaaaaaatgctggccggatgcggtggctcacgcctgtaatcccagcactttgggaggccgaggcgggcggatcatgaggtcagcagatcgagaccatcgtgtctaacatggtgaaaccccgtctctactaaaaatacaaaaaaattagccaggcgtggtggcgggcgcttgtagtcccagctactcgggaggctgaggcaggagaatggcgtgaacccaggaggcggagcttgcagtgagccaagattgtgccactgcactccagcctgggcgacagagcgagactccgtctcaa

SEQ ID NO: 625753 - DNA, 835 bp, Homo sapiens
  misc_feature (525)..(525): n is a, c, g, or t
  misc_feature (559)..(559): n is a, c, g, or t
  misc_feature (561)..(561): n is a, c, g, or t
gtcttgggagatcaatggctgtcaaatgggcatcccggaatcgtgatgccgctgggcgcacggacagtctcccacatgatccaaggacatgtgcccgcgtggccctatcctagagaccccatggaatgaaccgggccgtcgtcgccaagaagtataatatgcgtgtggaagactacgaacctttacctcggcatgatggtcgctggggtatggcgatctaccgcgaagactccctgaccgctcacagcatgagaggagatccatggtagtatctgggaccatgccgggcgctgaaggttcgaactgaggagtgagaccgatgcaactggcacgcgtatgacatgtatcgaacaggaaccgatgtaggaatacatacccccacaacctgtatcttggcatagtcatgtgtatgcagctcttcggtttcctggctttcatgatattcatgtgctgggtgggggacgtgtaccctgtctaccagcctgtgggaccaaagcagtatccttacaataatctgtacctggnacgaggcggtgatccctccaaagaaccagagcgntngttcactatgagatctgaggaggcttcgtgggctttcggtcctctaactaggactccctcattcctacgaacagttttacagcccgtgtaaacttgaagaattcccccccttagattacagagagcgttccagggtggcatggtggacacgcgcagccatcgaccagcaggtgcgcctacctcgacaccagccaattagcacgcacaacagagcaaataggcgcggtgcggcgctcggcgcctcagagagagctcccgccgcgggggggctcgc

SEQ ID NO: 625754 - DNA, 278 bp, Homo sapiens
gtccacttgaggccagaggtccctgaaatccaggagtgtcccataggtcaagaatccctggaatcccaggagcagcgggcacgagccggccttcgggagcgatacctacgcagcctgctggccatggtgggtcatcaggtgaatttcacgttgcacgagggcgtgcgtgtggccagccacttcggagccaccgacctggatgtggccaacttctacgtgtctcagatgcagacccccatatgtgtgcatgcagaggcgctgctccgatgtagagacat

SEQ ID NO: 625755 - DNA, 1552 bp, Homo sapiens
gctcaatgcggggtgcatcttggatgctgtgtgcctgtcagcgaatggtccttaccggaggcccgagactctggtgtgcctcttccgagacttcccatgtgcgtcgaggaacctgacatcatactctgcagtcagttgtgctaacagtggacacggagccttatcctcaagaatggatctggacgctgcccgcgagtactaacctttagtgactgactgcagccatcctggctcccaatgactgcatctcgttccagatgaaactcgatgagacgccggggttgtccaagatggttgtatgcatccatgggatcgtgggttccagggctggctgtactatttggattccttatgaatcttggcgcagtgggaagtaatggcgccgtgagctggcagaggcccatccatgtcatataactgggtccaaacgtgccgtgcccgtttgccattacagattgacttgatcctgaagctcagtgagtccaatgtgcgagatttgacctgcttggtgtccgacagaaagggctcggtcccaccattgataagaggacattgtgggagtcacacatttctcagggcaaagtaaaacggctcttgttactgccagacgttttacgtgcgtcatgtacccaatgctgcattcctcagtactgcttaggttgcgacattcttgacacgccaaaggctgtgtttgcgacaccaggtggcatttgatagggaaaacgccatttctgttgaacacattgttagcagtggaacctttagcattacgcctcacggtgggagacgcaaaaattgggcgcatggtaatctggcccgtacttgttaggacccttgatgtacacttcggtagcagttgaccgaattatcaaagaggtccaccgacttcacgtgggaaaggaaagtcagtagacgcatacaattacagagatacgccaacttgggagatggggcgaccgaaggaccatatacttagcaatcggtcaacccccgacagaagagaagtcgactcggacacgacacacagaggaaagccattggggaagggcccacaagcggattgggacggcacggggaaagtcagtaatgcaaccggagcgggtacgaccacacggcgcacgagaaccacaaaaggtcccatgcgggccccataacaacacaaggggggggcaaggcgaacaaccgacggagaacccagccataaggaaacacacaaacaggcgccataggcaaacacgaacaggaaaggaacccgtcaaggcacaaagagaggcgccccactacacaacaatggaagagcacgacgcggcacgttgcaggagagagaggagtctaacacgcagaaatctcagcagaacaacagcagcaatggaacaacaacacgtggccgatcaccaacacggcccgtagcgaggcagaacagaaggccacaggcgggcaaaagatacgcacgagaggacgaaggcgcaacagacaaccaaaaggaacgaacaaacctagaacagacgaggggacaacaataacgagcgcacagagaaaccacacacagact

SEQ ID NO: 625756 - DNA, 465 bp, Homo sapiens
tctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 625757 - DNA, 405 bp, Homo sapiens
tggagaaagaacaaagctgtagtacacctgttattggattaacctttgactcctgagtggcaatgtggtcacccatggtgtggagctgcagctgtgctgcattcagttactaaagcatgaggcagagagaaggatcgacaacagggttcccgacattgagggacggataaaggaaacaaaccctctggcaaggaactgaaactcatcagaccactacatccaatgagacaccagacccctcatccatcatgattgtttccttacccctctctaattcctgtttttccacgtttcccactccataacctcctcagttttacttggttggggagacggatttgacttcatctcccattttccccaggttcagcacttgattaaagccttcttcctggcaaaaaaaaa

SEQ ID NO: 625758 - DNA, 533 bp, Homo sapiens
  misc_feature (6)..(6): n is a, c, g, or t
  misc_feature (196)..(196): n is a, c, g, or t
  misc_feature (252)..(252): n is a, c, g, or t
  misc_feature (284)..(284): n is a, c, g, or t
  misc_feature (288)..(289): n is a, c, g, or t
  misc_feature (320)..(320): n is a, c, g, or t
  misc_feature (327)..(327): n is a, c, g, or t
  misc_feature (365)..(365): n is a, c, g, or t
  misc_feature (414)..(414): n is a, c, g, or t
  misc_feature (421)..(421): n is a, c, g, or t
  misc_feature (423)..(423): n is a, c, g, or t
  misc_feature (440)..(440): n is a, c, g, or t
  misc_feature (526)..(526): n is a, c, g, or t
tgaatnttacttgtaacttggcctttagggtttaaactgtctttggcttgaagatgggatttcactgggtacctgcccctgttttaggatttctctgcctcctccctctatcatttccccctctgaagaggtacatgtaactgccgttagaacagggatgatgactgatcttagctgcttcctgctgacaggggcnttgttttaggggcaatgacaatcagatttctctcagaggcctatctaagggtcctnagtaaaagggagccattgtctgaggctctggntgcnngactggagtttgttggcctgtaggcaagaanaaacaanttttacaaggctaactatgcatggatcaaatatgggtnttatacaaagaggagttaaagggaacgaatctagtgtcaaagataacanaaatganangtgaaatatactaatcnttctgaaaataatattgtgccccgatgaaagaaattaaatattgtatgggagcaattctttaagagataactgttgagggggtggntttctgg

SEQ ID NO: 625759 - DNA, 1065 bp, Homo sapiens
accacgaccagacacgcctgacacgcagagacacatacatatccatattctacaccctagataggctccctatcccctactcatcgcactaatattacactacacaaccacccataggctcactaaacattctactacatcactactacactgacccaagaactatcaaactcctgagaccaacaacttaatatgactagcttacacaatagattatatagtaaagatacctctttacggactccactatatgactccctaaaagacccatgtcgaagcaccccatcgctggagtcaatagtacttgccgcagaacatcttaaaaactaggcggactatggtataatacgacatcacactcattctcaaccccctgacaaaaaacatagacactaaaccttccttgatactatcacctatgaagaataattaataacaagcatccatctgaccatacgacaaacagaactaaaaatcagatacatagaatactcatacaatcagacaaatagaccctcgaaagaaacacaggacaagcagtcaagaccaaaacaccctgagagactacacccgggcgcaagacatactacaataaacaggccacggagataacacatccctccagtaactaaccaggcatagcaaacaacaaacaacgaacggaacgcgcaggcgatcataatgcacatcgcaaggacatcacaaggaagacccacaaagaagaaaggacgcataaagagaaccagaaaaccggcataaccccaaagtacacaacgagaagaccacgtcaaaaacaagaaagagaacaagaacaacacgagaacagcacaaaacaagaaagcaataaacatcaattataccaaacaatgagtacattaacaccattaaacttaaactataaaaaaaaccagtaaacatcccatacttattccaccaacttacgaaacataaaaacacaaaacaacactcaaaaacataccaaacaaactctattaacagacatatgatcatcacaaacacacaaaaacaacatcactaaaatcattacctatctacatatataag

SEQ ID NO: 625760 - DNA, 753 bp, Homo sapiens
  misc_feature (474)..(474): n is a, c, g, or t
gcatgttataattacagtttcgctatggaattctgtttcggactttgaaatatataaataagtaaaaaattgacattgagagaggttaacaaaacgtgtaattatgatataagcacagaattagagtcatttggttgagcattacaagcagtgtactttaggtattaacttttaataggcaaagttctttttattgaagttgaaatgaggtttagtaatgttgggtctcttattccctttgaatgtttcattttaaaataggcattcactttttttggtataggagaaattcaggaatgggatgacattttaatagaatatcataattatggtttaacaatttcagtcttggttactagcaatttattacagatcattttctgttgactgaagtcaagtaacgtatatgtaacccaaccagctaaacaactagagtgtgtctgaagaatactcccaggggtactttgaatcttnccctatggggggccggaagcgaacagctgtgttcccgggaaacgcttgttgggcctttccacaccacggtggcattattctcttcaaaaataggtcgtccctattaaaaggagggggtagattccacccgtatttgggccctctcgggaagcgcgaggtatctttcttaaacgggacaacaacgcacatacacaacattgttctcggtacagtccttcttctcctcttctgtgcatacctactacaaatatcaactaacaaagaaacacaaaagacaga

SEQ ID NO: 625761 - DNA, 87 bp, Homo sapiens
ctagaagattcagcaaagtacttttgtgctcttggggaacacctccttcgcattactgggggatgtatttacctcgataaactcact

SEQ ID NO: 625762 - DNA, 223 bp, Homo sapiens
gcaccagccaccacattatccagagctgagctcctccagcggatgacgccgtcccaccactccctcttcttcttttcatccttctgtctctttgtctctgagctttcctgtctttcctttcttctgagagattcaaagcctccacgactctgattccccccgtcccttctgaatttaatttgcactaagtccatttgcactggttggggtgggtggagagcgg

SEQ ID NO: 625763 - DNA, 194 bp, Homo sapiens
gagtgtcctctggttctcgaaacacctcaagtttattgaaatgctgatagacgatacatggatagactggggggacttgatagtatttaaatactgttaacgcaaactcaagcatagctactgcataaacgaggtgtatcatcgcctgttgaaccgatccggcaaataggttatcacgacaatgaatctttcca

SEQ ID NO: 625764 - DNA, 322 bp, Homo sapiens
tggaattccctcaacaccaaacaataataacactccagtctgcagtgaggacactagagaatgtctttagggaagcattatgttcacgttctttgaaaatagaactgttgatttttataaacacttcagggaggatgccgagtattgctgaatgaatgtggtcggggggcgcagcaattgttttcgtgacctcgacttgaagactttcctcgacaaccttcgccagtggcggaagctaatgactgggtaatttctagcccacacagccataaaccctgcttaacggagacgaaaatagcctcagctttgactgaatcccaac

SEQ ID NO: 625765 - DNA, 116 bp, Homo sapiens
agcggggaacaatcactttggctggcaacctagcaaaagtgaacaaataggattacatgaagtgaaaaagcttatgtacagcaaaggaaacaatcaacaaagtgatggttcccgcg

SEQ ID NO: 625766 - DNA, 217 bp, Homo sapiens
tgccaccatgccgggttaattttcggtatttttaatagagacaggtttcaccatgatggctaggcgggtctggaactcctgggcctcaagtgatccgtctgtctcagcctcccaaaagtgctgggatacaggagtgagccaccgtgcccggcctggccttgtggcttttagtattgaaaactctaggatgctccatctggtctgtgttacgtctagg

SEQ ID NO: 625767 - DNA, 395 bp, Homo sapiens
agaggatcccgttgccaggctggagtggagtagcacaatctcatgctcacttgcaactccacctcccagtgttcaatgcaattctctttgcctcatgcacccaatgtagcttgggactatagtcacacgccaccacacctggctaaattttttttttgtatttttaagtagaagatggggtttttgccatggcatttcatgccaagtgctgggtctcaaactcctttaccttcagtgttgatccacgccgccttcagtcttcccaaatgtgcttggattacatggtgtgagcctaccaccacccagcgcgaagtagtttttttcttgttaaatcttttcccattgcttgcaattgaaaaccttgcactgagcactggccagtggttacttggtct

SEQ ID NO: 625768 - DNA, 568 bp, Homo sapiens
  misc_feature (555)..(555): n is a, c, g, or t
cccgtggataacggcattagctgcctcttctgatggagtgacaagcggcgagatggaacgtgtgctgcggtccaagtgtgagtatagccctgatgctgatgggctagaaatcgctcagaccacagggttaccagtctgggatgcatttcatgctctgatgaagccaaggctcctgcgcatcgcatgtaccagagttggttggtacacgcaatccaggcgtgaacggtacatcacgacgtgttgtctgagatgcacgatcggagcatcgataactagccactcttgaagcgcgacttgatgatgcgtcgatcataagcttggttgctcgttgaacgggcgggggcatccggtggaatggcttagaacgcggcagatctgcgggaatggaatggctattgattgcaaggtgataactttggcgaaaggaagccctaagcattccggtaccgcttaagacttgggctttgcggttagaccaggggaatttcggattgagcaagaacttgtttaccttcgaaaaagggccctagggtgtgggtcgagggatagttcccntcttctcgttgtg

SEQ ID NO: 625769 - DNA, 515 bp, Homo sapiens
tgatgcaagtgtctaatagctatacttctttatctatttttatttcgtctttttttttctggagagggagtctcagtcggtcgcccaggcgggagtgcagcatgcacgatctcagctcacggcaacctcggcctcgcggggttcaagcaattctccggcgtcaacttcccaagtagcggggattccaagcacccaccatcatgccggcctaattttggtattttgagtagagatagggttccaccaggatgggccaggctggtcttaaactcctgacctcaggtgctctgcccacctgggacctcccaaagtgcggggataacaggtgtaagccagcacaccgggtctccatggaggtctaataatattggcttaatacatcggggtcctcggcggttgggggatatatgtcaagactggtatattggctggatgaatcaatctctttgatcgtgatatacttaccttgtctcctttaactggtttggacggtttaatggtagctatttctccca

SEQ ID NO: 625770 - DNA, 454 bp, Homo sapiens
ctgaatagacatttctccaaagacataaaaataaccaacagatatatgaaaaaatgctcaacatctccaatcagatgaaatctgattgcaattagagaaatgtaaatcaaaactacaatgagatatcatctcatcccagaatgctggcaaggatgtgggaaaaggggaaaccttgtacactgttggtgggaatgtaaattaccacagccactatgaagaacagtatggaaattcctcaaaaaaactaaaaacagaattaccatatgatccagcaatcccgccattggatatacatgcaaaagaaaggaactcagtatatcaaagagatacctgaactctcatgtttattgcagcactattcgccatagccaagatatggaatcaacctaagtgtccaccagtggataaaggaaatattatacacactcatatatatataatttcacaaatacac

SEQ ID NO: 625771 - DNA, 118 bp, Homo sapiens
cctcggctcggcgctcggtccacaccagcgaggagcgttttcccgcgagcggcaggatcgcgaagggcccggcgggcagaaaatgttcttcggcgcggccttcatggtcgcgctcgtg

SEQ ID NO: 625772 - DNA, 339 bp, Homo sapiens
ggggtattgaccgtcttagttaagagcatgttagagattattttctgctaatcttgagaacgggctccctggcccctttcctagaccccgccagctcgccttgcttttccctgccttctcagaaacagagcatacaggcaagcacaagaatgtccacatgcttactgccctgcctttcacccagtcaggtttcttccacctgacagctgctctccagatctcttcaggtttcaatcaggatttatctaaaggcctaattggctcagaacacctaacgcagtatggcaaacaggtttcatgtttttcattaactctgactgattggaagtggctggtgga

SEQ ID NO: 625773 - DNA, 112 bp, Homo sapiens
tggcagtcaggcactgagctcccgaatctcagtcttcactttcagcactgtcagtttatatgggctctgttgtttcttgttgcagcccaagtgtagatgtactcggggcatc

SEQ ID NO: 625774 - DNA, 230 bp, Homo sapiens
ggatgctgtgttgtatccatggtatggatgtaccacagtttgcattacattcacccactagaggacataagagatgtttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactct

SEQ ID NO: 625775 - DNA, 311 bp, Homo sapiens
  misc_feature (14)..(14): n is a, c, g, or t
  misc_feature (73)..(73): n is a, c, g, or t
aatggctgggagcnccaaaggtgagcctcacacttcacactttttccaagcactctccacagttatgattaancagaagggggaggattcccagaacaagtttggagtcagaagtcaaaaatatcaaatggcatttgaaaaatgaacaaatgtcattccttcatattttggaaagacagccatgtggaattagttcaagagtcatacagggctgggcacagtggctcattcctgtaatcccagcactttgggaggccaaggcagatggatcacttgatctcaggaatttgaaactagcctgcccaacatgg

SEQ ID NO: 625776 - DNA, 507 bp, Homo sapiens
aagatttcagacttaattgaggacacatgtctttgatagctttcttgaggtaactctagtcctttaagactatcttgaaaccatcagcaggatttattttaaaaatcctccagttgaggcagccatttaaaattgagtaattattccctggggcccagttctttattaccaaaattatagcatttttagggtttagaactctcttgggctcttaaagccatgttgtttagaaaaattaaaatgtaaaaaatggcctaagatttctaaaccatgtgacctgtggtcagtcctgttcctcttgctatagagcaggggaccattgtaaacaggaaaattctaatccatatgcagctagcaacttcagcctttcacagactaacaactaagaccactatgagccctatagctcctttatttctcgcatgggtgcctcatcacatggaggccagggaagaaggagcctgggaaaaggaacactttgtcttcagatttagaaagcacacttgg

SEQ ID NO: 625777 - DNA, 404 bp, Homo sapiens
gagtgcagtgtctcgatctgggctaactgcaacctctgcctggcaggataatcgcttgaacccgggaggcggaggttgcggcgggccggggtcgtcccacttgcacttctgcctgtgcttgtgttccgctctgtctgcctggcctccttctctttggcgctcctcctgtgtctctttcttttcgcttgttctgcttctttactctcttcgctcttttttctctctgttgtttcctttttcctgcctctctctccctgccatttcccgtctctctttcctatgtccttcttgtgcttgctctcccccttctctctttcttctttttcatttttcgccccttcttcccgttctttctctgttttctttctctgtctgctcttctcttcgtcttccttgtttcccct

SEQ ID NO: 625778 - DNA, 183 bp, Homo sapiens
ggggggggcccaaacccccccccctttttttaaaaaggaaaattttggccccccgggggaagggcccccccccccccccccggggcttttggggggggattaaaaacaccccccccaaggccccggaaaagggggccccaaaaaaaccccccccaaaaaaaagaaaaatttttcccgggggga

SEQ ID NO: 625779 - DNA, 246 bp, Homo sapiens
ggaaaggttgtagttgactccagtgcttcctgcagcctaggtaccatcccgccaatgatgctgcgcaggtgcaggtacaccatgtccttggtgtcagattcataatcgctgatctcttctttttgtcctccctaatcctgggttaaattcttaatccacaatcgatttgtgaagctggctggaaaaaacttattcatgaaggggctgatggtgtgggacagggccaggattcccagcttgctcaga

SEQ ID NO: 625780 - DNA, 406 bp, Homo sapiens
agctatgatcacaccactgtactctagcctgggtgacagaatgagaccttgtcttaaaaaaaaaaaaaaaacaaaaagcaaattttctaccaaaaaacacaaatgcctgctgagaaactcggaagcacttgcccacggggtttccacttcctttcagctccgcttgcagagttgcccagtcttcccacagtgtccccagccttcctctaagagactctcaggcaggaacagcgtccacttggcgggaccctggctcggtcctacgtggtgtatgatgcactataaaagcaaagactggctgggggcctggagaaagacaacccgagtttctaacccaaggcttgatccaccggtcccagggcttggagcagcactcttaaaagagcccgattgtgctaccgggttg

SEQ ID NO: 625781 - DNA, 376 bp, Homo sapiens
gaggatccctggcgggtccttcctggacttcagggatcacctggcctcggtctcccagagagctaggattacaggccaccgcaccaggccagaataaggggttttaggatagtattggcaggcctcagggcaacctcaaattaaaaaaacatacaaggaatacagaaaagtattaaaatcaagaaattaaataatatcaccagagaatatcacctacattagaaggaagacagaaaagaagaaatgaaggaaaggaagaccacaaaacaaccagaaaacaaataaaagggcaggagtaagtccttacttattaatcataacatcaaatgtaaacggactaagctgtctactcaaaagaccaagagcgacggaccgg

SEQ ID NO: 625782 - DNA, 799 bp, Homo sapiens
  misc_feature (632)..(632): n is a, c, g, or t
cgtcattggatatcccgaaatttactgaggggtggggaccagtggggggaagctctgtcacttctggttaccactgttttgaagcttcattgtggctaatccaccctgcagaacctcaaaccacttagagatcaaactccatagatctttggttttcttcatctggttcacatggaacacagctttctcctagtctgtgctttgtttgctcacgtgtttttttcttcctcttgtggttcatctgtggcactccattccgacccttgccttctgtcccctgtacttctgaactgtctccctggggacctccgccctctagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcctgccttctggtttgaacgtcagagccttcttctgatgtgtctgtgactctacaaccgaaataaagacgggcagtcctcctcttcatgccccctcattctcattttctccacttgctgcctttgagctgtagctgtgtgcccttaaccanagcctgaaacctggagaaatacgactactaaaagtagacaatcgagttgttctgccaatagaaataacaatccgaaatatagtgtcctctgaagacgtactacactcatgagctgtcccatccctcggttaaaaacagatgctatcccaggacgactaaaccaaaca

SEQ ID NO: 625783 - DNA, 934 bp, Homo sapiens
  misc_feature (2)..(2): n is a, c, g, or t
  misc_feature (20)..(20): n is a, c, g, or t
  misc_feature (27)..(27): n is a, c, g, or t
  misc_feature (31)..(31): n is a, c, g, or t
  misc_feature (39)..(39): n is a, c, g, or t
  misc_feature (41)..(43): n is a, c, g, or t
  misc_feature (48)..(48): n is a, c, g, or t
  misc_feature (68)..(69): n is a, c, g, or t
  misc_feature (249)..(249): n is a, c, g, or t
  misc_feature (412)..(412): n is a, c, g, or t
  misc_feature (475)..(475): n is a, c, g, or t
  misc_feature (508)..(508): n is a, c, g, or t
  misc_feature (519)..(519): n is a, c, g, or t
  misc_feature (567)..(567): n is a, c, g, or t
  misc_feature (593)..(593): n is a, c, g, or t
  misc_feature (597)..(597): n is a, c, g, or t
  misc_feature (603)..(603): n is a, c, g, or t
  misc_feature (606)..(607): n is a, c, g, or t
  misc_feature (611)..(611): n is a, c, g, or t
  misc_feature (634)..(634): n is a, c, g, or t
  misc_feature (638)..(638): n is a, c, g, or t
  misc_feature (641)..(642): n is a, c, g, or t
  misc_feature (648)..(648): n is a, c, g, or t
  misc_feature (652)..(652): n is a, c, g, or t
  misc_feature (661)..(663): n is a, c, g, or t
  misc_feature (667)..(667): n is a, c, g, or t
  misc_feature (670)..(670): n is a, c, g, or t
  misc_feature (707)..(707): n is a, c, g, or t
gntacatttgacacccagcnaaagaanacanatcagaanannnccagntgtaaatagccatacccagnngtactacaatgagctttttaaaatcttgaatgaattgagtattctagacagcagcataagaaatatacaaacagtatcctatgaatttagtggttttatgtggatatgccaccacaagtggtatgctttagatctgcacatgtgaatttagcataatcactgggaatttgaaattcttgncctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggnatgaacattgttcttgagctgcctcttaggaaacagaagacagtgttgaagttttccctgctnctggttgctgaagatttctagactgcttctggnttgctgaagantttctagaagcactatttacacaaatatgcaaatgtgaaataaccganctataacgtgaaggggcagacatganctgnactacncannatgnaccacagaataagagttggcggnaagncanntcccantcgnagctctttnnnccgnggntattgccttccaaatgccttgtttgtttacaaaattntgtgttccagacagaaaccactgtgttggttttcctggttccctaaaattcatgattggtttcccaaaggtgggagctctgtgctccaaaggtctttgaacttaggaaatttatcggcgggtctggtttaaagtcgggacacctaaaagttaatgggagagagaccctatacggcaacccgcagaagtattcgccaaaatggggcaaggaagagctacagagaaagc

SEQ ID NO: 625784 - DNA, 1116 bp, Homo sapiens
tttctcacagtggctgcgcagtgtttccccactgtctgctgaatgtgaccactgtgagggggttcaaagtgttctgctgtcccatgtactgtggaactgatgcctctttgatctcttcctggggctttttctgtgctttcctgtgaccatctggagcccacatgagatcccttattatgtggaagtggacttgactctgacgactgaatgatcgcattgattgcagggacaggcaatgaaagcacagcacagcggggctccattgttgtgcccggatgggacaccccaaagggtctcccatcagtcccttcagccaaccacccctgagtgcaattcgggccttctgtgcattccaggcttcaagaccccaagtgcatgggaggtggacttacctgtctctccacacgaataacacatctcccggggccttctgtcggacttggcagccctacagctcacctgccgcacttcaccacattatgctagtccatcttcaatgtgcggaactacatgaggcgcgtgcacatgcgcactcatcgtgaccatttatcccccagtgtccccctttcccccttgtgacaccccttttacccaaatgcggtccccttggactcgttccaaggagtcgcacaaggccttgggggttgaacgaacgaacatcacatgtggagacaaggggctaaccagatggaaacccagccctttcacgcggggaagctttctatacgtggccttttacatggtttattccccagaggaactttatggtccaacgcccattggcccccaatcggaaattcccttcttgggcgacagggagagagccccttgtgggacagaaacgctcggacttgcaaaagtgaaacatggttgcacattctcccgcaccacacaagagtccaaggcaaccccaaataacctttgggtgggcctttcacaaatggaacatggggaccaacttttcccacatcaccgggcgggtctctggcctctgaacactcgcgctaacttgggggcccttaactttgggtgaacgcgccacccacaatttccctttattgacaacccataagaatgaacgtggccacaggctcgcactccttttggtcgatcaca

SEQ ID NO: 625785 - DNA, 124 bp, Homo sapiens
ataccttctaggtgaaacacaattaaaatctcgtgtatatcttcatatcccatgtggtgtgtatatatggtgaggggcccacatggggggtttggagtaaaacaggatacacaagatcacaaca

SEQ ID NO: 625786 - DNA, 162 bp, Homo sapiens
gagcggtctgccccccaccatgtttcccctttggtagccataaatttgttttcaacgactgtgagtctgtttctgtttcataaataagttctttgcatcattttttaagattccacaaataaacaatatcacatatttgtctttttctgtctgacttacttc

SEQ ID NO: 625787 - DNA, 715 bp, Homo sapiens
ccagcgtcggaccgggcagccatatgggggatacgccagcaacagacgccgggctgcagagatctgcatccctaggccacgctaagacccgtggggaagagcgcaggagcccgggagaagggctggaagggagtgggtactggacagtgcgcgagaagttcccccctaagaggcagaagcccctcgaccgcagcactcgagctccgctcgggcagagcgcctgacgtgcgcgtgcgctgatgcgggcgacccacctcgcaccagccatgccaggcccgggcaccgacgcggggaagatccctttctgcgacgccaaggagagaaatccgtgccggggctcgaaagctctgaggggcggaggtggcaccggagaggccaggcgcgcgcgggcagctggcggaacatcgtctggaggaatgtcgtcctgatgagcttgctccacgtttgaggggggcccgtgtactaccctggtggtaatcgcccaataggcaagcccattcaactctgctcttggagccgtacattctggccttctctcactgggccggctctggggtggtgacaaggtggtgtccaattcgactatgtggaagccaaagggatcctaagcggtgacaaggctgccttctggaggaatattccatggttgtacgcaagtctccatggctttccaagaactgacatcttcaagtggccagggaacaccgggccacaa

SEQ ID NO: 625788 - DNA, 1753 bp, Homo sapiens
  misc_feature (1)..(1): n is a, c, g, or t
  misc_feature (525)..(525): n is a, c, g, or t
  misc_feature (545)..(545): n is a, c, g, or t
  misc_feature (834)..(834): n is a, c, g, or t
  misc_feature (1050)..(1050): n is a, c, g, or t
  misc_feature (1261)..(1261): n is a, c, g, or t
  misc_feature (1463)..(1463): n is a, c, g, or t
ncgtgtgctgttgtgttgtgttttcgtggttcgtgatgtatcagatttgtaggtgcagcaatacatacccatggggtgctccaacacaccacccgttttgggcgaccattatttgtgtctctcgagagggctcccccacaggggtcgccccataaaacagacgcgtgttgttttaccccccctgccccctcttttcctattttcccgggtccccttatagtggttccggacgccccccttgcggggtggctccaaattttttcggcgtatctgaaggggcgggttttctcccctcgcccaccactatatgtgtccccggtcggatgctcccttctcttgaattgacccgcgtgcctccctggtggtcaaccaagagaagccacaggggaggggtttgtctccgacccagagccgccccctcacagcggcggttgtaggtcaaccacagggggtttttttggcgggagccacacgacgagaggtctcgtcggcgaccccaccgttgtgtttggtggatttcctgcncggtgttctctacacagggnctttttggtgtgatgtgtgttccccaccggcggtggtgttttccccccccccccaccggggagctgtgtttccttcccttctcgctttgcgcatggtgcccccacggccttgtgtggccgcggcccacgacaccacgcgcttgtggtataatttcgcgctttgtagtaggagtaccgctccctgcgtccgctccgctgtgtatatgccctcctctactacccacggcgatgttctcgcgcgcgattgggagtataaacagacgagaggtgcgccccccgcgacgatagngggccatattaggtgcgccacacaacaaccctcggcgggtgttcttctttcggcgcacacgcgcggtatacaacacgcgaggagttgttatatactactacgagagtgtttcctccctactgttctcccgccgcaaaatattgttctatactagacaacatatatcatctcttctctcttgtgggtgtacaactactcaccacgcacacgaccacnacagtagtgtgtgctgatcacaccacagagagacccactctgccgtcttcacacgagtagaggactctgacacacaacacggtgtgttttttcgggggcgagagacacctccacagagtgtcgagagtagagtagtttatgtttcgccgccgcctacagccacccacactcttctgagccacaggtctgctctgctgagagagaatagtgntccacaaagtgttcatcacagcgtgtgataaagacttctgtgtctctctcaccacacactctctcacacagagaatacacaccaccacagagactctcccacactcgtgacaccacagagaggagagagagtgggagatagagaggagatagagagcgtgtcgagtgtgagatacacaccgcgcgtgttagagaagtctgtnaaggagacactaaaagagagatggtgcactacgtgcacaccaccgccacatagtggtgtcgagagagcgcccaagcgccctctccccgagccctctgtaaggaccaccccttatatgattatttgtgtaatatgccgagtttatggagaataaccacacaaggaaccataatgggaacccacatttttttgtgggtttccaagaggagattactcccccttgggttgtgaaattggaccgtttttatccataaaaaaaagattatggcctttttggttgggaggaaaaaa

SEQ ID NO: 625789 - DNA, 961 bp, Homo sapiens
gaggtctgtcccgtgcccaatacccgctggtgtcggtgggacagggcggcgttttgtcccgggcccccccggggtttttgccaggccaggggccgtatttcgtggggccgggtgattgtgtcccctccctcctggtgggcctctgaataggacgccccggtgcgcacgtggccttgtagacagacgcctgttcgtcgcggcggagtttgcttaacctccgagtgggtgcgtcgtaacgagacaggatattgagctgttcccgcgcggtggcgggttgctgcatctcgcccagcgcggcacgctcctgggtgaggccattactgggggtctcccacacgcgtgacgaaaggcgcccgttctccttttctgacgggcccacgcaaatgcggcccccgcattaggttgggcgccccgccgcttgtggaggcggcgtgtcgtccccttgtgtggtgggccctctcattcaccggggggctgcgcgccacgtggcggtgctggtggaccacaacagggtgtgtcgtacacaaggggtggttgtattgtttcctaaggacggccaccgttcagcactgtcgttcttttctccaagccgatgggcgcgcccaatcatgtacacccgactgtgtgctgccttccctgtttcgtggtagaggccctccctactctgggtgtgtatttccactagcgcccactgttgagtgtggcttcgatcgcgcgtgaatttccctctgctgcaggggtggttctgagcctcttgtcagaaatcgttcgaaccctcttggtggatcccactatattggcacgaagaagcggcgtgcgggccatcggccccccctctcctggagttgctgccctcctctctggtttcccgccggtttgtttgatggtccgcccgaaaagttggtagacgagttcctcgcgcgcccctcattattcgagggaaaagggccgcccacaaaca

SEQ ID NO: 625790 - DNA, 330 bp, Homo sapiens
agctgagattatgtacgtgagccacggcacccgccttatagttatctttcataatcgttttttcttatataacctcccctcccatttctctatgggtattaattaagatttttgtctaagttctttttctggaataaccggtatcttccggttggtatattttacttttcttatttggctggctttttcttctgcaggctggtgagtggtccagtgatctttatcacatttatgagtaaatggcggaggtggttatggtaaatgtgtggggttcccctgaagctccccagttgatctcttcttacataggagacgtagtgtaccctggta

SEQ ID NO: 625791 - DNA, 150 bp, Homo sapiens
gcccccttggttatgtgtccatggtcgcgcgaccctttgagtccccttaagtgtgcagctggcgatgatggggaacgcgggcggcctcccggcttggtgattgtttcagtgcatgtctgaatgcattcttgctgctgggcgcagtgtacg

SEQ ID NO: 625792 - DNA, 80 bp, Homo sapiens
gcagactcaggggcaggcacagataactgagtgtgtttgatgggaagcagtagaacatccaggggatggggagagggttg

SEQ ID NO: 625793 - DNA, 827 bp, Homo sapiens
ggcgtgcgactgtcgtcgtgctgcaggagaaagatggtggtctccacaaggagtcatagttcctcgtaatatacgcttgttggccgatgttgaagaaggacaactaggagataggcgagcgggtgactaacggtgtgatgtctgggtgcccttgaaagactgattgagagatttgtgacacttacacggtggcacaggcattgattcattctgggctcacctaagggtgcaaattcatgtaagatctgattatgattggcctgaaagtagcaatgttgtgaagcctaaaattactctcaagaagctcctccgtcagttaagatttggtacacatactttcacttattgaaccgggaattaatttgaatccacatggggagggatggggttgcgatggccccggggaggcataacccaggtgtttagccaaaaaactgggcgagcaattttcattataggcatataaaagtttgtactttcaaagaggctagatgaccgtctaatattggagtggtccagaatgaaacacatatgtaagtcttcccatcaagggcaacaacccgagcaaaggcatagaaattatgtgtcacagaacataatttcaaattacttccaacgcgggggcccttcgtccataacctgtgttcctcttaactcatcaaaggaaacgccttacataacttccatggtttcaactggttgcttttgcactttagatttaattcccgcataatgtgcaacaagttccggaccatgtaaggttacacaagcgaaacttcccagcccttggtaattaacattgaactcgttggacccatttctggtcc

SEQ ID NO: 625794 - DNA, 672 bp, Homo sapiens
aaattggctcggtgtggtggcggatgcctgtaatcccctgagattggaagggaggctgaggcaggagaatcgcttgaacccaggacgtgaaggttacagtgagccaggtcgcagcactgcaatggagtgcaagactgtgtctcaaaaaaaaaaaaaaaaaaaaaaatttacccagggcattggttggtgcaggggcgcaattctttggcctcacgtgcaacctttcgccttcccagctactcgggaggctgaggcaggagaaattggcgttgaccccaggaggcggacgccttggagttgagccgagaatcgtgcctcttgttcccccaggctggagttgcagtggcatgatctcggcacactgaaccggttgcctcccgcatttcaagcgattctttcttgccctcagcgtactcaggaggtctggaggccggggaagaaaatcgaacttgaaagccccggggaaagatcaagcagggtttgtcaggtgaaacccggagaagtgcgttggcccatgtccacgttccctatcaccccggtcggtacgacgacatgggtttgcaacaacaggttggtctaacatgggttgccccaagaaacaaaacgagggtattgtggtttggcaaatgcggcgccccgttatgtgattgaggggcccggtggtatggacgc

SEQ ID NO: 625795 - DNA, 898 bp, Homo sapiens
caacagcatcggtcgggacgcatgcactctggtctcaggccagttgcagccttctcagtgcaatacgccgaccaaaggaaaaatcactaccatgagaattgcaatgatttgctatttgtctcctagggcatcacctggtgccatatcagtataaacaggctggttctgggaagttctgatcgacaataggcgagctatatacaacaagaatacccagatgactgtggcacacatggctgaagcctgtagccatctcagaaggcagaatctcctagtccccgacagaatggtgatgtcctctgaagaaaccagtgaacttaaaagacaagagacccttccatgtaagtccaatgacaaggctcgtgaagcacatggttgatatggatgatttaagaagtgagtgaatagaccactgtggagcagacccggggactccattggaggtcaaatgatactgtaagtgatgtagatgtgccacttgatgattgcctcaaccagttctgagagagggtcgtacaggcatactgatgaatcgagagtaagaagggtcactgatgatcccacggagctgccattgaacgaagtgtttacatccagttggtccccaaaatgtggacatcatgtgatggcgggtgtaaggtggctgatggagctgtggtcaaaattaaagaagttatcatgatgttaacgtcagtacgcatgatgttcaagcagaggtcttacctaaagttgggaaggagacttgaagttttagaaaaaagaacacgtgccatggacttgaggcattggatggaaagggggcggattaaaaagggagggggaaaaggaaaacaaacaaaaacaatataggagcaagaaaggaaagaaacagaaaaagagaacagatcaaagaattagc

SEQ ID NO: 625796 - DNA, 753 bp, Homo sapiens
  misc_feature (55)..(55): n is a, c, g, or t
  misc_feature (81)..(82): n is a, c, g, or t
  misc_feature (100)..(100): n is a, c, g, or t
  misc_feature (146)..(146): n is a, c, g, or t
  misc_feature (149)..(149): n is a, c, g, or t
  misc_feature (155)..(155): n is a, c, g, or t
  misc_feature (228)..(228): n is a, c, g, or t
  misc_feature (295)..(296): n is a, c, g, or t
  misc_feature (337)..(337): n is a, c, g, or t
  misc_feature (394)..(394): n is a, c, g, or t
cggctgctcgcggaggcacttctccgagcgtgacgtgcggactccgctccactgnggcccgccgccgcggtctagccgccnnctcttcgctccctgagcncgccaggcgagggtcagctgccggggcgacgcggcgcggagagggntgngctggnggggctgtgggagcgccggtctctatatggcggcggtctgtcgggcctggctgtcctggctctcgcgctcggncgctgccgctcctatggggtcttctgcaaggggctgactcgcacgctgctcatcttcttctgacctnngcctggctggtgcgtatcaacttcccctacctctacatcgntggcttccatgatgctcaacgtccgcctgcaggttcatattgagatccattgaatgngccctcccagactgacgaaggcgtgacctcatggcccacctgatccaagaacacgaagcatgatgggacagaagagggcccctcggcacctgcctggcacaagtgcagcaggccggaggaggtgactcggacaaactatcatgcaagccttaaagaaaaagaatgccggaggagccctttggactgcagattgcaccctcctggatgacataatgctgtggttgactggaaaattcccaaaagtgaggcatatatcacctggaaattgagaaacaggatccgagcggggcttggcactttggcttcacagtggcggcccaagtgcttccatattgtgagaccaactcacgacagaacga

SEQ ID NO: 625797 - DNA, 116 bp, Homo sapiens
tcgtagcgatggggtttctagcctccgtgaggtgcttgacaagagtgtgcatccgctggatgctgatgacaaaccaagagtaggagtaccatgcaagacactttaagcggtggtcg

SEQ ID NO: 625798 - DNA, 346 bp, Homo sapiens
  misc_feature (159)..(159): n is a, c, g, or t
  misc_feature (282)..(282): n is a, c, g, or t
  misc_feature (298)..(298): n is a, c, g, or t
  misc_feature (333)..(333): n is a, c, g, or t
  misc_feature (344)..(344): n is a, c, g, or t
ctcccgagttcaagggattctcctgcctcagcctcccgagtaactgggattacaggtgcatgccactgagcccggctaatttttgtatttttagtagagatggggtttcaccatcctggacaggctagtctcaaactcctgaccttgagatccaccctnctcggcccccccatttcttgataaattctattaaagatcaaatctcctctaagaactatttatctggggttcacgaattttgatggattttcatcatttaagttctacatacttggtaggttncctttattacttcttngggaacaatgaaatcttcttccctggccaggtaanaaggctaggangg

SEQ ID NO: 625799 - DNA, 327 bp, Homo sapiens
  misc_feature (4)..(4): n is a, c, g, or t
  misc_feature (9)..(9): n is a, c, g, or t
  misc_feature (13)..(13): n is a, c, g, or t
  misc_feature (16)..(16): n is a, c, g, or t
  misc_feature (70)..(70): n is a, c, g, or t
  misc_feature (72)..(72): n is a, c, g, or t
  misc_feature (84)..(84): n is a, c, g, or t
ggantccgntgcngcntcgccctcgctcgccatggagaagaccgagctgatccagaaggccaagctggcnangcagcgagcgcntacgacgacatggccacctgcatgaaagccgtgacggagcagggcccgagctgtccaacgaggagcgcaacctgctgtcggtggcctacaaaaacgtggtagggggccgcaggtccgccatggagggtcatctcgagcattgagcagaagaccgacacctctgacaagaagttgcagctgatcaaggactatcgggagaaagtggagtcggagctgaggtccatctgcaccacggtcctggaa

SEQ ID NO: 625800 - DNA, 575 bp, Homo sapiens
  misc_feature (4)..(4): n is a, c, g, or t
  misc_feature (62)..(62): n is a, c, g, or t
  misc_feature (99)..(99): n is a, c, g, or t
  misc_feature (113)..(113): n is a, c, g, or t
  misc_feature (120)..(120): n is a, c, g, or t
  misc_feature (123)..(123): n is a, c, g, or t
  misc_feature (134)..(134): n is a, c, g, or t
  misc_feature (137)..(137): n is a, c, g, or t
  misc_feature (139)..(139): n is a, c, g, or t
  misc_feature (159)..(159): n is a, c, g, or t
  misc_feature (166)..(167): n is a, c, g, or t
  misc_feature (175)..(175): n is a, c, g, or t
  misc_feature (189)..(192): n is a, c, g, or t
  misc_feature (205)..(205): n is a, c, g, or t
  misc_feature (212)..(212): n is a, c, g, or t
  misc_feature (216)..(216): n is a, c, g, or t
  misc_feature (218)..(220): n is a, c, g, or t
  misc_feature (230)..(231): n is a, c, g, or t
  misc_feature (248)..(248): n is a, c, g, or t
  misc_feature (257)..(257): n is a, c, g, or t
  misc_feature (287)..(289): n is a, c, g, or t
  misc_feature (316)..(316): n is a, c, g, or t
  misc_feature (324)..(324): n is a, c, g, or t
  misc_feature (390)..(390): n is a, c, g, or t
  misc_feature (429)..(429): n is a, c, g, or t
  misc_feature (462)..(462): n is a, c, g, or t
  misc_feature (572)..(572): n is a, c, g, or t
ggcnatgtgcgctaccaagtgtgaagtaaaggctggtctcgtgccacgcctcctgtaggaanggcctgccttgtaatgacacctatcatattcgtgctnaatctgaagtcttntgttttnctnatggtaaaaantantnctgatagaggtttttttctnatggctnnccactgcntcctggctctaaannnnccgcgagcgctcncttctgnttgnannnatattctttnntcttttggacatcaggnttgatggtntcactgccaggtttccaggcagctgggctnnnttccccatgtttgtcagtgaactgganggcgctgnactagtctcaaagtctcatcctactagtagcggccgaacgaggtggggtcatttacagtgatcatncctgaatgatatacctcttatcatcaatgataaaaaggnccctgatacgagatgtccttcatgagcctttangaccccataatctctgagcaagtggtgcgctctcgggtctgataccaaaggaatgttcatgggtcccagtcctccttgtttcttaggtgtattgacccatgctagatganaga

SEQ ID NO: 625801 - DNA, 277 bp, Homo sapiens
atcctcccactcctttcaaaggcacacagaaccttctcagtatttctgtcattatgtaatgcacattgcacatccctaaaaaaacaccacaaacgaatagtgatttagtaccatgcacacactacaataggcggagattaacattctactatcggaagtccacatcgctaacacagtactacatagatatggacgaatacaacctagacagtactgtccagatgtggacaacatagaacgcttagacgtatgaccagtattttatttgatcctgtaa

SEQ ID NO: 625802 - DNA, 480 bp, Homo sapiens
ccctcgtactggcatttgatatacatagtctacactttctacatagtatacatgatgtataatttagcttttcataatacagtgttccatacatcattagttctgttaaacattaagtcactttactttccaaatcccataactttgaaccggttccttttgtacatagtttagcaaggctaatttacattagatgctatttattcagaggtatatgatctgagtattaacagttgctgaagtttggtatttttatgcagcattttctttttgctttgataacactacagaacccttaaggacactgaaaattagtaagtaaagttcagaaacattagctgctcaatcaaatctctacataacactatagtaattaaaacgttaaaaaacagtgttgaaatctgcaccagtatagaccgctcctgtcaggataagactgctttggaacagaaagggaaaaaacagctttgagtttctttg

SEQ ID NO: 625803 - DNA, 157 bp, Homo sapiens
ttgaggctagatgaggaatgaggagcgaaggaaaaggcgccgggagaagaacaaagtcgcagtagccctgatgcctggaacaagaaagaaggagcgcacggagtatctgcagtgggaatcctgagcgtgtggaactcatgaacgcagagctagaaga

SEQ ID NO: 625804 - DNA, 380 bp, Homo sapiens
  misc_feature (135)..(135): n is a, c, g, or t
tttgaaagacaccccaacgccctggggaaggaaggagtagggcagtggtgccttctttcaaaaaaacatcaaccagtagcgctggcgccatctcaggagctggcgggctggccttttggacctggcttctccccncttgtaacgcctggttaccacaaacttgttttgggttcccgccaggcttgaaaaaaatgatttaatttttttcctccctttggttttattttggtggtttaatttgtgttttcttttctcccttttggggggtattcaaaatgggctgggcccctgggcgaaacacaactacctctgttggcatttttttaataccaggaacccagcggctttagcccctgagcggctaaattaaataaagtgga

SEQ ID NO: 625805 - DNA, 557 bp, Homo sapiens
tgactctagcaggatcctcgattgtgaaataggtaggtagaatcaatatggtgaaaatgaccatactgcccaaggtaatttatagattcaatgccatccccatcaagctaccaagtgactttcttcacagaattggaaaaaactactttaaagttcatatggaaccaaaaaagagcccacattgccaagtcaatcctaagccaaaagaacaaagtgggaggcaccacactacctgacttcaaactatactacaaggctacagtaaccaaaagagcatggtactggtaccaaaacagaaatatagaccaatggaacagaacagagccctcagtaataatgccacatatctacaactatctgatctttgacaaacctgacaaaaacaacaatggggaaatgattccctatttaataaatggtgctgggaaaactggctagccatatgtagaaagctgaaactggatcccttccttacaccttatacaaaaattaattcaagatggattaaagacttacatgttagacctacctatttcacaatcggggtaccgagctcg

SEQ ID NO: 625806 - DNA, 943 bp, Homo sapiens
  misc_feature (78)..(78): n is a, c, g, or t
  misc_feature (80)..(80): n is a, c, g, or t
  misc_feature (88)..(88): n is a, c, g, or t
  misc_feature (184)..(184): n is a, c, g, or t
  misc_feature (208)..(208): n is a, c, g, or t
  misc_feature (211)..(211): n is a, c, g, or t
  misc_feature (219)..(220): n is a, c, g, or t
  misc_feature (237)..(237): n is a, c, g, or t
  misc_feature (251)..(252): n is a, c, g, or t
  misc_feature (350)..(350): n is a, c, g, or t
ggcgccgcgggtgagaccctgcgtgtctgctcagcggactctgcccgcccccacctccccctgcgtcgggccgacatnangtgactcngctggtgctgctgggccgtgtcccggcgcacccggactcccgctgctggttcctggcctggaaccccgcggggaccctgctggcctcgtgctggcnggcgacctggagaatccgcatctnggngcacggannggtgacagctggatctngcaagtctgtcctnntctgaaggccaccagcgcaccgtgcggaaggtagcctggtccccctgcggtaattacctggcctctgccagctttgatgctaccacttgcatttggangaagaaccaggatgactttgagtgtgtaaccactctcgagggccatgaaaatgaggtcaagtcagtggcttgggccccatctggcaacctacctgggacagcttgcgaggcgcgagataaggagcgtttgggtctgggaagttgactgagagatggatgaggtatgagctgtagttaagaagtgactagaaggtgagacaagagaagaggatggtcaaggattgtaggtttgagaggcgaagtgtaaggtaggctcttgagaggatgaggtggaggagtagatgagtgaagcaacaagggtgaagtatattgaaaccgagagagggagaagagagataactaactgggaaggtagaggccatgagaaggagaagacagaaaaggggtgacactggaaatgcgaacatggattggggaggagagtggagcgtagggtagacagagggagagagcagagagagaatgagaaagtcgatggtagggagaaggagcggaaggtggtagagagaataggaggtgagaaaactgtagagagaaagcaataggaagaggggagattggggacaaggggaaagtgatgagagagggaatta

SEQ ID NO: 625807 - DNA, 647 bp, Homo sapiens
  misc_feature (41)..(41): n is a, c, g, or t
  misc_feature (62)..(62): n is a, c, g, or t
  misc_feature (64)..(64): n is a, c, g, or t
  misc_feature (79)..(79): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (107)..(108): n is a, c, g, or t
  misc_feature (122)..(123): n is a, c, g, or t
  misc_feature (126)..(126): n is a, c, g, or t
  misc_feature (131)..(133): n is a, c, g, or t
  misc_feature (135)..(135): n is a, c, g, or t
  misc_feature (141)..(141): n is a, c, g, or t
  misc_feature (167)..(167): n is a, c, g, or t
  misc_feature (235)..(235): n is a, c, g, or t
  misc_feature (582)..(582): n is a, c, g, or t
  misc_feature (584)..(585): n is a, c, g, or t
  misc_feature (587)..(587): n is a, c, g, or t
  misc_feature (591)..(591): n is a, c, g, or t
  misc_feature (600)..(600): n is a, c, g, or t
  misc_feature (603)..(603): n is a, c, g, or t
  misc_feature (607)..(608): n is a, c, g, or t
  misc_feature (611)..(611): n is a, c, g, or t
  misc_feature (613)..(613): n is a, c, g, or t
cccctcccgggcaaaatacgcagcgctggggcactggtgcncccggaggattctgccgcacntnccgagggatggacangctgtgctggagaatgtntcagangntnncaaggaacttcctnnctncctgnnnanaccgcngccccccggccacacgctggaagccngctggtttctgctccgtcattgcattcggaaaggcgaccccgaacttcgggcccacgtgattgaaaanttcctattgttgcccttccactccggatgggaccctgaccacggaggcctcttttacttccaggatgctgataacttctgccccacccagctggagtggcccatgaagctctggtggccacacagtgaagccatgattgccttcctcatgggttacagtgacagtggggaccctgtgctttgcgcctcttttaccaagtggctgagtacaccttccgccagtttcgcgatcccgagtacggggaatggtttggctacctgagccgagagggcaaggtgccctctccatcaagggaggtcctttcaaaggctgcttccacgtgccgcggtgcctagccatgtgcgagnanntnctgngcgccctgntgngccnnccngnccccgccccctcccccgccccctcccctgcctgc

SEQ ID NO: 625808 - DNA, 1191 bp, Homo sapiens
tggactggacaggaacagagggttatattggggggtccgtggaaaacacgtggggagagggacgagggggcaaggctcgaggctcacgggggcacccccttagccaaagtgccccctttccccatagggatggggaggaagacagagacagacaaaccaacagagagtggagaagaaagaccaagcggagtgctagcggagaaggagggaaggaaaccccgaggtggtccaccaccttcccactcagaagtgagttccaccgggataaagaaatggcggtggaccggctccacagcgctatacggaggaacaagaagaaggagtgtgtccgcccttattctcactctcttagaggaaagggtggacaggcgcaaagcccatagaaccaggccacatctcgcagtgtgtgagtggcgggtgtgtgtggtgccccattagaattcagtctccattctcatacgtgggccagaggggatttctcagggccagctacatagtctcatagagtgttatgggcggcggggaaacaactcgatagagggctcaggatccaatttccacaagctcggggcagggggggaattcgacgggcagggggccatctacccgggttccctctttacagcacgagggcacgtgaaacagcggggacaagcggagatctccggcatatatccatttccgtggggttccccaggtgacccctggaggggatggacatcgcggagcgcgatctaggaacaatgccgggacattgcttccctcccagattctcccaaatcagggtccgtcaggaatgacgggctcccaggggaagtgcggcagacctccctggtggcgcgtcgcggtgccatcttaacgcaacacagggcccccagaaaggacaaggaactgggtggacgacccaggggcacagtgaagtccccagtctgggggacctaggggacacacaagcataccggacgacccaaaggcacagagatctccccacaaatgggggccccgaggccacataagcaccccgttgttggggcccccacatcgcggccgtgtggtttgcggccccaccatcacagggcacccaaagcaacggaaaatacagagacgggcgcccaacacaaacccgtacgcacaccgggagaggggacgcaaccacgaagagtgagaacaacagcggcagaggtatacctg

SEQ ID NO: 625809 - DNA, 250 bp, Homo sapiens
tacatcagctcggtccacggttaggtacagctacgggtgaggtccagctcatctggtagcgagccttaggcttccctctagaaaggcccatagttcatgagcacagagggtctgatgaagttagtgtactctaatatcagggtatcatctggagattgagtgaaagtgattaccagaagagtgaggaagcctaaataaaaagtatacttttgtttcaggcggcctttaaagacttaagattaaattatat

SEQ ID NO: 625810 - DNA, 504 bp, Homo sapiens
  misc_feature (14)..(14): n is a, c, g, or t
tccattgggagccntgtgatccatccattaggtgactgtgagcatccacttctgtgcttgctaggccccagcatagtctcacaagagacagctatatcacggtccttgcaacaaacgcttgctagtgtatgcaatggtgtcatcgtttggaggctaattatgggatggatccctggatatgccagtttcttgatggtccatccttttgtctcagctccaaactttgtctctgtaacttcttccatgagtgattgtttccaatcctaagaagggacaaagtgtccaaactttggtcttcgttctttttcagtttcatgtgttttgcaaattgtaccttatatctcgctatactaagtttctgggctaatatccacttatctgtgagtacatattatttgagttcttttgtgattgtgttacctcactcaggatgatgccctccaggtccaaccatttgcctaggaatttcataaattcattctttttaatagctgaggtcgacgc

SEQ ID NO: 625811 - DNA, 1226 bp, Homo sapiens
caaaccctgaagacacccctgcccccctccagagagtgaggagggggcctgagactggacctgggatctgcccacggctggaaggggcccatggctccccgatgggtaaacccttgaagacaccccatgaccccccatccatgagagtgaggagggggccatgagactggaccatgggtctgcctgacctcagaggtggctctcaggatgggtgacagagggggccttgatgtctgtaaatagccatgatactaacatttcttcccatctgtgacaacggggcccacacccaggggcaagcaaggagagatccatccccatactcctactacaacaagcaccagaagactagaccaacaaaaccacgggagtgcgggcataagagcaagcgagaagacagaagggaaccaaacatgaggaaaaccgagaacaaaggacacaagacaaccaacacaagaaccacaaacaacaagacaaaactagaggaaaagaaaagtagaaacaagacaaagaacaatagaaaggagaaacagaggacgaaggaaaaggaacaccatgaacacctgaacagcacaaaaacaaaaacaaaaccagaaaacacaaaaaaaaaaaaaagaccacacagagaaatcaaaaccaaagaaaacaaccaagcagaaaaaggaagcgacgaggaaaagacgacataccaacgtagacggtaaaaggaaaaacagaagatatgaaagcagaaagagaagacaggaccaagaaaggacgcacaggagagagagcacacgatagaagaagaagggacagccagaacacaccactacaaaacgaacaccataagacagaaaagcacgacgccactaataaattcagaacgcaatatcaaccaaaaaaacagacaaataactgagagacgatataacatataaatgacacagataaacaacctaaaacaaacaacaagaaaacataccaacatggagaggaaggagcgcaagaggaagaagagaaagacgaaagagagtggtggagcaggggagagagacgaaggcgaggggagaaatggcagagaggcgaggcagggcgcggctgggaagagcggcaagaagagaggagggagacgcggaagtagggagagcgagagcagaggccgggacgagcaggggaaggggaggaggggggcagacaggaaggagagagggcaggaacgggggagggggaggaggggggagcgg

SEQ ID NO: 625812 - DNA, 364 bp, Homo sapiens
gacttatggttctggtagactagaaattccaacagcaagagaccagtatctggtgaggaacttcgtgcagtataattccatgatggagggcagaagggcaagaaagggtgagagcaagaggatgaagcttgctttataacaaagccactctcaggatagctaacccaatctcatttataaggacaacatgacctaatcacctcttcttaggccctaccttccagcactggttgcattgggatttcagtttccaacacatgacctttggggaacacattcaaaccatagcaacagtggtgtcagtgaggttggtagtgttggtggtagaggtgacagtgcaggtggcagtggggttgtggagttg

SEQ ID NO: 625813 - DNA, 532 bp, Homo sapiens
catacgtatagagcacttagatcagtgccaggacatcaagactcgctaggtgagtgtgacatcatcatcagcattcattcttatcacacatctactgatgatgtatatgtgactctgagatgcacatcaggtaggctgcatgacatcgcctcgcatagccacatcagatgacttagcgatgacacgagttagtgtgtgcagagggccatgactactgtcgacagatcgccgagtagaatatacatatcctggctccacggatagcatcgtactttctggcggatcacctcggcaccgcacatcatggatatgtcagagaagcgggctgtatgtagtgcatgtagacagttgtacacatcttaccatctctttctgtgcgcagtatgtagtagttcttactctggtagcgtaccgagtgctccacatagccatgtgcaatctcgcggggcttcggtcagccgtcatctgcgatatccgtgacatccttgcctaagtccactgcattgatctgtcgccactcgtgccgaattcc

SEQ ID NO: 625814 - DNA, 92 bp, Homo sapiens
acgcggtcattcgcggcaatctggagcgtctggcaagcgagccggacctgcacagctttctcgggcatatgctcctcgagacgaccccccag

SEQ ID NO: 625815 - DNA, 198 bp, Homo sapiens
catacacgatccccccaccaaaagggcatcttattcacagtcgctttctttcgatttagaaaagccccagagcactttacaggttcatgtacctttatcggatctaaagtacactgacttactgcacttacttcatttcctattctacttttattgtaatatctgtaatcattctagctaacttccttcaacgagact

SEQ ID NO: 625816 - DNA, 1279 bp, Homo sapiens
tgggcaaaaaaaaccttttaataatgaggggaaaagggcaaaaaggtgcaacccaggcaggcaggtttgagggcaggaaattgccgcctttcatagggttctccaaaaaacctgctgctcaaccggagaacgttgggccgggaagggcccaaggcctgcagcacattctacacaaggggctcagcaaaacttccaggcggttccacacctcgttgcaaacaacaaaggtgtgtctcagtgggcctcatcaaagcgtgggggttcgtgccccgtggtgtgttataggttccagtatcttttcccgtgcatttgccgcaggttaacacaggttcgtgtcgtgcgtgtgccgccagttggcgggccactctgggggtgcctcctcgagatgtggccctccttgtgtgctcatgtgggcctatacagagattcttccttataagctctcaatcagtgtgggccattttctccctctgtagaggggctcaactcacaaggcagaatcttagctagtggggtttgattaaatggcgccccacaaacaacaggacaaagattctcgcggcgcggacgaggagctcacaagggggatcactgtgtggcagactcccattaacgaagaggtagggagcaagaaataccgaagctctccccgataacaagcggggtttcttataatacctttcaacaggtggctccgtgatgtttttcccacaaatgtgtctcgccgcggagaaagaaattggccatattccctctggaaaacattcagtagagcgcgccagaaaaagtgggcacagcctaacaggaaaatgctccccgcgacaacccgcgaaaggtggtggccccacaccaggtgtgggcctccaacgtggggcctcccgagatctgtggcaacagacgggcacacacgctggcgctctacaagaacaaatatctcactcgcggggggacacacacctttgtggttatcgtgtgccaccacacaccggagcagcatctccaccacgaggtggttagtacaaccagtggaccccccgcggcagcgaggaaccaaacacatctgtgttggggggtaagaaccccccctcgctcgaagaagcacccaagacgacggggaggtgccccccgtggggcacacaagactaccgcgggcgcccctacatataggccagcgagctgtggaggaaaccacccgggggagggggcccacactatagaaagggcgaacaactcaccccactgaaacgagcactcgtgtgtgtgtggctcaaaacaatgc

SEQ ID NO: 625817 - DNA, 365 bp, Homo sapiens
cagcacactgcagcattgagaatgcatacggtctctatggctgatatcacatgcaatgatacaagattaagtattttccggctgggcgcgggggctcacacctgtaatcctagcactttgggattacaggcaggcggatcatgaggtcaggagttcaggaccagcctggccaacatggagaaaccctgtctctactaaaaatacaaaattagccaggcatgctggcgcatgcctgtaatcccagctactcgggaggctgaagcagcagagtcacttgaacccgggaggcggaggttgcagtgacccgagatcgtgccattgcactctagcctgggcaacaagagcgaaacttcgtctcaaaaaaa

SEQ ID NO: 625818 - DNA, 369 bp, Homo sapiens
atgggccccccccccctggggcccggccaggaggggccctgcccatgccccccctacaggccaggggttggggggtggggcaattccagccccctttcccggggcccggggccttggggtcctgccctccccccccgggttggttcctcccgggggcccccctgtggaaataaaaaagggatggaattggggaaaaggaggagcaggaggccctcttcctttttttgcccggggggtggggccccccccctttggagggccgggggcagggggggggaacccccgggggggggtttttttaaactgggtttttttttattttttttttattttccgtttttccctaaaggggcccattcccccttttga

SEQ ID NO: 625819 - DNA, 1094 bp, Homo sapiens
gacgtagtctcacgaggtgcggaacttagggtgttcgtcttgagaaggtggtcaggtgaagaaccatgttatcaagcatttgtatctctagatggcttgcttcgcagaaagtcgtagttgtgttcagtgctagcctagtatcgtctgcagtaccatttcacatgacacgtgttgagcctcagtgtccacttgagtccagcggaggcgcaagtacagcctctgggcgtgtgacgtggcaggtgcattcagatgtacagcgcatacacttcgacgcacatgatattcctctacagccaactagtggtcgtcggctaagtagctgaagtggcttgacgccgacggcacttgtaggatgcccaggacgagttgacgaggcggtaagcccagggggataatacaggcccggaccccaatagcgacgcatttgtacaagaccttctgcgccgaaacgcaacacacgaggatggtagaaacgtgcactagtagccccggaagtacttacctcgctttgtgcgacccacctagggtagaggaccccctacgttgccggagcccaccgcaagtcgaggaaacgggcactcgtgtaaggacacgcccgtcttgcgcgggccgaataagtagtgacgcaagcaagttgccgcggcgcgacggggcataattagggagagatgccaagtcaggttgccaaccaacccccttaccaacctattcgactgcattccctagccaatcaaaagaacgcaacgctacgcgaacagaaaagctgcataaaggccgtgctgacgagcaacccagctacacgggataaggggtatccccgcgcccgggaatgtccaattggcgataggaaacacaccaaaaaggtggaaccatttttctgcgataccaaccacccatagtggtgaaattagatactggtcccacatatgcgtcctcagagagtacacaaacagtggttatgcggttcccccttattgtcccaatagcatagcgtattgccaccagcaattatggggcgaccacatatcaactaggatacattatataccgaaagacacaactaagagcgcggtatacctaaatatatccccatg

SEQ ID NO: 625820 - DNA, 111 bp, Homo sapiens
agaatacgaaatcatgactcgtcgtgtgttgctagtctgccagccgaacgtaaagaaggatggatcgtacgacagtctgttgtgcgtgctattgaaacttctaaaactagg

SEQ ID NO: 625821 - DNA, 111 bp, Homo sapiens
gctctctagaggatccttccccttctcccacattattcctaacctggctggcagggtggagcgatgtgatctaagggtcctgtgagaagggtggagtggaagaggcaggtc

SEQ ID NO: 625822 - DNA, 718 bp, Homo sapiens
gaaagcaggcgacctcttcctgatgagaagaagataactagctgggtaccacatgcctgattgccacagctgttatcacgctatttaatgaacctatagctgaagacagcataaagggtgcattgacagctgcacacaaaaaagcccacacatttttgtgcctatgaaaatacatctaggatgtgtctgtcctcactgggacacagagctcccgtctctcacgcagcgaagttcgatccatcatcctctatgaaatcatgcaccgttggaagctggcccaggtacacgtacacatagactctatagaagctgtcactaagatagcatctgagcacacagctgtccgggaacaggcataggaggcgtgcatagctgcagcagaacaggccatctccgtccgacagcaggacaggctagagaatgctgcacagtatagagagcgagcaacatgcgacccatggacacagatcagatacacgagaggaaacgacctcagaatgtccaagaagccaaaggacccacagccaccagataaagagtttacgccttacgactacagccagagagacttcatggctgttgcttaaacagcagatacaaagttgcttctcagattgatccacatatacagaccccgtctgtcgtgcgttgcagccgacacaggctctggtactactgggcacgagatagtactggagacacgtgtcgctgctgacag

SEQ ID NO: 625823 - DNA, 298 bp, Homo sapiens
tcgggggcgtccctgatttttttgggggcccccccggccggggcccctgcccctaaaaaagggggtgggccctttgggggggaaaccgggttttggcctaacggcccagaccccgggggggcaggggaaccttgtttttggagtcgggaaattgtttgacacccggccgggggcttttgttggccggaatctcctcccctttattgatctaaaggggggggcctggggcccgggcccggccccccttgtttgggtacccttgggggacaccccctgggggggtcaggccccggttttc

SEQ ID NO: 625824 - DNA, 781 bp, Homo sapiens
ggaacaaatctctgaactcttcagcaaacagtggtgacataaagaaaatcattatgggtctggatacaatgaagaaaacagcatgtggattctagtctagtaggaatattaactcacgcgcagcatcgcgcgaacaacgccactagcggtcacatacaatagggacgcgtactaggcatgacccgaatcatatcgctacagactgcggacgctcggctttcaacggacgggcaggcacaaataccggcccgttgcctccgaaccctgcggtcgccccacgctcacgggagactgacgctactcggccccgcgacctaccgaatgcctgcggaagaagtgacgcgcatactggccaacacacctgggccacctagcaccaccacgatagacggtggcgctcgcacccagacatcatgctacaagtcggaccaccagcccacgtcaccgtctcggcgactcctgcgtgccgcacccctcatcgcctcggcacagtagagctactaacaagccctaagacacgtctctggccaacaccgcaggccaccacacaccaccaaacgacccaccaggcactaacggtcaattctcactggactccctactacacaccctagccagcgcgcctgcgcccacacgccccatcatctctagccccaacacacgctcccacactcctcacctatgcgcgacaccagcatacaaaccatctccaacctgacagcgtcaagcttgcacccgccactgcaccacactagccttagcgcagccacgtgacagcaca

SEQ ID NO: 625825 - DNA, 465 bp, Homo sapiens
tacttttcacagggtgtaagctccttcttcttcctgcacccctgccgctaggcctctgtctcagcaaaatgggtgagcagaagagtggaaagaccagctttggagctccatagctctgccgcttaacggcaccttttggacaacacgcttaaccactctgaacctcacgttctcacctgtagtatggggataaggactccagtacttttggggtgttgcaaatattaaaataagaatgcagaatgcaacactaaacacctagcaaaggtttggcccttagtgattgagcaggaaaattgtagctgttatttccattcacaattgcactgcaccttacactgtccaagaagccgttgagaaatttgacaaggtctgctctgatcgtgaggagctgatcctgaacagctaccttgctgcattgttttagtttcatcagtagtagtgaaatcagagcagcagagagaa

SEQ ID NO: 625826 - DNA, 155 bp, Homo sapiens
ttttcccccccccctttctcttttttcccccgggccccccaaaaagtttttttttggggccccccccaaaaaaaattgccccccctttgggagggggggagggtttaaaaaaatgggaaaaaaaaaaaaaaaaccccctttgtttttccccccca

SEQ ID NO: 625827 - DNA, 523 bp, Homo sapiens
tgggtcctgcctcaggaaagaacagaaaaatgagagttgatattaaaaaaattttctcctgtgatatatttgagagatctatagcatgaataaataaaaacttatatttttacttaagaaaaatattcatcaaattgataaatatggtaaatttccatttcagatcttaaaaaatctgatttttaagaataatgagaacttgcttattttattcataagggtagttgaatctgtagttctttcaagatggaataatttctaaaatactctattcagaactataaatgaaaactagtcagtggggacagttttaaaattcaccagataaaggcatgtttaaaccagtagtccccccttatctgtggtttcactttccctggtttcagttacccaagatcagccatagtctaaaaatattaaatggaaaattccagaaataaacaattcatcagttttaaattgtgctgcttttctgagtagcatggtgaaatcttgctctgtcctccccagggcataaattatc

SEQ ID NO: 625828 - DNA, 157 bp, Homo sapiens
cgatcagaggatcccaaacctaatacgcctcatggtactagtcgggttagttaccaagtgaaccataatggaaactcccaaattcaattttatggattaatccgtcacactaggctgagtttcccatgaactcccattgaaaattcacctctccctc

SEQ ID NO: 625829 - DNA, 131 bp, Homo sapiens
  misc_feature (35)..(35): n is a, c, g, or t
  misc_feature (48)..(48): n is a, c, g, or t
  misc_feature (90)..(90): n is a, c, g, or t
ggtcgacgagttcaccctctaaatcaccacagatncagcacacagggnactaagcatcaagcacgcagcaatgcagctcaaaacgcttangcctgagccacaccacccgacggggagaacagcagtagatt

SEQ ID NO: 625830 - DNA, 267 bp, Homo sapiens
ccgcccaagccatcaagtcacttcctgctcacttttcctcaggttctgtgtgggagggcagtagccgtagccaagctacagcccataatctatcctcgggggcaccctcgaaaactcaatggcagagtccttggacagcagagcttactgcccactaggccagccagagagctggcatttcgcagacttgtactttccaaacttttcctgtgcctggcggagaagattccagatggcatgctccttgccattcacacttcgcgccac

SEQ ID NO: 625831 - DNA, 496 bp, Homo sapiens
  misc_feature (433)..(433): n is a, c, g, or t
cagtgacgtacaggtttctcttaccgtgatagatggtgctatcgcttcctgcggatgccgggctgaacggatcctcccggatggactgaacgcgcacaggcacgtctcacacccgacctgagcctgccagcctccacgacctgggctagcctgagagcacggggcccggcggccgggtccgccaccaccagtgtctctgatgcctgcagcctccccagccccgcttcctctgcagcccggcgcttgggtgggcctgaggacccagggggagtgtgcggcgtatgaagggctgtgccataggctcgcagcctctgtggctgttcccagccctgtttgatctctccatcggggacagttccctgcggggaagtcctttgtctgagttctccaggggcagctgctgggcccagcctccccaggggcctcagagccncaggtgcctggggcaggcctgtggtgggcagctggaggcagcagcagtctgtttgcttgtttt

SEQ ID NO: 625832 - DNA, 201 bp, Homo sapiens
  misc_feature (32)..(32): n is a, c, g, or t
  misc_feature (75)..(75): n is a, c, g, or t
  misc_feature (139)..(139): n is a, c, g, or t
tcagtctggggcgagatcgggtagaaatcttnatcttaagtcacgtaagatacaagttcaggcaggtctgaaggnctggatggcaaacatcagacctgtcttccaaggagacaagtcctggctacatcccagcctgtgnttacagtgcagacaggccatgtgagcccacggtgccagcacagagcgtccttcccaccactg

SEQ ID NO: 625833 - DNA, 120 bp, Homo sapiens
  misc_feature (51)..(51): n is a, c, g, or t
gtcggtcatccgcagcgcagtctgctacaaagtgccactaggcactcgcancacgcctgtcagcaggagcggctctgccattaagttgagatggtgagacgaagtgctaggggcggtacg

SEQ ID NO: 625834 - DNA, 157 bp, Homo sapiens
aggtctgctgatggtatacctctgcgtgggctctggcccagatcagccgccgtaaagttgcgccggtacgtgtggtccgtggcgatgatgctcagacgcaggcatccagagtggtcgggatgctagatgcgccaccgagcaagactttgacgcccag

SEQ ID NO: 625835 - DNA, 394 bp, Homo sapiens
  misc_feature (59)..(60): n is a, c, g, or t
caggagccggcccgggggccccccccggagattgcccccaatgccccctttctttattnngaagccttttaacgggggccggggcaaagggacccagggggaaaaaaaatcccctttttgggggtccaaggggttttccccccccgggggggccccccaagggttgtttagttcttttccaaaaaggaaacccctgggtccttcccccaaaaaaaaggggggcccccccccgggccccccgggggggaacccccggtccccttttttttttctccggcccaggggggggggggggccgggggggaaaaaaggttgacccccccccccccccccttttttttttttaacccgggggggttggttgaaaaaaaccctccggttggcccccctttga

SEQ ID NO: 625836 - DNA, 442 bp, Homo sapiens
  misc_feature (25)..(25): n is a, c, g, or t
  misc_feature (30)..(30): n is a, c, g, or t
cgaagggaagctctgaagcaccctnaaaanacctggccattattaagctgagcaaagacaagcagtgttttaagcaagaaatcacttaaaccttattttgaacgctgacctatattatcaagaaccacattattattattattttttgtgacaggtttcgttttcattctgtcgccccaggctgcagtgcagtggtgtgatcatggctcactgcagccttgatctcccagggctcaatcagccctcccacattagcctcatgagtagctgggactacaggctcacaccaccatgcccagctaattctttgttgttgttttttcttatagagatgaggtttcaccatgttgcccaggctggtctcaaactcctaggctcaagcgatctgcctgcctcggccttccggggtgctgggattgcagcatgagccaccatgcctggc

SEQ ID NO: 625837 - DNA, 556 bp, Homo sapiens
  misc_feature (44)..(44): n is a, c, g, or t
ggtcgatctagaggattccccggtgggagacggggttcacacgntgggccggggctgggtctggaactccgggacctcgggtgatccgcccacctcggcctcccaaagggctgggtattacagggcgtgagccaccaggccgggccattagtagggtgttaaaaaataggttctcttggtaaaaattagtttggaactttatttttactttttttcttggcattctcacccagtctattttgggtcttatttggaagtttcgcacaccagtcaagatgtatatatatgtgggccaggggatatactttcggacttggttattcggtcaggtggacactctctcagggggaatcggcatgggtctgttttcacacggctgataaagacataccggagattagaaagaaaaaagggtttaatgggacttacagttccacatggctagggaggcctcagaatcagggcgggaggcaaagggcacttcttacagggcagcagcaagagaaatggaggaagaagcaaaagcagaaaccctggataaacccatcagatctcc

SEQ ID NO: 625838 - DNA, 112 bp, Homo sapiens
tgcatggacaatcacgaattctcgtggcaggctggcagagcatcctgaagaacccgaagttcgagcagccggggcagaccatcaaggtcgccgccaaccaggtctggttcga

SEQ ID NO: 625839 - DNA, 228 bp, Homo sapiens
cccgcttatactacaggtgcatgccaccacacctggctatttatttttaattttggtagagacaggctctcactatgtttcctaggctagtctggaacacctggcctcaagtgatcctcctgcctcggcctcctaaagggctggattataggcaggaccactgcgcccagcccaagaggtgagttttcaagagctgagaaggcggagccaggccctttcctagcggtg

SEQ ID NO: 625840 - DNA, 259 bp, Homo sapiens
ttcggtcaataagtataggtcatacaaattgaaaccgtggcgcctaatatgttccgcaaggtgacagatcagatattatgacctcagcatttatagcgaggactaaccccttattccttctgcattatgaattaactagaatataactttgcaaggagagccatatcttagacccctcgttaatcagacaagctaccttagaagcagcttatatagctcgcccgtctatttagcataattgtgggaagatttattggtc

SEQ ID NO: 625841 - DNA, 215 bp, Homo sapiens
ctaaaactaatcgtcccaacaattatatactaccacggagcatgactttccaaaaaacacataagttgaatcaacacaaccacccacagactaatgattagcatcatccctctactatttttgaagccaaatcgacaacaacctatttagctgttccccaagcttgtcctccgaccccctaacaagccccctcctaatactaactacctgactcc

SEQ ID NO: 625842 - DNA, 2205 bp, Homo sapiens
  misc_feature (1039)..(1041): n is a, c, g, or t
  misc_feature (1046)..(1047): n is a, c, g, or t
  misc_feature (1049)..(1049): n is a, c, g, or t
  misc_feature (1057)..(1057): n is a, c, g, or t
gtgtctttgtggtgcatctggttctgtttccctacggttacgttctccgtgtgtgtatgtcgctgctgcactgtgtgcccctggtctgtcacgccatggatacgtttgggactccgtctcgttcgagtcttctttggtcccgtgttcattcttcccttgtgtacgtcgttgactacgttcaatgctctttttgttcccttgccctatggtctaggttccatttcatggcttgggactctggtagatcctggaactgcgcaactgctttttatgtcgtcagtgcctgatccccctatgatttgaatggtatacgccccctccccgatagtctggctatcactagatagttgtaatataatttatacgtcgctctaaaggaagtgaaattgtatccgactgaatgcttgatggctctcgttggtctttaaacgcttatcttagttaacggatcacagaagcagtcatttccatcgtgtacgttgcgggttaacgcacgtctatcgtgtactcgcctttcagttgtgcgactgctcctagtatctttgtttgtggtttaacgacgcactgtaaggaatctgcacgccattcctgggtcgtcccagcctcgatcacggagcgatcttgatggttgtctgggaccaccctgatgccggctctctcatggctcgtgtgactgactgggaagcccatcctgaccagtctgctctcgaggacccatggaaaggcaggtattgaaacatgtctcaggtaaacgtggaccaagaagcagtggcctttattgcatcgccagaaccagcgcctcattgaccaggctgcctcccttgtggcagcaatcggcatcagctgaattctactcacagtgcgttttaagtgaatatggtcgagaaagacggcaccaggaagccgtcctggcgcctggcagtccgtgggacgggatggttctggctgtttgagattctcacaaggagcgagtcatatcgtggacacagcacagactatttcttagattcttcttttgccttttgcaaccaggacagcnnntgcannanctctgtgngagggtaggagggtgggaaggaaacaaccatgtcatttcagaagttagttagtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggcggggtaatccctgctttttgtgtaaacccgtaccgtcagtacgtacgtacaccggggggttttcttgccttggtctgtctggcaaggacttcgtacattctcgggaggtcttcatgagaaacttaaatgtcattatctgggcttatatctggcctctgctttctcctttcaattgtaaagtaaaagctataaaagcagtattctctcttggtaaaacaccccccacaacaacaacacaccaccaaaccactttgacaccctcccccctctccatccactttttcttcacccaccttccacccacggcccacccgcccccatgctcacatgcaccacggcgcccaaacgcggggggtgcctaaagcgaaacacccgggcgctcaacagcaacactagcgcacgagaactccctaccagagaataaaaaaagaggcgccgcgcgcgacacacagccggagcctgcttgcgaccacaccacacccaaacagtcggagaatcccacggagagcagcactactacaggggagacccaccaccactaagcgaggacgctcaccacaaggacaagagctacacatattcgacagtaaacgccccccagcagacgcgggaggcacccagcaacgcaccaccggacgatcgctaacggacgacaacgaactgcgcgaccaggccagccacgcgctagacgagacaaacacaacacagtcaacatcccaagcggccagcaacgccactagcaccaccggacagccaccacgcgaaccacaccatcgtacggaccaacaaccacgccgggaccgacgcaacgtagcacaaccgtactcagccacaccacgcac

SEQ ID NO: 625843 - DNA, 940 bp, Homo sapiens
  misc_feature (541)..(541): n is a, c, g, or t
  misc_feature (940)..(940): n is a, c, g, or t
gactctagaccctctctgtgttctctacacagtgaccagatctgctgtctagagatgatcgtcccctgtagaatgtactcctgctcaatgggagtatactcgcgtccctcatcggtaccaagaagcatacaacagcatgtctgagacctaccgtttatctgtaaagtgcgatgctagaaatacgtatcgctagcatactgcacagtatgaaaagcctccattgggcttgagacattcgcatgtgcaccttaaccatcacttgctcttcataatgccctactgttcattaccagaatccacatatgcgagacgcatattgattcaatatgctatgcgataactctcgattgcaagcagatatttggccactagttggagatagactgaagtcgagatccaaggtgaataggtcaacgggctgttagggcatccctcacccaaaggggaatgactcataccatctaccttcttcttggacatcaatacagctgtgtcatcacttagcacagtcatgaaagatttctggtccaccttcgcgggnttcatataggtagcatcaaaatggaactgtacgttagcctcccatcatgctcatgatggctagtgatattagccggcagccggactcggtaaagatcaatccgagggcttgaccagaacccgctgtgttacttaaaccaaataatctgacccaggtattctgggagagtacgctgatgggcagggctgaccgacttcgagccaactcactcactgtctcagtccgggcatatagatattcatttgactcctgaaacaaccggcatcatcaacctgcaatcctgcaccatgttttccgggcccacaaaatgcgaccacactttttggcacacggcaacgaaacaccgacggccaaagactcgcccggcgactctcaaaagcgacccttaacaagcattcn

SEQ ID NO: 625844 - DNA, 315 bp, Homo sapiens
cgggcggatctagaagatcccctgtgcacgtggcggaagtgatttacacgcaggcatcccggagaggcagcgcggcgtgaggccctggcgcgagactgagtctctgtgagcagaacgtcgtctggatacctgcaggctgtggaggctcccatctattaaaatgctctgatgccttacatttatttcatcaccggcacccacagacacacagcacccactgagcctcatgaggaaacacggtgaccgccagcactctgttgcccagctggccttctgcagagcctggcgctgaagcagcttgtcgaattctgtgct

SEQ ID NO: 625845 - DNA, 443 bp, Homo sapiens
  misc_feature (77)..(77): n is a, c, g, or t
  misc_feature (145)..(145): n is a, c, g, or t
  misc_feature (261)..(261): n is a, c, g, or t
  misc_feature (296)..(297): n is a, c, g, or t
  misc_feature (367)..(367): n is a, c, g, or t
  misc_feature (394)..(394): n is a, c, g, or t
gtagacacagtttcctttagttatttgaacatatgtgtagaagctgatttaaagtacttgtctaagccgggcgtggnggtgtgcgcctgtaatcccagctacttgggaggcagaggcaggagaattgcttgaacccgggaggcanaggttgcagtgagccaggatcaagccattgtactccagcctgggccacagagcgagacgctttcctagatagatagatagattagatagatagatagatagatagatagatagatngatagataggataagataagatgataggtgacttnnctactagttcaacatcagggcttattcaagggaaagttcctattgatgaccttttttcccatgtcagagnccaggtaaccatctctttcttgggggnctcatatatatgtatttttgaagactggcactttaattgtgctgtgcct

SEQ ID NO: 625846 - DNA, 694 bp, Homo sapiens
  misc_feature (96)..(96): n is a, c, g, or t
  misc_feature (152)..(152): n is a, c, g, or t
  misc_feature (194)..(194): n is a, c, g, or t
  misc_feature (350)..(350): n is a, c, g, or t
  misc_feature (461)..(461): n is a, c, g, or t
  misc_feature (474)..(474): n is a, c, g, or t
  misc_feature (476)..(476): n is a, c, g, or t
  misc_feature (619)..(620): n is a, c, g, or t
cccccctacacccgctagtatgtttcagcgcaaaaggaaaccccaaggaatttaagaaattaaggcttaagagaaaagaaagaaggagggggaaangaaaacagaaaagaccagaggccccgcggggcaacaaaataaaaacaagaattcgngaatttaaaaaccaaccccaagaagagggaaaaggggcccanaaggcccaagaaaaaggggaagaagggaagggaaacaaacccggggaggaaaaagggaggggggggccccggaggcgcaaaaccggaagggcggggggcgcgaagcgaggaagggacgggggcgggaaagacgacggcatagaagaaggcggacgncgaaaggggcagaaagagaggcgaagaagttgggccgtaggggttccagaccgagacccgggggggcggcgagcaagagacgcaggagctggcctcgaaggggctggacanccagaacaagagnancaaaaaagatgtgaagcagaacgccaagggccgcttccacaagattgccgaggagggcgcgggcggaaccaagagccgcctcacgcagaccaaggcggaggccgccgaaaacagcgacaaagatgggcgacttcaaagaacannacgcgcagcggggcccaagcagcccagagcagaaggcggcaggcgccgaggagggcggcgggccgcggcgcgcg

SEQ ID NO: 625847 - DNA, 888 bp, Homo sapiens
  misc_feature (28)..(28): n is a, c, g, or t
  misc_feature (84)..(84): n is a, c, g, or t
  misc_feature (171)..(171): n is a, c, g, or t
  misc_feature (227)..(227): n is a, c, g, or t
  misc_feature (273)..(273): n is a, c, g, or t
  misc_feature (314)..(314): n is a, c, g, or t
  misc_feature (351)..(351): n is a, c, g, or t
  misc_feature (354)..(354): n is a, c, g, or t
  misc_feature (359)..(359): n is a, c, g, or t
  misc_feature (439)..(439): n is a, c, g, or t
  misc_feature (450)..(450): n is a, c, g, or t
  misc_feature (454)..(454): n is a, c, g, or t
  misc_feature (464)..(464): n is a, c, g, or t
  misc_feature (587)..(587): n is a, c, g, or t
  misc_feature (604)..(604): n is a, c, g, or t
  misc_feature (608)..(608): n is a, c, g, or t
  misc_feature (615)..(615): n is a, c, g, or t
  misc_feature (620)..(620): n is a, c, g, or t
  misc_feature (624)..(624): n is a, c, g, or t
  misc_feature (680)..(680): n is a, c, g, or t
  misc_feature (694)..(694): n is a, c, g, or t
  misc_feature (715)..(715): n is a, c, g, or t
  misc_feature (741)..(741): n is a, c, g, or t
  misc_feature (743)..(743): n is a, c, g, or t
  misc_feature (758)..(758): n is a, c, g, or t
  misc_feature (767)..(767): n is a, c, g, or t
  misc_feature (795)..(795): n is a, c, g, or t
  misc_feature (818)..(818): n is a, c, g, or t
  misc_feature (849)..(849): n is a, c, g, or t
ataaatagagtccaggcagggcagagtncattggggatgcccaagccggattcacccacccctccagccccagcctaggcgcanggcggcctttcgagaggcgaaactgtcttccttgtcctggtgtcccagcagggtcactgggaggcaacagtgtggtctcagggtgcngggcgggcccgtgaggcccatcgccgtccccctaggcatcctgtaccatctgtganccgaggcagggggtgccgcagcctccccggttgtcccaaccctgcncccctcccccctctccttcctctcgtagatggagtaaagcntgtggattaagaagaatttgtcctcaccctcattgcnganctgcnccttgagcaggcagaagaccttgcgccggccccgcaccaccaggatgtggaggtagatcacggccagcggccgggctganaccaggaaganaaanaaggggtgtnccatcaggtaccggtgcacccagggcagccaggagaccctggggcctgccgcctccaggtggcgcacccacaccctgccggcctcgtacatggagtccagggtccggaaggggccgcagtgcncgagggcttaacctgcnaaanggcgtanagaangaanaaagccgcgcccaggaaggcggggaagcagagcagcgtaaggaagacggtgctcangtgtaaggacagcnagggccggcgcggcgcctggnagttggccaaaaggctggtcttcttnanaaaaaagaagagcancagcctgangaactgcacggcggggaggaggggcganaagagcacccccagccaggtcanagtttgcccataaataagctccaggacattncgggcaatgtaaaactccggcttccgcctcctcttcagc

SEQ ID NO: 625848 - DNA, 823 bp, Homo sapiens
  misc_feature (823)..(823): n is a, c, g, or t
ctccagtgtaccctgctggaggactaaatggcagtgatccttccccctcatgcactggatggaccctcattgtggactgtgggtagggatatcgcctgtagtcctccagtgtaccctgctgcaatgctgcttgtgtggcaaaatgtgactggacctaccgtaagactgtgagaaagcccgggaggtcaccagtggtacgcccgtaggactctacagtgtgacgaggaaattgagccctgtaatggacaatcacggatgcctgcgcgctggcaatcgcagaggacgcacggccaaccaagagccggcgggactagatgaggagccccgagggagccgggagaggcgagagcgcgtgcaacgggaaccagtggccaggcgcaaatggcgccgttgacgacgcccgccagtgtccaggtgcaccgacagaaaggaccggaagcgacgagccgagggcagcggctcccatggcatggaagcgcgtgaaatcgagaggactggaccactggtgaagtcgctgagacgacgcgcctccaaaatgggaaacccccggaggaaccaaaatgcgggaccacgtggcgcccacgtggggcactttcaattaacccaggaatgcaagcccgaatcgaaagggcccgtacatatccgcgaacatcccaaacgcaaggcaagacgcttcgggaggatcacgcaatttgggaccattagacctgattcagccgacatacatttccaaccataaggggcgcccacttgaacacacttacgactcagcccattcgaggcaggcgcctcttcaatgacaacgtctggacaatctgagaan

SEQ ID NO: 625849 - DNA, 168 bp, Homo sapiens
tctgtatcccagcacgtcttggggagtcaggtgggcggatcacgaggtcaggagatcgaaaccatcctggctaacacagtgaaaccccgtctccactaaaaacacaaaaaaatcagctgggcatggtggcaagcacccgtagtcccagccacattggcagggagcccg

SEQ ID NO: 625850 - DNA, 179 bp, Homo sapiens
ggtagagatggggactcactctattgcccaggttagtctcaaactcctggcctgaagcaatcctcccaccgccttccgaagagctgggattacaggtataagccagcatgcccacccaacaatttttaatcgtcacatagtctgtatttatgttccttcttctgtttctggcccttctc

SEQ ID NO: 625851 - DNA, 520 bp, Homo sapiens
  misc_feature (1)..(1): n is a, c, g, or t
nctgcgcggtatggaacgcgtggcccgcgagaactcagactttcaacgccagaagctggaagcccatcagggcctgctggcaccccaggaggcgaaacagaaggtggagaaggaggttcaggcccgggaggccaacctccaagctgaatgctcccggcagacccagctagcgctggaggagaaggcggtgctgcggaaggaacgagacagcctgcccaaggagctggaagagaacaagagggaggcggagcagctcaggatggagctggccatcagaaactcaaccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggttgaggaggctccaggcctgaggaccaagggatggcccgacttggcggtttgcggaggatgcag

SEQ ID NO: 625852 - DNA, 499 bp, Homo sapiens
  misc_feature (19)..(19): n is a, c, g, or t
agttcgacggaaactctcnatgttatcaggctaggagataatggaattggaatgatgagtaataagaaaagagattagaaaggctgaggcaaggtttcttaatgagtttcaactatgttggtctccagagatgcttatttaaataatcttggtcacttttcaaacaatgcttttgattgctactctcaaagcagcattcttttcttttctttttttttttttttggttattggacatgtgccattaacagagagggtgggacacagaaaatgaagaaaataaaatttaggagttcagcgtgttggagaagtgaggaatataattatttaaccacttttttctatcccgtgttaaaaggagaaaaaagcaagttatgatgcgggttccaacgcaatatgggaaatcatcatgttttgggtttattaatacacttttttaagagcggtggtagtccacagcaaaattaagcagaaagtacagagagtctccgtcgaacggg

SEQ ID NO: 625853 - DNA, 293 bp, Homo sapiens
atttcatcaacgtatcatgcttcgagatgtcttgtgagacctctgggctggaagtcaatgcgtggtgtcacatccccacttgagctggctgatgcataccgctctctggcttcagcaccgctgtcccttgtctgggacccccacgcaaacgcctgaagcccttcctcagatcctgcttgttgtaagacctccctttaattctccacgcacagcagctgcccactgttgcctgccactgaccaccatgtagactgcgcagtctgtggagctttcactctgtcgtgaggggaata

SEQ ID NO: 625854 - DNA, 575 bp, Homo sapiens
agttttatttcatatttgtgtatctgaatatattaaaatatcttttttttttttggatgcggagtcttgctctgttggtccagcctggagtgcagtggcttgatctcggctcactgcagcctctgcctcccaggttcaggcgattctcctgcctcagcctcctaagtagctggtattacaggagtgtgccattagcctggctaattttggtatttttagtagagatggattttcattgtgttgggccatgctggtcttgaactcctgacctcaggtgatcctcctgccttggcctcccaaagtactgtgattactatcatgagccaccacacctggcctaaaagatcatggatttagtttggagtaagattttaagtgacttcaaattatggtatggtggtgtctggaatatctgatactagggtttttttttttttctttttcaccagcttttcggatactccttaaattgggggtattgtctgttcccaacatctttcagggaacatttaaggagggtcccctttttttttcaactcaacaccgtgttttttaacccgggccttgggggcccc

SEQ ID NO: 625855 - DNA, 513 bp, Homo sapiens
  misc_feature (158)..(158): n is a, c, g, or t
  misc_feature (164)..(164): n is a, c, g, or t
gcgggtggatcacgaggtcaggagatagagaccatcctggctaacacggtaaaaccccgtctccactaaaaatacaaaaaagtagccaggcgaggtggcaggcgcctgtagtcccagccacaggggaggctgaggcaggagaagggcatgaacccagngcgggncggggagctttttggcagttgaagccagagatcaacgccaaccggcactccagctctgggcaacagagccagactcggtctcaaacacaacacaaaggaaaacaaggaatgagcagacaaactggagaactggatcataacctaatatggatctaactatggttgggtggcgtgttctctaatctacttggacgaaagaggttaaaaacttccaattaaaaagggcgtggaaaaagaaaaggttaaggccacaattttttaaaacaaaacgggggaaacgaaaaaaagttcctataaatggggccttgggaagggggaagcaaatttaacgtgggcaaacaaacgtgca

SEQ ID NO: 625856 - DNA, 1053 bp, Homo sapiens
gctgcgtggaggctctggagcggagacttggggagctgcccgccgacaccccaaggggcggctgctgcgagaagagctcgctgcggcctcctccgctggccttcagcacccgacctggctcgggccctttcccgccacgcactacagcaccctgtgcaagcccgcgccgatcacagggaccctggaggtacgagtggtgggctgcagagacctcccagagagcatcccgtggaaccctaccccctcaatggggtggacctgggacacccagatcaggcgccccccttcctgatggcgccatgcccgtgggcctttacaagcgaatgcggaagcctcagtggcggagcagctcaaagcagaagccgagaacaccaagtgaagtccaggactgtggctttaagggtggacattaccccacgtggtgggggcacaacctgtttggagaacacacagtgtggccccccatgtgctcgtgagaccaagacgctctcatctcttggactcgtggaaagggccacgaggaactgaggtgtggtgatgttctgggcagaggacccagagcacgcactgtgtcgcctaaaacttcccttgacactttggcagcgacttctgggacaactgacgagtcactgacggtgcagctggatacactggaacgcgcccaggactgccctggcgagcggaaggccaccgatcccggcacccccgtcattgcagaggcactccatcggcaaccgcacggggagacacgaacaaatcccaccgcggcaagcaaagggcaggagcaaccgccgagtccagccggcatcgacatcgaataccgcaaagtgagggcgacggaccggagggccaccccagacgcaccgggcacaaggcgcgtttacgcccggagctcccacggatcgaggcggaaccagcggaacacgggcccacaacagaagacggacatacgcgacagccacaagcggagcgcggagacccagagagccacccgacggcactaagcacatgcctcgccactagcagtcagacaccgagacctggccgggcgga

SEQ ID NO: 625857 - DNA, 151 bp, Homo sapiens
  misc_feature (6)..(6): n is a, c, g, or t
agatcntgagcaggttagggcggatgagcatgtatcagctggcaagagtgagatctgttaaaataataatattagtataatacgataataaaataaagatcatatagtgatcagaaggttgtgtgcctcccttcctgggagatgaaacctg

SEQ ID NO: 625858 - DNA, 643 bp, Homo sapiens
  misc_feature (40)..(40): n is a, c, g, or t
  misc_feature (66)..(66): n is a, c, g, or t
  misc_feature (71)..(71): n is a, c, g, or t
  misc_feature (96)..(96): n is a, c, g, or t
  misc_feature (105)..(105): n is a, c, g, or t
  misc_feature (180)..(180): n is a, c, g, or t
  misc_feature (187)..(187): n is a, c, g, or t
  misc_feature (203)..(203): n is a, c, g, or t
  misc_feature (238)..(238): n is a, c, g, or t
  misc_feature (245)..(245): n is a, c, g, or t
  misc_feature (262)..(262): n is a, c, g, or t
  misc_feature (274)..(274): n is a, c, g, or t
  misc_feature (503)..(503): n is a, c, g, or t
  misc_feature (612)..(612): n is a, c, g, or t
gatcccggctcggattggccgggcacgggtgccccagaantggaaggcaggattgatcctccttgngcccntggaggaattcatcctgtcgacacntggacttcngcccagtcaaactgttatcggaaggggtccggatccggaccccccagaggggttcttggatctcactccaggaangaattcngggcgagtccaccaangtaaattgaaggcaagttttttaggaaagtagggnattaaangaatgtctactcccttngacagagcaggncattcctgaaagcaacaggaggaaggcacccaccttaggtacagtgcttatttatacacaggacaacaaagtcaaggaaattatggggcgatgtgctctactacgagagcttgtgacaaaggattgttcgtctttgtgtaactattgtcgtctgcaagaatctatattaatatctttaaagtaaacttattcttttttttattatactttaagttttagggtacatgtnacaacgtgcaggttagttacatatgtatacatgtgccatgttggtgtgctgcacccagtaactcatcatttaacattaggtatatctccaaatgctatcccccccaccnaaacccctaaagtaaacttattcttaaacta

SEQ ID NO: 625859 - DNA, 1002 bp, Homo sapiens
  misc_feature (768)..(768): n is a, c, g, or t
cagcccatgacccctaacaggggcctctcaggtcctcctaatgacctccggctaatcatgtgatttctcttccactccataacgctcctcatactaggcctactaaccaataccattaacccatataccaatgatggcgcgatgtaacacgagaaagcacatagcaaggccaccacataaccactcgtgtccaaaaaggccttcgatacgggataatcctatgtataacctcagaagttctttccttcgcaggacttgtgtctgagccttttaccactccagaccatagccccgctatcgccccctaattagagagggcactgggacctgcaagcaggcatcaccccgcgtaaatcccctagaagtccctacatcctaaatgcatccgtattactcgcatcaggagtatcattcagctgagctcaccatagtctaatagaaaactagcgaaacgaataatgtcaagcacgttgtcattacaatctcctacgtgggctctctatttgtaccctccttacaagcctcaggagtacgttcagaggtctcccgttcaccaatttccgacggcatctacggtcaactatttggtgtagccacaggcttcccacggagcgccacgtcatggatgggtcaactttcctcagtatcgtggtgcatccgcaactaatattgcactttgacgttcaaacaatactttgggttcaaaagtccgccgcctgatactggcattttgtcgatgttggcgttgactagttcctggatgtctcngccctatttgataacggggctttaacaccacataacgcgcccacatctcacaccacagagagggggggccgaaaatataccccggggcgccgcgtcgatccacgttgttaaaggggcgccaaggagggatataaacggcgcggcgctaaaccgtggaaacagcgtgtttttggaaccctgtgtggtagtcccccactacgcgaatatctgtgtcgcctgtgggtggtttcacca

SEQ ID NO: 625860 - DNA, 104 bp, Homo sapiens
aggtcggtggcgtaattgtactagaacctcatttaggaaataggtgttttatacattttatactgcaggtttgatatggggctgaagactttgtcggtgccaga

SEQ ID NO: 625861 - DNA, 377 bp, Homo sapiens
ggcagatcatgaggtcaggagtttgagaccagcctggccaacacagtgaaaccctgtctctactaaagatacaaaaaaccagctgggtgtggtggtgcacacctgtaatcccagctactcgggaggctgaggcaggagaattgcttgaatccaggaggcggaggttgcagtgagctgatatcatgccattgccctccttcctgggcgacagggtgagtcctttgtcttaaaaaaaaaaaaaattgaaaattgacatctaatctagagcttctgtacaggaaaataaactattgacaaagtaaatggacaacctacagtatggaataaaatatttgcaaactgtgtacaataaaaattaatatatagaatctataaga

SEQ ID NO: 625862 - DNA, 404 bp, Homo sapiens
ccctcagtcaggttggtgggggctgagtcctccctgagcaccccctttccacatttgctagaggaacagtgccatggacacctgtgacagagagaggacagttagtgaggagggtcagccagctcttcctttgggagcctggctagtctaggacatccccttgctgggtcttttcaagcttttaaaattggccctgaacgtgtgacagggtcctatggtgttactcaaagctgtgcagggtaaatgatgtcatatttattctttttccatttgttctagaaacagggcctttttcatcagttgcattttccggggtgagagctgtataaaaccttttggactgtgcccctgtcccttcctttttaagaaaaataaagggctttatggtagttggtaaaaaaaaa

SEQ ID NO: 625863 - DNA, 114 bp, Homo sapiens
ccgcctcagtctctggagtagctgactacaagcttgcgccaccacaccttgctaattagccagttttggtggggccttggcctcccttgctgaaggtggggattgggggaactc

SEQ ID NO: 625864 - DNA, 367 bp, Homo sapiens
aagagaaacctccccagaccactctttctaaaatgaatcttctaggctgggcatggtggctcacacctgtaatcccagtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcacttgaacccaggaggtggaggttccagtgagccaaaatcatgccaatgtattccagtctgggtgacagagtgagactctgtctcaaaaaataaataaataaaataaaatgaaatagatcttaaa

SEQ ID NO: 625865 - DNA, 1089 bp, Homo sapiens
taaatggttctcttaaaagtttattataaaccagtttcataggccacaaggaaataaaaggatctatgtacagccttaacgggaaaacagaggcaagggaagctgaaggaagggccaagaatgaagtctaagggcctgtggggggcgctattcccgggggagagggggccctcgctatcccgagggggaaggaaggccgatattcccggagagggggcatgccctatgggatgtcccttcttccgaggggggtatcccctatggggggaaccctataagggaggttctctataccagggaggtggggccctatctatgcctgggagggggtgcccctgcggcccataaggtgggggaggacccccaagggccagtgtgggtgtcactggttgttgggacgccccgggaaaaactgggtcttgtgggcacgcaagctggcagcgggtatggaaaccagtaacctctcttccttggggggggtctatcacctggtgggggatggggccggcaaaaccccaaggggactgggcccaagcaatgtcctggcaggagaccctgggggggcttggggagaacccccaagctggggagatacccttctggcacaagaaggccctctagcgcgaagatccccgggggggcccccccaagagaggtctcccagcaaagtgggaaatctcggaagcaaatcacccaggttatcctcttgggggaagggaggggtccccctactaaactggtcctttgtggagaacccaatattttctcccccctccgcagaaagacacccagaaccggaagggactccggctttactcttcccctttttctgggcttgggtacgggaaccagtctccttagggcgcatagaacctctttctctggagaactcccatccacagcagctccacccaagaggggacccaacatccccatgttccgctttgttcaaaaaaggctcttttaaaggggggcacccattaaaaaacatccggcgccgggtctcgtggaggggattagtgccccttaatctctgtgtaatcacaaattatcttgggcgcatctttgctgtctcttggccccccggac

SEQ ID NO: 625866 - DNA, 391 bp, Homo sapiens
cggtgtgtgtgtgggggaagccttgcttagaatgaatgagaagttacatattttactaggactgcccaataaaaactcagctatcatccaaagaggaaaagctcagccttcctgtctccatggacgacacctttctcttagctggcatgctgtgatggctagctgtgctatgtgaaaggaggagctgattttgttttttttttttttttaaatgctttttcttgggaagtatttgtggcctttaatttgtaactatatacctagatgcctatattggacataggcgaatgaagttttttctttctttcgtttttattttttttaaattaaaaaagaaaatatatgtatacagtaatacacacacacacacacacacacagtagcataaaat

SEQ ID NO: 625867 - DNA, 1521 bp, Homo sapiens
gagacgacgtgggcgaccgctccggcttcggacgcgggacgtgttcgtctgtgccagcgacctacacaacacgacgacacttaacactactgcggtgactgcttgacgaacacggcacgaacgacttttctattactgacacgttgttccacatgtgccaccacacgtttgcacaacggcggcaggcacatgccacacatgaccttgaggcacaacattctccataggatcatctatatcgaggacggaacgacaaggtcaagtgccccttgcgatactcattacaacagcctgccaactacgaacaaaggcactcatctggggcagaggcatacacctgatggagtcattcggagaatccccaagcaagtacatcccctggcacacaacaccatgcatcttcagtcgcgcattaccgcacgaacggcacgacacgccgcccgaccctatccctacgccatctactctcacacacaaacgcctacataaactgacgctaatacctctggccccacatggacctttactctctactaaccacaaaaccgagacaactgtcctcattgcactttcctcactcgtgtcaccaaatccgcttttaccctcagacattctacattacgacacccgagcacaattgcacgacatccagtggcacacttggacctagcaccgaggcacagtcattcactggtcacgcgggccagctcccttgacatcttcaaaacactcaagcaacttgggccgatgatgggtctcacatgtcacaacatcgtaccaaggatacaaagtgacacttcttcaaaaataacgataaacactacacacaatgtcccaacggaaacactatggggttattacaacttgggtagaaccccccgcttttataacacaccgcattatccgaatccaacgaccgctactccgctgaacggacaaatttggtgacacacatcttgcaacacaatacgactatggggcagcaacttgggacccaatcatcaacacacacttcacactggggaacgcatacgcgagatcaacacacatacccaccactgcaccacatacacactgagagctaatgcgagacacatcaacgcccccaacacccaccactgcgggccgaaaccagagggcgcaaccacggcagcacaacgaaaccacaagcagaacacaaatataacaccgcaagcaccgcagcgagagccaaacgggtcacactcggacaccataaacgaggccaggcgcagccacccaacacacaggcggagcacagcgacacactaaatgcggaccgcaccaacaaccacaccagaacagaacaccgagcaacaaaaagaccgcagcacatatagcaaaacacacaggcagcaagaagacaacaagaacgacacaccacaccaacacgagagcgaccgtcaacacacacaaacgcacccacagaacctcaagtgctgaagcacaccagacgacacggatgagacacagcactctcgccagcggtgacaccgcaaacac

SEQ ID NO: 625868 - DNA, 336 bp, Homo sapiens
gtcgacatgtgccacgactcagtttagttgaaccctggaacgagcccagtggtagttaacagctacgtggtgattagttcgccttgctctctctcgtatttcattaacacacacacacacacacacacacacacacacacacacacacacacacacacacacacacgcacacacacacacacacacacacacacacacacacacacacacacacacacacacacacacacacacacacacaaatacactcactcactcacataaacagataagcccattcacatgtccccctgtcctcttctccaaactgcctttgtgttcatgttaacgtccacg

SEQ ID NO: 625869 - DNA, 777 bp, Homo sapiens
tgacccctccttagctttatgcgctcagaaaaccaaattaaaccccccccccatgtaacaggggggcagggacaaaagcaaaaacgcccgaacccagccgggaaaccaccatttcttgcccccgcgcaatttatcgcccctgatgggattttggtttttcatctggtccctgtagctggggtcggaggttggagggtgggagcctccgggggggcactgggccattgagccccctgggagaatgtcagaggggatgtggagagggccactgtccggccggggcttctgggggcacagtgggttgggtccccagaatgtcctgagggcggagggggggtggtggggcagggtcctccctcagggtgtcaggaggggtgcctcggaggccacaggagggggcctccggtggctgtggccttgaggctgtggccgaaggggaaggggctacgcagggttgtgtaaccagagggtcccactcaggcgtggggcaggggtggccgcccttccgcacacttgaggaacccttcccctcttccctcggggacatctgctgcccgcccctaagaacccgtgcctgtgtctccaagggaggtccgaaagtctctgggggacctcctggggggccaaggtgggagtaaaggccgggcaaatagggaggataagggcgggtatagagcccacagagcaggaaagctgcccaggttctgccccattcgaccaggtttgctggggccccgggagcccacggtttctggtgatgccatagcagccaccaca

SEQ ID NO: 625870 - DNA, 629 bp, Homo sapiens
agcggggttacttcctccagagactgacgagtgcggtgtcgctccagctcagagctcccggagccgcccggccagcgtccggcctccctgatcgtctctggccgggccctcgccctcgcccgggcgcacgagcagacgcgggcgccgagcagacaccgtcccgacaagcgccggcctgccgcagcggccggatgaaatgatttcggaatcaagaatatggaccaggtagcccctgtgggctaacagttacagagggacactcaagcgcgagacagactttgacacctttgatgggtccctgtgttgctgtgttaccttctctaaatgaagagcaaacactgtcgaagaagtggcaacagggcttggattcccatttctcatgagtccgccaactgtgaattgcctttgtgaaccccgtgcagcgaaggctgtgatgagtcaaagccttaaaagctaccttcagtggcttcaaaaggaacacgcgggcgcctgggcattccaaagaaaccctggctgtggagtgagcaacaggtatgtcagtggcttctctgggcaccaatgagttccactctggtgaaacgtgaaatctgcacagggttcggatgaaatggacaagatgctgtgtaacc

SEQ ID NO: 625871 - DNA, 158 bp, Homo sapiens
tgtggtcccctcccccccgtggggggttttttcccccctttgggggatttttgttgggttggggccccgaaacccttttccccccccttaggcgggggggggttttaaccctgggctggccctttcccggccccttaagggggtttttttccccccca

SEQ ID NO: 625872 - DNA, 1063 bp, Homo sapiens
aattttatgtatgtatgaggcctgaggtgttatatcggctacgaggcagctcgccgcttgctattgcgtcgctcaccgtgaatggcctaccttctgggcaaggaggacgcgggcgcgcgagattcggcgcttcagcttctgctgcagccccgagcctgaggcggaagcccgaggctgcggctgggtccgggaccctgcgagcggctgctgagccgggtggccgccctgttccccgcgctgcggctggctgtgttccagtgcgcactacctgcgatgaagggactggggacttgtggttgccttttccagtgaccgaggaattgacaatggccatgtcctactgtgaagggatgacatcttccgaatctacattaaagagaaaaaaacgagtgcctggctgggaccacctgcccacctgtgtgctcaaggagtgctgccccgaaacatggttgcaccccaaatgtgatctgccgatggctagcaacttgggacctgtaggtaggaaacccggcttacaaagatgcaaggtgtactggcccagaataacgactatgttgtacacgtctagcggagggaacaacgggggctttgcaccctgggttgctaccaaaccaaatgctacgacatttccccacaagccactttacgggacacaccttgtcttgacgggctacctacgccacaagaccgctgggcatcctgtacaaggtgttgaaaaccaccggacccactttcgcagtttgggacagcgaattgcgcaaactggggtcccaccaggaaacactgggaagcccagtgttctcctcgcttgccggggtgagtgcccctgccattggccccacacggcagaaatcagactcctggtccatggggaggatcgaagtgtgaaatttacgtgaacgaccgttgggggagagatgttgcagatgaccatataccaccatctggtcatataaattgatatgatgtggagcacgtgggcaaataagcaactaacagggtctcaagaaagtccagacacaggaatatacagcaaagcaagacaatgggataaatcaacagg

SEQ ID NO: 625873 - DNA, 116 bp, Homo sapiens
ataatcagctcggccctattaagtattctgaatacaagtaggataccactaataagaatgtatttacctaagaaatctatgatagtgaagtggctatcctaaactggtttatctcc

SEQ ID NO: 625874 - DNA, 429 bp, Homo sapiens
agcctgtgtgcctggttaagggtacgaaggagttcctgaaagctttcaggtatctgagcctcgggattctcggtgaggttgaaattcgggccctcaggaatttcatcgtgagtgtcagccttggtccacagtaagagcattgcaaagcctgaagcgatgctcactggggagaagacgatattggtgctgttggattggtgtgccagctgacggtataggttaaaggcgatctcagccaggttgggggtgatcttgttagaggttgggtgatcctgatcatggtggtatgtatcgtgtcttgtggacagcatctccgtggggatcttcagacagggagacagggaccaggcagcacaggcatgccagcaggagtatgccccgagacacagtaggcggcattgtctattcagtgtcccaggtcagtggtgg

SEQ ID NO: 625875 - DNA, 195 bp, Homo sapiens
tgttcatgagtattagtcgtcatttttgtaacgatgtaaaagttctagcagatctgattcatcgaacaatattacagatattcaatatttcacacaatagacgtatgtacacttaacacaatgtctaacgatgggccatgctgcagtcggctcgaggcctatatatcccaggtactgttgggaagctgaggtcag

SEQ ID NO: 625876 - DNA, 251 bp, Homo sapiens
ggcaaccaaatcccttctgagtcttgcctttggtcagcatctacctttctcccagatcacaggcaaaacctcagctcgctgcaacctccgcctcccgggttcaagtgattctcctgcctcagcctcctgagtagctgggactacaggcacacgcaatcacgcctggctaatttttgtatttttagtagagacaaggtttcaccatgtcggcccggctagtctcaaactcctgacctctggtgatccaacca

SEQ ID NO: 625877 - DNA, 303 bp, Homo sapiens
atcattaacagcgcaatttttcatgcatatttaatgctgagttcaatttaggatgtattacatataggcaatgtgttgagcaatacccacaacaactgcagtttcttacttggccaagagaatactcatttaagtgctagacttccattctggcaaaatcttgcaccaaaactgtgcttgctttgtgcttgctacacttggctgccttacttttcttgagctaaagacagcctttttccaccgatattataactgctatcatcattaacagcctagttttacaaccctatttaatgctgattg

SEQ ID NO: 625878 - DNA, 217 bp, Homo sapiens
gggaccccccccccccttttttttcccccctttgaggccccggggccggttccccccccgggttttttgtttgggcccggggggggtttccctttttccccggggcccgcttttgccctttgggcctttttgggggccctttttgacccgttttttccaaaaagccgggtggggccgggtcgggtttttcggggtttttttggcccccggggcccca

SEQ ID NO: 625879 - DNA, 132 bp, Homo sapiens
gggccaacggaggggttcaaagcaaacccaactttttgaactttattttgttgggacggaaggcccctttggccgggaggttttttaatttaaaggggctgggtccctataaattattaaaaaaacccccca

SEQ ID NO: 625880 - DNA, 397 bp, Homo sapiens
  misc_feature (329)..(329): n is a, c, g, or t
  misc_feature (369)..(369): n is a, c, g, or t
  misc_feature (391)..(391): n is a, c, g, or t
tgaaaagtaacacttttacactgctggttggaatgtaaactagaataaccactgtggaaaatagtatggagattccttaaagaactaaaagtagagctaccatttgatccagcaatcccattattgggtatctgcccagaggaaaagaagtcattatataagaaagacacttgcacacgatatttataacagcacaatttgtatttgcaaaactatggaaccagcctaaatgcccatcagccaacaagtggataaagaaaagtggtgtttatattactatgtacactatagaatactactcagccataaaaaggaacaaaataatggcntttcgtgaggccaccgcgcccggccaggtggatctttttnaaaatgtgggatgtattatggntttatt

SEQ ID NO: 625881 - DNA, 145 bp, Homo sapiens
tccccgcgacattgggcctgtagccttcccccattattcctagaaccaggcgacctgcgtactcctttacgttcacatcgagtcgctactcccggagttgaaacccctcattcgctataactatcttacagtcacaagtacgtct

SEQ ID NO: 625882 - DNA, 667 bp, Homo sapiens
tgtggtagctcatgcctgtaatcccattactttgggaggctaagatgggtggatcacttgaggtcagttgttcgagaccaaccagaccaatatagcgaaacctcatttatactaacaatacaaaaattagccaggcatgcctgttatcccagctactcgggaggctgagacaggataattgcttgaacccaggtggaagaggttgctttgagccaagatagcgccactgcatttttttgagacgctgtgtcaaaaaaaaaaatggcaagaatggaggtactgaggcagggtgcactggctcacacctgtaatcccagcactttgggaggccaggcaggcagatcacttgaggccagcagttgcagaccagcctttccaacatggtgaaaccctgtctcttctagaagcacaaaaatgagctgcgcgttctggcgcgcaccttgaatcccagttacttgcgaggcttaagcagggagaatcaccggaactcacgaagccgcaggttgcagcgagcccagatcggaccagtacacttcagcctagcccacaagcaggactggttctaacaacaccaccacgacccactccaatcccaccctcccaaactgtcggcctcttggcccaacccctctctcggcaggcttagcatccgggcgcttgcggccct

SEQ ID NO: 625883 - DNA, 254 bp, Homo sapiens
tcctaagcagataggtgtttttcatttcatgattaatgctcccacctaccaagtgtaggtggggtctaggagctggtctcctaatcccattgttgtgcaaccccagttagtcctcagggctctgatcgctgtccttgggtttgtgccacgtgagagagattagagaaacaatacttgctgctgttgctgggcaaaggcttgcgttgctctgaggagaggaaatgtgaagacccagttcgccccatgattagtct

SEQ ID NO: 625884 - DNA, 301 bp, Homo sapiens
tgctctagattatgttgttttaaattagatactgcaaagtatttaaaaggatatctgatgtccatttgttccctttttgactctgtgggaaaaaggaataaggtaacatttttttaaaaatggactactttggaattttggcggatttgattccggaatttatattaaaggcccaagaaaatccaaacctattattcaggttcccaaaatataatctgtggtgcagattcaggggttgtggaatacatgttagagtagcaattctgttgttagcgatacataaactaatgtcgacgcggcc

SEQ ID NO: 625885 - DNA, 526 bp, Homo sapiens
ggggtggattccctgaagggaaggtaaccccaaggaaaaggaaccatattctttaaatattattcatgctatcatttagaaactggctatttggatactttgccagccaatgtgggtatatttcatctttgcaaatctcttgggtacctcttagatctttaaaaccaactttcagtttcttttttataggtagaatgacaactctcctctatcacaaggtacatttcacttttcttgttagagtgttccaatagattcaaaacagaaacacaaattaatgaattagaaaggaccattactccccccacactctgctccagagcaagtattgcagactcagactcctacaggagtgagtgaggcaggctagggtgagcactctggagtctggcattgtcatcattctcattcagtactgaacctgacacctagcatttggggagcataaacccttccaaaggggacagccagttgttgccatgggggattgtaggcccaatgttgccaagtcttctgatactttggg

SEQ ID NO: 625886 - DNA, 140 bp, Homo sapiens
cccaaacccacttccacctttactaccataacaaccttagctaaaccatttacccaaattaaagtattaggcgattagaaatttgaaacctgggcggcaatagaatataggtacccacagggaaaagattgagaaattta

SEQ ID NO: 625887 - DNA, 120 bp, Homo sapiens
tacagagaggagctgagaccccagaagtgctctgaaccccaatcctcaaaatgaagatactgacagagagcagcagaaactctggaactgtttccagagggcctgcattgcatggaccag

SEQ ID NO: 625888 - DNA, 151 bp, Homo sapiens
tacagtatataacgtatggtttgtgaactttgatatttcatgtacactataaaatatatatttggggaacattgatattatatgtacagtgtataatctatatttgatgtactttcatattttatgtacctaatatatatttcatgtaatc

SEQ ID NO: 625889 - DNA, 607 bp, Homo sapiens
gagacgtgaatggaggaagtggagtagatgaaatggttaaatgttggagaaaagaggctatttatgaatatgaccactgtcattcagataaaatttctggactgttatcattgaaaaaagtctcattatgtttctatttgaaagccaacccttatgcttttttgaggaaaaaaaaaaactgtgagtcacgttatgcttgcaagtgtttaattcagaccatttcatctttaagaaggcccctggtcacattatacggatgatttgcttattaaatggaactcctgtttcttgcaccatgttgtggggtcaatatgagaagcctaattaacagaataaaaagcattaaagcttctttagctaagtcaaacttagagaattgtctaatggtatgtagcccctcgttctaagatgggcgttttccccagataacttgaaaatctactggtaacagccacttccctttaaagattctattactaatagccatggagtaaatgcgggatcctctagagcacagttaagaatttgcaggccttaaaaactaacttatttttcctgattattgagtttattgtagaattctacgtgtaagcattccccagccgct

SEQ ID NO: 625890 - DNA, 165 bp, Homo sapiens
cccccctattgggcccccccgcccgggggttttctgggcggggagggggggaatgaaatatcttatattcttgggggccccaggggttctaagggtcccagggggcctggtccccaccccggttattttccggaaatttttataataaggggttccaatttccca

SEQ ID NO: 625891 - DNA, 396 bp, Homo sapiens
agcgaaggtcgggtctagggtgtagcctgagaataggagatcagtgaatgaagcctcctatgatggctaatacagctcctattgataggacatagttggaagtgagctacaagcgtaatacgtgtcgtgtcgtacgatgtctagtgatgagtttgctaagtacaatgccatgtcaggccagcctaggtcaaacgaccaccacacacgtttatctatgtaacaaaactgcgcttccggcacatgtaccccagaacttagaatttgaatcaagagccggcgtgggacctgagacagataattttctcaaaagaagacactcaagtatatgaaaaaacactcatccttactaatcatcacatacataaatgcaagcaaaaaccacagtaagatgccatc

SEQ ID NO: 625892 - DNA, 165 bp, Homo sapiens
  misc_feature (82)..(82): n is a, c, g, or t
tgggactgagaatgcaggaaccataatactctgtagtagccataataatctaaatacagtattagagacctagaaataatgngtctgattcactacccctaccagtataggaagatttagactacagagtttgcttcttcacataacaccctatatccaacaggc

SEQ ID NO: 625893 - DNA, 86 bp, Homo sapiens
agcgggcagcgcctcagggagcgcggggcccactgacccgcggaagccagcggacccacttgtgcggcggtcggcgcggggcgcaa

SEQ ID NO: 625894 - DNA, 426 bp, Homo sapiens
atgatcgaaacatcatctgaataccgttaaggcattaaaagaccgaaaacagtaaattcgttacgtagtatcacctaccagccccgactcaccattagcattatagatatatacaatcagactggaatgaatcttattaaaaatacaattatacgtcctagaaagtgacaccatcaagcccccgataaaaggacattcctcggagcgaattcccaaatgataaaaatagacccctagacttcatccctcaacaccccagtacaccctccacccaataactcccctggacgaaaatatgtagctacgatagtcatccggtgctattttagtcgcgcaagacctacacaagcgtaggtgcctactgccactggaaacttactcgttgtgtaagtggagcggcgtcgatgttcttctcaacgaacacgc

SEQ ID NO: 625895 - DNA, 251 bp, Homo sapiens
ggatggccggtgtgttccatgatcgactggcttcctcagtcactcagatccttcactcatccagggatctaagaacatttactgaccatgtctacgtgcagctctagtttacagccttaggaggtcttattctgacttcctctgattttggcatgtgtagacactccgataaggagagttcagcgcctgtggtgaagtgaagaatctcatttcccagagtctgaggagaagagatgtgtaccccgagccat

SEQ ID NO: 625896 - DNA, 895 bp, Homo sapiens
acaccagccctcagtcactgggagaagaacctctcataccctcggtgctccagtccccagctcatcagccaacacaccatgtgtgaagaggagaccaccgcgctcgtgtgtgacaatgggctctggcctgtgcaaggaaggttcgcaaggagatgatgccccccgggtttgtcttcccctccattgtgggccgccctcgccaaccaggtgtgattggtgggaatgggccaagaaagacagctatgtggggggatgaggctcaagaaccaagcgagggatcctaatctcaaataccccattgaacacggatcatcaccaatgggggtgcctttggacgaaagatcttgcaccactctttctacaatgagctgcgtgtagccacctgaaagagacccaaaccgtgtctccacagaggctccccttaaattcccaaggccaacagggaaaagatgacgccagatcaattgttggaaaccttcatgtccctgccatgtacgtcgcccattcaagctgtgtcttccctttatgcttctggcgcacgaaaggcatcatccttggattcaggttgatgggcgtcaccccaaattgtccccaatttaatgaaggtaatgctttggccaaatgcataatgcgctgagttgttgcgtgactccgggacaactcatgaacgtctcaaagaaggagtatcctttgtgccacgtggagaaacctggcggcctcaggaacgttggcatttgcactgttggaagaggagcacggagtcttcccctgggaagagattactgcccaaggaggtcacatggaaacgtcggcgacctaagcctatgggggcggaatgaccacccggggcgccggtatacagctgcccttttgtagtacctcccggggctcttgc

SEQ ID NO: 625897 - DNA, 465 bp, Homo sapiens
  misc_feature (4)..(4): n is a, c, g, or t
gtanccagaggatgttcatggataatgccaagtgatgggaggtggttttgaccgagggaaaaaggatcttgggggtgaatccaaatgccattggctaaggtcgggcatggcaacccatgcctgtaatcgctagcactttggaaggtgaggcagaggattgcttgaagccaggagttcaagaccagcctgagcaacaaagtgagcctctgtctctacaaaaaattttttttaaaaatttatgcattggccatatttccccacattactgaaggctgccttagggacagacacacaggtctgacctgtcctttttttgtagcttctggctcagggcctaaaacaaactggaagcccctaagggtatgtaccgctttttctttccatttcctgaatattggatagtaagtagagggagactattcttcagattgactagattagaataggcattgtcattgtttttca

SEQ ID NO: 625898 - DNA, 817 bp, Homo sapiens
ctgaaaactgggccttttccagttaaaatatgctgtagattagaggaattcttggttattattttagaaaacctgatcttctcttttgggtcatttgtctgggttaggtttcttcacaatcttgaacattttacagtagaactcatctaaaaatggattggggatggggaaacatgcacaaaatcttttcataattaaaaagagccttacctttctttacataccacatggacagaattgtgtaaaagtgaattatcttatttaaaatgtatgtttcccctcactgttgcagctcccaatgtcgtcatttttaaatgttatatacatctcaagggttaaccagaccctttcctccaaaacccaacctttcatttcctacttcattccagcaggaggcacttaggggagactcgcgatggggacatggagaacaacccaagctccttaaacttattattattgtaataatctaatgatatcactcactaacacgtgaggccaggaaaaatgcttctccttttaaaatcccctccaattccctcacaaaaacacaccttttggaaaatccttccccaagaatgtttctttaatgacgacctcctcgaatcttgtcgtctgatccaggtaatcatattcactctcgttaaaatataccattcagatcagagacaaaactgtatccatacgcggatccagaaagttggcatcaatcacttgggctgctggcataacaaagggtacttttttacccggaataaaacgcccagctgtcgttgacgaggtgggtgaaacaaccgaccatcaaaggaatggacac

SEQ ID NO: 625899 - DNA, 430 bp, Homo sapiens
cgcaccaggttatcgcctgtcatgttctgcagatcagcctggtactctgtgttcgcgtatcgacgccccacctcgaaatactcgaattcgcgggccgacatggttcccgtgcgcttagcttctgccgaggcaatcttttggtagtaagactcagccgattttgaggaccgtgcctctttaagcagatctttagttgagtccagcggttggcttgcggcgatcatttgatcttgaggatccgtcgcagcggagatgatcgagttgtactggttcatcaggccgatgtactggacaccagcgtcagattcggcctgccccttcttgagctgtggagccactgaacgccgcgcggagttctgcgtgtacatccctggctgcgtccgtttgcgcctgagtaaaggtgaggtcctggtccttgccatccttgccg

SEQ ID NO: 625900 - DNA, 758 bp, Homo sapiens
ggccgggctcgatgtctcatgcctgatttaagcgcgatctgctttaccatggctaggatggcctacaagacccagcgtttgctaatggtgctggccgacccacttgcatcgtgatcacttctctcaaatccatgcactggacccaatcccgagcccatacccagtattacccatactctctatgcactgactcggaggtcaccattagtccagtgaaagtagtggaccagtagctcatgtgttgacacgattaccagtccacgctatgcaaccagtatcagcgctcatagtcggcttactcggattacaatgtccagcgtggatctgtggcgtggaccgactgccaggacactgagcaatgctcaagatgttcagattatcgatgtgcaaacatctactagaggtacacaagtagctaaatctgcagatctagccatatgaatgcagtgtgtccatttgaccttgcagagctcagtcgacttcctccatttctgtgattgttagcatcattggctctcacaagtacgactaatatccaactcgcacctttgtctaacgatctggtgtacacccatgccctttccggctccaaccttgtcccatcgggacaatcccctttcgtaccatccttaagaaccactttaattccatcgctgacgcctaacaccactccggtccaacctcctcactgttccccaacttaccgaatatcccttacaggcgccacccggcctctctctccagtcctcaccttctcc

SEQ ID NO: 625901 - DNA, 329 bp, Homo sapiens
  misc_feature (1)..(1): n is a, c, g, or t
  misc_feature (79)..(79): n is a, c, g, or t
  misc_feature (82)..(82): n is a, c, g, or t
  misc_feature (89)..(89): n is a, c, g, or t
  misc_feature (101)..(101): n is a, c, g, or t
  misc_feature (114)..(114): n is a, c, g, or t
  misc_feature (116)..(116): n is a, c, g, or t
  misc_feature (122)..(122): n is a, c, g, or t
  misc_feature (137)..(137): n is a, c, g, or t
  misc_feature (139)..(139): n is a, c, g, or t
  misc_feature (169)..(169): n is a, c, g, or t
  misc_feature (182)..(182): n is a, c, g, or t
  misc_feature (222)..(222): n is a, c, g, or t
  misc_feature (283)..(283): n is a, c, g, or t
nacattatatcattactacatatttctccttcactaaatcttaatctataaagcacattttttataattgttatcaganaanctataancgagctccattntgggtcggttttncnccagcngggcttgggtttgtnantatgcttttgaatagggtcatgcaaaaggngagcttcgatttnggaacttgatccaagcaccagatataaccaaaatctctgnactaggaaatatttgtattcacatagggtcattttccacacaatgatgcccattataaaanagcctcctctcatattctatattttaacttccagagttttccacta

SEQ ID NO: 625902 - DNA, 383 bp, Homo sapiens
ggagatcatttaagggaaacgtcgtacttgatatgcagcgccatggcaacagcctcgggagaattgtcaagcatctggagggtctctctgaagaggctatcatagagctgaacctgacgactggtatacccattgtctaatgaattggcacaagaactatgcagcctatcaagcccatgcagttctgggggatgaagagacggtgcgcaaagccatggaagctgtggactagcccaggacaaggccaaagaacagtcgaaggccggcgagaaaggatactgtccccaggagcacacctccctgcccgtctagtccctctgcccctcccagctgcacatagtaacactaaccacatctagtagacatctaagaaagtacctgca

SEQ ID NO: 625903 - DNA, 902 bp, Homo sapiens
  misc_feature (499)..(499): n is a, c, g, or t
  misc_feature (615)..(615): n is a, c, g, or t
ggacggggacctccgacggtaccaagttaccgcttggtgtgcggtgcaacggagaccgcgaagagccaaggctatctacctgcagtgctgtaggatgcgagtgttactagcaggtgtccctggcacatgccaagaatgcaaggtccacatgtacattcgcagagttggtaggtccgaaggaaggtggatctgtcattgaatgtcgacaatcactaatgcgtgacctgccatctagtcgccatttcaccggaggatcccggaagatagagatctcccacatggcgcgggtaatatacacatggacgtgccagtggctaggtcgaggggatccattacaccttgcaattgcatggctgtagtggctatccagagacgagtgagcccaagatcgcgataagtgttattgggcgcgactgcagcagtcgcacccaagccggaggtacacgcaagtcccgcgatccgtccgtcgacgaccggggtgcacacgtattccatcaancttttctgagctagctggctcgcgtgggtatcttctccccatagatggggactggttggcacctcagtcgcttgcttcgcccggcgtcccgctgccatggggcgccgacaagaggntgtacaccggccgtcttctggccaaaggcccgctcgcggaaccgcgccgcataacgtacaaaactaccatgctctaagtcccgatgcgcgggggaggtcgcgataccggtatcagtagtccgtaagcccagcaagggtcctgctcagggaggcatagaccggagtggtcacaagctagtctacatccctgggtattcccgtgagcttgctccttttgtttcaccccacacgatctgcggtcgtaccgtgagcattctacgcgggcctggtgcccagttgccccgccg

SEQ ID NO: 625904 - DNA, 989 bp, Homo sapiens
ctgagttgttacacgtgtaactctcctctcccagaaccggaagatggtgccggtacccgagggggcttacgggaactttgttgaggaacactgctatgtcatcctccacgtcccccagagacccgaaggccacgcagggggcagtccgagcagatctgcactacatgaggctcgggaagcaggcgcggtgcggaagccgcaggggcggcggctggaggcacgtatcctagtcagcgcctgacaggcacagaggcattgaggtgggcccgagacccgctgctggcaccggccgaagcgcgagggcgcagcgagtccggacgatgctctctgcgagctcacttccagcccggggcaatcatctgacgacggacacgggagagccatatggctatctagacccttcaagcgatgtggatgaccctaaacttgttgtcaagcaattccacgctgacgtgctgccaccaatcgactaccgggagcgaagcgacagtggatcgttgctcgactagaaagggtagtgaagggctacgtcccctgggggagaccatgccctttatagattagaggggggtagaaccggtctttttcccgtgggcttgtgggaatcgcgtaaggggcgagacgaactgaacttggaactttgcaacggtcgggcaaattggcggcgtccctctaggaggaagcccatgccctatttttgcgttggaacggaaaggggccctcggccgcggtgcgacccgtgtgcgacttttcttagaagcgcttaaagcgagggcacttccccggggccgcaaccatagggggggcaacacccgctggcgcctggcgctatggagtccggctcgcccactaaggactctggggaacgctgcggctagggaatcgcaatttgaaaggcgtcccctagatatggacccgcgcggtggaacgccttcccaattgtccagagaatccgactcgcggagaggagtcggttaggtggctttcgg

SEQ ID NO: 625905 - DNA, 703 bp, Homo sapiens
ggcctcctgacaggaatggtttagaggtggacatagtcctggccaggccgggccgggctcgcggggccaccccggggggccgagtgcatggatttgctccgtctgaaggtgaatgaatttcgtagaggagctgctgcctggtccggtggtgcatgtgactacttcagagtggctctaaggtcgtagcgtgttgctgatcgcggtgctaggcgcgtgtgggacggtccgcccgagccctgacgagagatgctgggatgctcgagcgaccgagcgagcgcaacgcggtggcgaatcggtgcagcataaacgacgagactgtcagtggagcaagtatttaccatgggcagagatgcaatttctagctgatacccaaagtcagtcaaactgagaaaacgaggtcaggctacgagagtgagaccacctggaaatggagcatcagcaggttctagtcgtccagaaatgaacgacagattgatgaagcacaggatcaccgcaccagcttcctcccgcactgaagcttctcaactcatagtccgaagacctaggcagtaattccacgcatgtcgaaagaggccttatgcacagaaaaccggggacggtggtactttgagcaccgcgaggatggaggggcgctctgctcagtctccctgctgtagaggatgagctgactagatgatacccttgtagctattgaggctataag

SEQ ID NO: 625906 - DNA, 149 bp, Homo sapiens
cccgatttctctctgtgggggacgctctcgtggggtgacggctcgctcaggtgggaggcaggaggattgctttgaacctgggaggcggaggttgttctgagctgagatcgcgccactgcactccagcctcggccccacagagagagcgt

SEQ ID NO: 625907 - DNA, 207 bp, Homo sapiens
tagtaactttacatcatattttcttgaacagaaactttacaccactgctcattatttaccttatgagacaaaactactaacacaatttatatgggcttacaattataacacaaacctgtgagagggcatgatctaatttaattttgattgccttcttttattattatcactactactgtctgctcactatttctgtgcccttttcaa

SEQ ID NO: 625908 - DNA, 154 bp, Homo sapiens
ccatccttttattggtgcgaagaaaagggagcaatgatgagtgttgacccctgcatcttatgtgtgtacttgtctctgcctctgtacacacacacatgcaccacagacacaccacacacacacagcccacatacacagcccacatacatgccca

SEQ ID NO: 625909 - DNA, 743 bp, Homo sapiens
  misc_feature (680)..(680): n is a, c, g, or t
ctctaaacttcccttctcacttcatttcattcatttcatcttccatcactgataccctttcttccagctgatcgcatcggctcctgaggcttctgcattcttcacatagttctcgagccttggctttcagctccatcagctcctttaagcacttctctgtattggttattctagttatacattcatctaaatttttttcaaagtttttaacttctttgcctttggtttgaatttcctcctgtagctcagagtagtttgatcatctgaagccttctctcaactcgtcaaagtcattctccatccagctttgttccgttgctggtgaggaactgcgttcctttggaggaggagaggcgctctgctttttagagtttccagtttttctgctctgttttttccccatctttgtggttttatctacttttggtctctgatgatggtgatgtacagatgggtttttggtgcggatgtctttcctgttgttaagtttccttctaacagacaggaccctcagctgcaggtctgttggagtttgctagcggtccactccagaccctgtttgcctgggtatcatacagtggtggctgcagaacagcagatttttcgtgaaccacgaatgctgctgtctgatcatttctctggaagttttgtctcctccaagtaggctgctcgggggtcanggggcaaggacccacttgaagaaggcagctggcattctcagactccaaaggggtgtgggagaa

SEQ ID NO: 625910 - DNA, 104 bp, Homo sapiens
gacgcatatcaggactttattgtgttacatccatgtgactagaactcagatcgggccctttaacacctttcgtactgatatctgtggcatgaagaagggcgtca

SEQ ID NO: 625911 - DNA, 123 bp, Homo sapiens
actatcatccccagatactcgggtggggggctgtagatgtatgcagggcgtggcgggctttccggttcctcatcttcttcttagggcgacggagtcttatcctttgatgcctttgacgctgtg

SEQ ID NO: 625912 - DNA, 517 bp, Homo sapiens
gcgtgggcttgcctctcctctgcatcctggaagcatcgtgcatagttctttcattgtaagccgctattttacattcccacaatgcatgactgtttgaccagtgatgtgctactgatatgtcacacgacgttattctttgatttggtgttcaggttttgctttcgtgtgtgtgtcttctaacaggtaatgtgtattttagtgtcgtctaaacagtcgatttttacttatagacaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgc

SEQ ID NO: 625913 - DNA, 174 bp, Homo sapiens
  misc_feature (126)..(127): n is a, c, g, or t
taattttaagcacagctagaaggtagtagagagagaggaagctggaggcacggccctgctgatcacaggagccttcacacggtggcgctgctgggtcaccaagacctgagcaggttgtctcccagnngacgtgaaccattctttctcccccgcgcccttaccacagtgttccag

SEQ ID NO: 625914 - DNA, 174 bp, Homo sapiens
tactcgacaggctccagctataacgatattctggaggtcagcacggtgctcacgtatctgacggaacttgtacaggcaggcatgcaccgcagtggtgaatacacgtacgacctgtgctccatctttagcgatattttggtggtcagcacgtgtgctcacgtgatcgacggaact

SEQ ID NO: 625915 - DNA, 124 bp, Homo sapiens
gtggctcacggagttttggcagagatatgagatctgactccaaactccattcccaagggtttccatggacgggaagcaggcgtgcgtgctccatgataaaagccctggagctcgaccagcaatc

SEQ ID NO: 625916 - DNA, 118 bp, Homo sapiens
caccctgttgcacgatgcggacggtgtggagccccatacaaacgtgaacccgtggaggatggcagagagaacctgtccgtcacgtgcataaacaacaaaataccgggcgcggcggccg

SEQ ID NO: 625917 - DNA, 199 bp, Homo sapiens
  misc_feature (18)..(18): n is a, c, g, or t
  misc_feature (68)..(68): n is a, c, g, or t
  misc_feature (122)..(122): n is a, c, g, or t
  misc_feature (149)..(149): n is a, c, g, or t
  misc_feature (177)..(177): n is a, c, g, or t
agacaggctttcaccatnttggtcaggctggtcttgaactcctgacctcaagtgatccacctaccttngcctcccaaagtgctgggattacaggcataagcaacgtgcctggccctggattngtatcttacttcaagttgaaatcattngagaagttgtagtttcaaaaagttgctngctgacctatatcttcctgcat

SEQ ID NO: 625918 - DNA, 602 bp, Homo sapiens
  misc_feature (439)..(439): n is a, c, g, or t
cacatgaggtgtactcagcttctggcttatggcggcctctgtcttgcaagcagagcctatctgttgtctgtgcttgcatagtctattcttcactggccgcagcggacatcttcctttctggcacgaagtcataattcatagactgcagtaccggcatttacttccaatgttcccaaagttgttgctctctgccagtaggattatcttcctcatgttagcccacactagtttctcccttcaagttccagatgcaattgatgagcacctcgtcaatgctcatccctaaaaggttaatggattggctggggcctgtgttttcattctcttcccatttgacatttggttttctgtggtttaactggtcaaaagactgtttggatgcctgtgtgtgcatagaactgggaaggctcttgtcaaaaagacccctacccctttcttnttgtggtccccggcattagattgggggtttggaaggcaggtgaatgtctaagtaattgttctgtttgaactggaatgtttttgaagtctttggtgtgtccgtgaaaggctcgccactggtgctcataggtgtctttgcagacaataaatggcaaatacaccca

SEQ ID NO: 625919 - DNA, 373 bp, Homo sapiens
accctttttgaacccccgggaagatccccatcccggtttccccaatttttttttccccagttttttttatagggacttttaaaaaaggagattaagggggggggggctcccccctgtaatcccccccctttgggggggggaggtggggggttcccctaaagtcaggggtttgagccccgcctggctaacagggcaaacccttgtttttcctaaaaaaccaaaaattaggtgggcgtggggcgcccacccctgtgttccccgctaccccggagattgagccaggaaattcgcttgacccccgggggcaggggttgcggtgggttgagaggggccccccccccccccgccggggggccagagtgagactgttcca

SEQ ID NO: 625920 - DNA, 116 bp, Homo sapiens
tgcaccttgcattctgatggtcgatctagaggtatccccgttgggagcttcatggtcttcaatcctgcttatgggattgcagtctatgagccagcgcactgacttgtacccatgtt

SEQ ID NO: 625921 - DNA, 887 bp, Homo sapiens
ttcttttgttcaaaaaacagaaaacgggaaactagacaggcacgacagagggtaagctcccgtggcggagaattggtgtaggaaacccgttgagagacagcatctcggtaataaagggtgtcagctgccgtgttttaccaacggatggggtattacggacagaaagacggtccggtgcaggtaacggtcgtccccgctctcattaaaccgggagtaaatttggaacggccccccgtgcccgtttttccgcaggtcctctcagggtcccgcgcggaagtttgccgccccctgcgcggtccagggttatacttttagcacgagtcgtcgggccccggcccagacccctccccccggggaaccttgcgctatcacccgagaacgaagggcccccaaaaagaggcggttatcaagactgggctccctctccaaacaagccgatcaccggccccaatcaaagccgcttcggcgacgaacacacgtctttagagacgcccgcggtcctcctcgcaggagagtacaaaggcaaccacccctctacagaaggatcccccccaaaaaaccacccgacccagcacaggggggattcaacaacggaaagaagtgcgcacaggaaccagagtggggacaagacaacgcacacagatacggctggaccaacgacgccccaaagacagaatatgggtcgcccgcctgggcatctgccaccctgacaagcgtctgaaccctctgggaatctccaaacaggggggggcgtccccaagaaacaaatcaactgcatgaaacagaactctacgcacagactccggtttacagaaggaaaatagaccacgaagcggccctgggaaaaggaaaggagacaccattaaaaaaatccgggccacaaaaca

SEQ ID NO: 625922 - DNA, 119 bp, Homo sapiens
ttaaggatcccgtggaatcctcctgctgctcagcaggagctcaggataaaactgtgatgcatgtgagtgtgaacactcctgaatgaatgaccctgtgaggagtgatggccaatgaccca

SEQ ID NO: 625923 - DNA, 669 bp, Homo sapiens
  misc_feature (90)..(90): n is a, c, g, or t
  misc_feature (189)..(190): n is a, c, g, or t
ttggagggtgggtacttttagtgaaatgtcacttcaagcatagtggtccgagtctgccctcctgcgacctgtccactccctgcaggggcntgtgtcacagctcgagaggagctgggaagttgcctgtgtgtgctcaggtgtgaaatgcctgccaggatgcaggatgaaggaggctaacaaaggccttgnntgtcgtacgggaagtcagtcattcagtctgtggttagtgttgcaaaccctgaaaatactccacgcagagcagaagcaagaagcgccaggcacagggctcattatcagacaccatgtttaggaatgggtttggctttggctatctatacacctcctctggtttaggagtgagtttgaggaaagctggtgtttcacattcagtggcctgatgttggtaaccctgtgaaaggatagtacagtttctccagagacgaaaaccaagtgcgctttatttaacaacaggctctacgctagaacttgacctgcctaattgctgacacctatataaattactaatatatatatatatttatttacttatttatttattttccatctaacctttggaccatctttattccacaggaaagccatgacttccacaaaagcagctgcatagtaccacacagggcataagtttgtgtttggggctgaaacgat

SEQ ID NO: 625924 - DNA, 614 bp, Homo sapiens
gtgcgctgtatgtcctggtaatccggtccttcttcccggctctctaccatcttgcttgaatagcacaggcgatggtccctgaggcccgcattcggagtcaaacttgcggcaatgttgccgattatctgcagggttgttgcttgcagaaggacccaaagctagaaaaggaggccaaggacactgaccccttcagtgacagaagtgattgtattcaaagcagattgacctagaacgtggtgactgaaggcagagtagggcgacatatacaagatgtaagactgtcataaagtgtaaggcacacgactgaatgcgagtggacctaagtatgatgaagagccaaagcctgatgaaaagccagaagaggacgagaatctagatgaggaggtcaaagctatacactacaggcatctaagcaatgacgatgtgtttagagaagctgatgaaatagatgacataaggagagtcagaaacaaacttatagtgatgcgtagcaaccttaatcgtaaccatgcttaccgctatttatggagtttacctcgatttgtatctgatattaacattaccatgtagctcgcttcttattagcattcccggaaattccttcgaccacataa

SEQ ID NO: 625925 - DNA, 396 bp, Homo sapiens
  misc_feature (393)..(394): n is a, c, g, or t
  misc_feature (396)..(396): n is a, c, g, or t
gaaaaatacctgctgtcaaatgatgcaaataaaataatatggacatgcaaatacttaaataccccggatctctgagcctcttggaaatgtacatgaagcaatatcttaagagtataatcacaggccgggtgcagtggctcacacctgtaatccccagcactttgggaggctgaagtgggtgtatcacgaggtcaggagatcaagaccatccctggctaacacagtgaaaccccatctctactaatttttgtatttttagtagagatggcgtttcaccatgttggccaggctggtctcaaactcctggcttcaagtgatccacccaccttggcatcccaaaatgctgtgattacaggcgtgaatcacagcactggcctgaatctagggttaaannan

SEQ ID NO: 625926 - DNA, 443 bp, Homo sapiens
ctttttttttgagatagagtgttgctcttgttgcccaggctggagtgcaatggcaccatcttggcttgtagtacgacgagccacagacaaaactcctcagactccgagttaaagaaggaaggggtttattcggctgggggcatcggcaagactcctgtctcaaaagccgagctccccgagtgagcaatttctgtcccttttaagggctcacaactctaagggggtgtgcgtgagagggtcgtgatcgattgagcaagcagggggtacgtgactgggggctgcatgcaccggtaattaggtcgtaacaaaacaggatagggattttcacagtgcttttctatacaatgtctggaatctatagataacataaccaattaggtcaggggtccatctttaactaccaggtccagggtgtggccccgggctgtctgcttgtggatttc

SEQ ID NO: 625927 - DNA, 511 bp, Homo sapiens
cccaaaaagtaaggaagaagataacacctgaaatttcgtttttctcatgaattagatagggcctcttctgagggccattaaaaggagaaaaaacccatttctccctttgcctttagtccaaagaaaaaatgctttatagccaaatgaaagagaccctgaaatgcttctttccccgtttattgggtgaatggggatctatttgagtctggaaaaaactaatgggtttgataattagtttagtttgtggcttcaaggaaaccccccgtaaactaaaagcttccggggtatgtttatgttccttccatagaagaaaggccaaccaccccggggttttaaaatttgttattctcccctgaaaagaaatttatggagaagccacccaaatccttttccccccttaaaaaaagaaaatacccttttttggccccataatcttttgttttttaagttaggggatattttgttgggattttctttttggggggggaataaatctttttttttgaatgta

SEQ ID NO: 625928 - DNA, 178 bp, Homo sapiens
catactagtagggtcaaggatctgtgaaagggattggcagatgagggactctgaaaatcgtaggaaaaggacagtaataagtgcgaccaaggggtgctacctgtctccacgtcagtgagccagccagaggaatctcctcttaccattacaaattccagtggaactagctgtttgacct

SEQ ID NO: 625929 - DNA, 869 bp, Homo sapiens
gggaactttccagaacgctcggtgagatgcggaggagcggtaattaccccgtctgcgcacattcggcgctccttcccgctcctctcatacatcggacttcatgccgtaccggcagttgcagatggtgacagaaacaattactacgaatgttttgggggtcagacccacatgctactcaggcacgaattgagagaggcttataggatactgggctccgaagtaccatcctgataagaacccaaatgaaggagagaagtttaccagatttctcaagcttacgaagttctctctgatgcaagaacgggactatatgacaaaggaggagaacaggcaattaaagagggtggagcaggtggcggtttggctcccccatggacatctttgatatgtttttggaggaggaggaaggatgcagagacgaacggagaggtcccacatgttgtacatcagctctcagtaaccctagaagacttatataatggtgcacaagaaaactggtctgcaaagaatgtgatttgtgacaaatgtgaaggtcagaggaggtacgaaaggcagcagtagagtgctgtcccaatttggccgaggtactggaatggcaaataagaatccatcagataggaccctgatggtcaggcaattcaggtctgtgtgcctggagtgccaggccatggggaccggatcagcctaagaatggatgttacagtgccccgcagacaatcagtcgagaacaacactttgacgtccctttgcccaggctgaagatgccacgtacttctgcgaggcgcccaccggtggccggcatttatggggatcgacaccctcgtttccggaaccttgttacaacgtacgtggccacacttctcacacgt

SEQ ID NO: 625930 - DNA, 407 bp, Homo sapiens
  misc_feature (35)..(36): n is a, c, g, or t
  misc_feature (98)..(98): n is a, c, g, or t
gcgtcgacctgcactccaccctgggtgacagagcnngactctgtctccaaaaaaaagaatggctaaaatcaggaagagcggcagagacacccctcacncccaacccctcaaccttatattaccttgaaattccaccgatgctatatccgggtttgtttgcaactttcaagtgggtattatttccgttggctttggaggaatattcttgtgatcacgcaatcaaccatcatgatagagcctcatgcactgtttaggaaccagttttcggaaagaatcaagatctgtgagtcattctctcatttatctacataaaactattggaagaagcagctcattaagctaaaatgtattccatttctctaggcgtatgaaggcatcaggtgacagcactgctgccctcagggtct

SEQ ID NO: 625931 - DNA, 112 bp, Homo sapiens
catatgttggtcgatttagaggatcccagtgctaccacaaacaggagttattgatgttatacactcccttccattcaggattttctgcttggagggaaactatgttgatcct

SEQ ID NO: 625932 - DNA, 254 bp, Homo sapiens
aaaggttttttgggctgtaggtttattcaatgcaaaaagaatcctctccaattttactgaggtggctgaccacgtcacgacccaaatccgcctctaaactggaattcggttgctgaccccagcccccagccctcgggcttttctttgtcgggcacccagggtgggcacagcccactcccgtctggtagggtatctctgggtcaagccctcccctattctgtcggtctttctcggcaagcccggtattagataag

SEQ ID NO: 625933 - DNA, 415 bp, Homo sapiens
tggatagggagaagagggtatggtatgtgggtacagggtagggcctgaagtagccaggaggtccctccgtaccctggcttagtcatgtgatatgaaaagtctgctgaatatggccaggcgtcttaagttgtccaagctcgggaagtctgagccactgtgtctgctgctgaagctgctcaggtagccctcttggtccaagagagaatcttaaggcctgggggaagagtcacctatgtgaggggactcgcacatgggccgaaagagtaaggtggtcgggaagccacccccggacagccccatgctagggccaaagaggcttgccagctcctggctggagaaggcaaaagggttattgtgtgccatcggacagtgtaggtgagcccaggaggtcatcggcgctcagtatagggggtct

SEQ ID NO: 625934 - DNA, 336 bp, Homo sapiens
tgttatggtagtaatgagggatcccttttcttaacctgcaaaaaagtagaacatttgggttgggcgtggtggctcacactgttaatcccagcactttgggaagccgaggcaggcggatccctggggtcaggagtttgagaccagcctggccaacatggtgaaaccccgtctctactaaaaatacaaaaatagccaggcatgttggtgcacacctgtattcccagctacttaggaggctgaagcaggagaatcgcttgaacccgggaggtagaagttgcagtgagccgaattgagccactgcactctagcctgggtgacagagcgagactctgtctc

SEQ ID NO: 625935 - DNA, 573 bp, Homo sapiens
atatataccagaatttacttccttaacatatatgccttcctcaaattaccaaatataatttattttattaattcaaaagtaaaaatattcatttgtggtctcatcaggaatgagtttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctggttatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaa

SEQ ID NO: 625936 - DNA, 206 bp, Homo sapiens
actggtccacacgccaccggagaagggggtctgagccgcagatcctggcaccacagctcacagcaacaccggatccttaatccaccaagcgaggccagggattgaacctgcatcctcacggatacttgtcagatttgtttctgctgagccgtgacgggaactccaaggacttaccttttaacacacctttccgtgctgtggaccgt

SEQ ID NO: 625937 - DNA, 119 bp, Homo sapiens
gtgactgtggccagcggacacagctctacggcaaacggacgagaacttgtggccaggcggaacggacttgtggccagcggaaacctaaggcaaccggacgacgaactgaggcaacgcga

SEQ ID NO: 625938 - DNA, 111 bp, Homo sapiens
cagcaatgcaggatccgagccacatctgcaacctacaccacagctcatggcaacgccagatccttaacccactgagagaggccagtgatcaaacccgaaacctcatggttc

SEQ ID NO: 625939 - DNA, 818 bp, Homo sapiens
ggagcaaggctagtgaagggcgggcagtaaagggcacgctgcttgtgtgggtgactacaggttaggagatccgttgtaccctggaggggcctaggatggactcccgtggaaagattcttgagtacgtgcgcgcgtctccctggcgccgatcgttcacgcctacacgcggcgggtatattctgttgcagattggtcccaggacgctgtttccaagactctgggcaccgctcgctagcgttgccgtccgcgtccatgggtattagtaagagtgatgctcaataggaaccccgaccccgcggtgacactactcgcaattcctgggtgactttctagatcgttctggttgaacgcgtgcgcctttagatgacacgaagccatacgcacaatacccgtgatttccagcggatgcccgggcctggagcccacagaattcttccagatccctgggtggggacggagaaagtgaacgttcagattgagatggcccatggaacaacacgctcgtcttcaagttccagcatggagtgattgcagcagtggattctcgggcctcagctgggtcctacattattgccttaggggtgaacaaggtgatatgaggattagcccttaactgcttggtaaccatgtctgggtgtgcagcagactgtcagtactgggagcgcctgctggccaaggaatgcaggctgtactatctgcgaaatggagaaccgtatttcagtgtcggcagctccaagctgctgtccaacatgatgtgccagtaccggggcatgggcctctctatgggcagtatgatctgtggctgggataagaacggc

SEQ ID NO: 625940 - DNA, 402 bp, Homo sapiens
ttacaacagctcaaaacttagctgcgttctctttatctgaaaatatactatttacctatttgctaagggtattagtctttgtctgccatttagaatggtgtctagaatgcaggcatttctctgtcctgttcctgctgtctcttcagcatctagaacagtactgggtatatagaatgctcctgataaatgtttcgaacatatgaataaacattattcactttctttctataagacctaactgttacattctttatactttactttcagatgtacattattacattgttgtaataattactattttactagttatgcaaatagatagcctcatccatatccaggatacatacgagaaggatgattctcagaaagacacctccgaaaagggtcaaactatctcag

SEQ ID NO: 625941 - DNA, 292 bp, Homo sapiens
gattgcatttagacctagtatgggcaacaaactgagaactgtctgccttaaaaaaaaaaaaaaaaaagggaaaaaaaaaaaaaaagaaagataacacttccccacagctatacaagagttgtcatttctgtgcattttcaatggaccccttttactttggcccacattcttaaggcaaacacatgtgggcatttaatagtcgggttaaaggtgcatttattaaaaagcaagatggagagatattcctcattattttttattacccatttaaatttccccaggaatttggctg

SEQ ID NO: 625942 - DNA, 135 bp, Homo sapiens
caattcctagagttaagagacccttaaaagattcccgctcatgctaaaagtatgtaaagatcccatgtccagtatgaaagtgtactttttttaaaggcctgtcaatatacaaacctttaaagattaaaaccctta

SEQ ID NO: 625943 - DNA, 435 bp, Homo sapiens
caccgccagttacaactatctgacacctgtaatcgcagctactcaggagactgaggcaggagaatcgcttgaacccaggaggcgtagactctagtgagccgagatagcgccactgcacgtccagcctggcaacagagcgagactctctctcaaaaaaaaataaataaagtaaaagaatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatggtggggcacaacttgtggctccactattgggaggctgaggtacatcacctgagcctagcaggtcaaggctgcaagaaggtatgatcacaccactgcactctagcttggg

SEQ ID NO: 625944 - DNA, 101 bp, Homo sapiens
gacgctggtcccccccttatgccgtggtggggggaggtggcatgcgtgggcttgcttccctttgtggagttccccatcatcatagagagactgggatggtt

SEQ ID NO: 625945 - DNA, 159 bp, Homo sapiens
actgtgagctaccttggaattagtaaacagtggggaaaaaaagaacacaatttaaaaatgacctttaacattatccatatttatgaaaattaacaaaagaaacagatggatattctctctgatgacatctataaaactgtaatttatatcttatttgcc

SEQ ID NO: 625946 - DNA, 351 bp, Homo sapiens
tccggaaatggagtcaaatagatgtatgtgtttttagtcttttataaaagggaaattcaaaattagtgggaagtgatagcatattcaaaagtgatgaggacaatttgatcagggaaaaaaaattgacatcctacacttattacgtatatcaaaataaatttgcagatgaaacccaattattggaggaaaaaaggaactatagttgtgaataagataagggcttacttagaaaatactatgagtatctgggtgataggatcatttgtaccacaaacctcatcattatgcaatataaccaggtaacaaactttcacatgtaccccaccaccaagctaaaataatagttgaaat

SEQ ID NO: 625947 - DNA, 355 bp, Homo sapiens
  misc_feature (334)..(334): n is a, c, g, or t
acatcaagttttctttaaagtttacttttttagaagcttcctaaatagttgaacataaaatttctcaaattttcctcaaagtgtgcatttcgcttactattttctggaatataggaaacaaggatcatgggacagcacgtctcactggcatttacattcactgccccaaatcagaaccaaaccactgttcaagtcttctgtaagaacactggatttgggtccctgaggtgctgataaaattttattttttggcttacataattattatatgggcattcagtaattgttggactttacatgtgtggactttatgggattttgcaattgtatttcncaataaaaagaaacaaaaggc

SEQ ID NO: 625948 - DNA, 303 bp, Homo sapiens
  misc_feature (207)..(207): n is a, c, g, or t
ccaccacataccctcatacccccacacctcaccctcacacccccacacctcaccctcacacccagggatggtgccactgcttccgcgttccgcctgcccttagcatccccagagccaggaaggaaacctgccgcttgtctgtctggtcctttgtctctgtgcttcagctgatttgccccagcttgtgatcatgtttacactgcctgntgtagggccaaggtgagggcactcaactcagagcttctttaattaggcatcacttctaattgaatttcactcaaggaaagtagaacattcttgtgg

SEQ ID NO: 625949 - DNA, 442 bp, Homo sapiens
agctgcagtgcagtggtgcaatctcagctcactgcaacctccacctcctgggctcaagccatcctcccacttcaagagaagaaaatgcccccagcccagtggtgttctgctggagatcagcaggaaaccctactccatagtcaagtcagccgttagcctttcaggaagttcttcctatggtgaggcctcctcaagatatatatatatacatacgtgtatatatatatacttacgtatatatatatatgtgtatatatatatatatatatacacacgtatgtatatatatatacacgtatgtgtatatatatatacgtatatatatatatttattttaagaggtagtctcgctctgtcaccctggctggagtgcagtgagcagagatcccaccattgcatcccagcctgggcaacagagcaagactcttatctcaaaaaaaaa

SEQ ID NO: 625950 - DNA, 135 bp, Homo sapiens
cagctcgcgtacctataggttggacgagtagtggtaagccttgttgtttgttggaaaggtgctaacaaagcccattatctctaaagggactgggggtaatgacgagaaattataaacagctataaagttattata

SEQ ID NO: 625951 - DNA, 182 bp, Homo sapiens
agggaccacagtggctgactggagtgtagcatcccacaggaggtagcattcccactaaggatatcctcacttaggctccaagctatacaatgatgtctattattcttctaattcagtaaggaagagacttttctggttagtaatagttctgtaggatttcttttctatttttttttccggtg

SEQ ID NO: 625952 - DNA, 113 bp, Homo sapiens
aaattgcgccactgcactccagcctgggtgacagagcgagactccatcttaaaaaaaaagcaaaaaaaccaaaaccaaaacaaaacattaacactaatgatagctgatgagct

SEQ ID NO: 625953 - DNA, 371 bp, Homo sapiens
ggcacgagcgctctctctctctctctctctctctctctctctctctctctctctctctctctctctctctctctctctctccttccttgtagcacagatttgaatactattacaactacaggaatctcttcaactacactcttaatgccgaaggtcctgctccccttgaactacccaaccagtggctatgggagattatcgatgagagcaactaccagagacaggcattcagtcactaccgctgtaagacatggcaagaagtcacaggcagagaatgactctctttgagtccaatcccttcaacatcaaccgacaggtgtgaggtatacacgcggaggcgaccccgagagtgtggctggggagttgggccg

SEQ ID NO: 625954 - DNA, 418 bp, Homo sapiens
aaagtcctagctgcaaacgtgcatgcttgcttgtgggcgatatcatagaatctgttgattactatgagcctgtatgaccgttttcatgatattgattcttcctatccatgagcatggaatgtttttccatttgtttgtgtcttttatttccttgagcagtggtttgtagttctccttgaagaggtccttcacatctcttgtcagttgtattcctaggtattttattctctttgtagcatttgtgaatgggagttcactcatgatttggatattattggtatataagaatgcttgtgattttcgcacattgattttgtatcctgagactttgctgaagttgtttatcagcttaaggagattttgggctgaggtgatggggttttctaagtatacagtcatgccatctgcaaacagagac

SEQ ID NO: 625955 - DNA, 1753 bp, Homo sapiens
caaccgaacccatctacatcaccgacccgaccttagcatctcaccatcgctcttctactatgaacccccactcccacatacacaagaccccatggtcaacctcaaactaggacctccataataatacatagacacaccatctagaccatagacacgacacatacagatccatcgtgaatcaaggatgagcaataaaaaacaaacaacagaaacctgactcggacagcaccagaagaaaacagaagcaacaagacaagtaaacaatagtgacaagatcagcgcaaagaacacacagacaaatacatacataagtagcagaaacaaagacagaaatacagaagagccagtcacaaacacagatcacaaaacagaacggcagacaagaacacaagacaacaccagaagacacataaacacacatgacagaagcaagaaaccacatagagagacaagccagacagccaagcacaacacagcatcacaacagagcataaggcaagagaagcaccaaaacgcagcacacaccaaaacaatacagcaaccaatagaccgaaaagagaaagaaaatacagacaaacatacaaacaaacagagaaatacaaaaccgacaggaaacaataccagagaccgcggcagggaacaacacaaacagccccaacaaataacacaccagagtacgaccacaggacaaggagaacagcagagcccataccaccccaaactgaacaaaagaaggcaacaaagccaagaccacaagaaccatccaagcaccacggaagcgacagccgaccggaaccactgaaacggaaacagaaaaagcagacacgagaacaactacaaaaagccaaaagcaactaacgaaggggagcaagactgaaaaggacagcacaacacgaacataaacagcacacaaaaagagagaaataaaaaagaaaacaacaaacaaccagaggaaataacaaccagaggccagacacaacaagacagagaagcagaaaaagccaacgaacaacgcaacaccgcaataacaaaaaaaaggagaacagctcacccagcagcccaccagaaaagcgcatagcccacaacacacggaaaagacagacaagacaacacaaacgaacagacgtgcccagagacaacgagcacacgaaacaaagaaaaagaagaaagaaaacagacaaagaggagaaacgcgaaacagagagaaaccaaacgcaacatgagacacaagagaaaaaagacacgcaccgaagaaaagaacgagaccgaagcatgccaacagacagagaagaggaaacaatagaaaacagagctagcgaagaagcagagaagcagcacaacagaagcacagcgacagaagcacaacacggaacgacgaaaacagcaaagaacacacccatacacaggagctgcacataggagacagcagcgacgcagcacatagacagacgaggacaacatcagcgagacgcgagtgagatcgagaagcagagacagaacagacacgacgaactaaacagtagctgacatactgatgacagtgcccaacagcgaggagaacggagatcagacagcgaaggagagcagacgacgaagtaaagcgcagaaaaagcaccgcagaagaacgacgaaagacagaacaacagaacaaggcgacagcgaccgagacgcgaacgcgacacgaaaagacaggcaacaccagaaggtagagcacgagagagagcacagagagacgagagcacagaagcagagg

SEQ ID NO: 625956 - DNA, 975 bp, Homo sapiens
aacggtggctcacacctgtaatcccagcactttgggaggctgaggtgggtggatcacctgaggtcaggagttcgaaaccagcctggccaacatggcaaaaccacatggctactaaaaatacaaaaattagtcgggtgtggtggtgggcacctgtaatcccaactactcgggagtctgaggtacgagaatcacttgaacccaggaggcagaggttgcagtgagctgagattgtgccactgcactccagcctgtgtgacaaaacaagactcctcctggaaaaaaaaaaaaaaaaaaagggaacccggaaattcggtttaccattggtaaggtcaaagggtttggaagagatgtcattcggaaggttcaagacctggtgggacaggcgcggatgggagatcctccagcatgtttggaaacactgttaacgtcaacgccagggtcctttggtaaactctccaaggttggtacaagagcgctttggctttgggccaggttggtgtccacgcctttgggcggttaaagtggaggagactttgggatataacggtgggcacaattcggctctccattggaaattggactgggcgatccacactaggtcaggcatttggacgtggcgcttaaacattatacgcggggggacagggggcgtattctttacaagggcgcgtaattggaggatccgggggaaattttctaaacgcgcggggcgtcctccccccacggtcttcagagtatgtgcaggtgcggcttcacagaggggggacccaactactggggcggcggcacatcggacatgcggcatgtgggtttgtgcgaacccctcggaaaacgtggcccttttggggaagcggcaaatcgggggcgacaccccaacccatttaaagtttttttcacttagcgggccaagcgtgtgggccaacacccaccgtgtttacggccatgtgcttgcggcgtctgcatgcacaccagcgc

SEQ ID NO: 625957 - DNA, 117 bp, Homo sapiens
ggacataattgacttcatatcagcgttaaagtattgctaactttatataatagcatttggtttggggatatggtgcatttcccggttgtagaaaggatagctatattatgtgagaca

SEQ ID NO: 625958 - DNA, 1035 bp, Homo sapiens
gccgaattggcactttaatttgagcatccctgggggcctgggctgctgacagaagggctctctctgccctccactccaaagtgggtgcccccccaccctgtggccaggacagggagggagccgcgtggtcgtgctgccggaggtggtggctgcacgagaggacgccatgacttgctgttcaggcccgcgacgaatgtcccagtgtccccgttcctcactcgtttgtaagtcgccgtctgtttgttctgggtaaggaaggcaatgatgctatagagtaaagacgtataaactaataataactttaatgtgaatgggttctgagctcatccctgcgccccgggcgggccaggccgagcattttgcacttaatgtgtcccactggtgggcgtgagtcgggagtgtctggggacgtgcgtggtttgctgatgcggatccggcttgttgtgtctcctcgtctctacgatcactgtatagtgataccggttggcgagcgggggtcgtgcaggtgcacgcggcgtcaggaggggtcactttcgcatgagctgctcttagctatcactttcgatcgagtatgtccaacacgggataatcgaattaggaaagtcggaccgcttgccctctctttgattcacacatgatgactagtcctagacatccggggtcgtcctggcctgtgagtggtgacccttgagtcatctcagaccctgatagtagtagagacgaggctcactcagtcatcggatgagcatgttctgcgagccatttaatcccttaagtcctgactaatgagcgacgaccggcattatcctattattaggacagtctacttacagaagctacgcttattctataaaacccttgggacgagcggacgcgaagggacctggacccgtgctgggagcgtgcccggcagggcagagtaggtcgggcgcagggagtactagccggcctctctgtcctggcgtcccctcttccccgaaggggaacgggcccagcgagggcgacggggagcgagggaaagggcccacacagagg

SEQ ID NO: 625959 - DNA, 908 bp, Homo sapiens
gctagcccgccgcagcccgggcgttgaaggtagtaaagcggccaccctggccgcatcatggtgaccccactgtcccaccagcccctcgatgcccctgcctgccctgagcgtgggagtgctgggacaactgaccatgaaccttacgctgcccctggctgaagaacgagcaggctgtccgcagcctccggagggaacgcagccgctgccatccccatgaaaccctgtgcccgactcccgggatgactcacggcattatgcgaccatgtatcgagatcccctcatgctcctgtgctcaggactggctgcacgagcatgccccttctagcggctgcgcgggctgcgtagcacccacatgcccctgtgccctggacccagaaccactgtaggacgcaagctaagatactacaagaacctttcccgactgacatacggagccacgacgctgcttacgaccgtatccgcaagtgcgccagggcagagcccacattccatccctgctgggcagagcgactggacactggacagcccatctacgctgacgcgtgcatgggtatgacgaccactgcatcacagcagctcgctcggcatcagttccatcttcgactcgccatggcctcttcgtcacttctccattgcctgtgctccggcgccttcgcgaacgcggcctcgggtgtaccacgtggtatctagttcccaggggatcgccaggaccccctgaggcttcggagagtccaacaaagacgtggcccagctggcacgagcgcgcgcttcacacccgcggccccttcgatatctacgagccagggaagtgcgcccgcaaaaacatgtgtgagtgccgttaaggaccgtgcctctgactggggaaccttggcccccaggtacacacaacatgcctggccctaacttgg

SEQ ID NO: 625960 - DNA, 143 bp, Homo sapiens
ggatatggcatgtacaccgtgtctaatggaagacgagatacaatagactcgatagatggatgcttgtttcaaaggtgttctctccctctacacgaaggcagtacagccagtactcctgctctgctaaccctgcgtagcacacg

SEQ ID NO: 625961 - DNA, 134 bp, Homo sapiens
gattgttatgtaccagttacttatttgcttaactctacgtgagagaaattttaaccttacaaaaaagacagcagtaggatgaacccttgcatatttattcaccttactgtggcccctttcattattattttaaa

SEQ ID NO: 625962 - DNA, 198 bp, Homo sapiens
  misc_feature (32)..(32): n is a, c, g, or t
  misc_feature (63)..(63): n is a, c, g, or t
  misc_feature (170)..(170): n is a, c, g, or t
gacctcgtttttcatcctattatggcgtttancaggctagacagaaacacgccttaactttanttgccacaaatcttaatattttctccactaatattagaaaggaagcaacaaataatgtcgcttttcacctgacgtctggttcaactttccgcccagcctattcctgngtcttcctcctgcctttctaatgtccca

SEQ ID NO: 625963 - DNA, 393 bp, Homo sapiens
cttacactgttgttctttatttttaacattattattctttcctttttgtctttggttgtctctttttgtttcctctgttcttctgtttcttaccttctgaatctcacaggtatataagtgcctttaagagactcagttacctgtgagagcataaaaattagttcctaatacgaactaattaaaatcataattaaacatgaaaagccactctcatcattaactcttaagttctctcagtcttttcttttctctgcttctaaagaggatttgagatttctttgttctatttcctcctctctgccagcctcttaggaaggtcagccttgctagctaattcctttggacttgcagctgaaggattctgaataaaaggtcagtggcccattgtttggc

SEQ ID NO: 625964 - DNA, 114 bp, Homo sapiens
aagcaactaatgttagtcatcagtacaccatgaaaacattctcctccgcataagcctgtgtcagctttaacacaccactgacactgcaccacattcaaccactcccaccttcac

SEQ ID NO: 625965 - DNA, 133 bp, Homo sapiens
  misc_feature (6)..(6): n is a, c, g, or t
tgggcnggaattctttttattaaaatgggcgggcgcgggcagctttaggtgggctggttcaactttctggagttcccattaaactgggttctaagcgggctggttcaacttcataaggaagcactcgatgtcg

SEQ ID NO: 625966 - DNA, 536 bp, Homo sapiens
catcaacattctcactgtgcctgggtcaaccgaatacacggagagagagagccttcgagaggtgcggccggcctatggacccctgaccgcctggggtggctcagacacctaacgcgtggacagagctatgatgactggactgagaaaccgcacgcctgtgacgggcttttagcatgagctagtgggaacctggcgagcgacattgtacccgtgcccagatccttgatttacactattcagcgttctctgagaactactcatcaatgaactgatactgaaggtcggaggctctctgcaatattgttctgaccaactactgcatgtgtgtggcgcgtatttaaactcgggccgtagcggccttcgacgtcatagagagtgatgagtgtaaatattttgcacttagagtgcagagctatacgtatattgagagtgtacagcgatactctctgaacattatgagatcctatgcaccatggtctgcgtgcactatgaatttcctctctgtatgaggaccgacacttagatgggctccgctt

SEQ ID NO: 625967 - DNA, 163 bp, Homo sapiens
  misc_feature (155)..(155): n is a, c, g, or t
gtgccgcacttggtcgctcgaaggcatatatatgaaatttcacatgaactctcagttgctcaaggaccatgtgccaccttctcgaagctcatggacccaagaaccccagaggaatctttagcatgaccgaaagaatagcatacattggggttccngttgccgc

SEQ ID NO: 625968 - DNA, 215 bp, Homo sapiens
agcggcgccttttttaaaggcattcttggtatcccagggggagagttagaaaaaatttacaaagcatcggcggaaggcattttcaattattccggggctttaccagggctattactttctggatggtaagaattttacattttcaaatatgctttaactttacaaggcattaagaattacggttttaagattcttatgagggttttatctcactt

SEQ ID NO: 625969 - DNA, 101 bp, Homo sapiens
  misc_feature (1)..(1): n is a, c, g, or t
  misc_feature (78)..(78): n is a, c, g, or t
  misc_feature (85)..(85): n is a, c, g, or t
  misc_feature (89)..(93): n is a, c, g, or t
  misc_feature (95)..(95): n is a, c, g, or t
  misc_feature (99)..(99): n is a, c, g, or t
nttcaagagccattttttaaaaatgagcaataaagaacctctatcagagacttctcattttatagcaaatacattttngcagcgnaaannnnngncaanga

SEQ ID NO: 625970 - DNA, 1520 bp, Homo sapiens
tatggcgtcctcgttttgtcttcgggtgtctcgctcgtcgtcgttcgttttctgtgtcgctcaacatcttctgctcctccgctctttgcggtgaccagtgtccaaccggcgtcccgctatctgaggtgcctgtcttgttcttcttgtcggtcgcccagtatcgttctgtccacactgctttgcaccttcggcatcttcctgggtggttgcccctagttctgtcgtggcggctttctctctcgggtagtctcctttgtcgcttgcctactgcgtgacttttctcatcgcgtgccacgggaccctgttcccttggtttaccacctgacggttcggctacatttgcgtttctgttgctctttttgcggctggctccgtttcgtgcggttcgtcttggtattctctccctgcggatgtgtggtgagctgcctgttaggctgctcttgtttgctcctcttttcttcccttctctgtgtgacttgtcgtccggggatggtgtcgtcatttatggcgttggttttggccgtttcttcctcctgcttcttgttgtctccgtctgtgtctgctgtctggcatgggtttgcggccccccgttctaccgattttctgttcgcggctatccgcctggtctgccccacgtcgggtgtcttatgtccttatgtttcgttggatgtctgctccccggtcggtctcatgttgtcttcgcctttgtttgtggagtgtgcgctcgtttgtactcgcgtacgttccgggccttccgttgactcgttgtctttgcttgggatggaaggatccatctaaggtggctccctggtgagtgtgtactcgcgtagtctggcttgatgttctctggtatgctgatcttggatgcgctttggagcctctggcggtgctgtcgcgtgctgtcccgtttagatggcggatgagtactgcttgtgccctcggccacgtagcccttggaccctctggatgtctactcctatacggcattcgatttttcccctagttcggatacatctgttggtgcgctagagcggtttctgtgcgagttgtttagcaatgtcttgactcgactgtctgtatgattgtttatgcatccatttcctttggtatgcgttacgttgacagtataacgatccatcagacgacatatggcacaggccgtgctcacaaccatgcgtgagtgacaccctgtcagataagagaggctgattgaagccaatggtacagttacagtgatagagtccatgtctatgatagtgtaattatcaaatagcgtaacgaagtacaggcaccaacatatctgatgacaataattctatatctttgaatccgcaaggtgcatgacgtggctggaatgctacgtttgtaggaatcacgtccagatgtgagttgtttccaatgcaacctcacctgaaactctatataatggaatacatttttctgtgaaagggtctgtataatcattttctaagataagtatgggtatctatactaagtgtttttacatgaagacactaggt

SEQ ID NO: 625971 - DNA, 404 bp, Homo sapiens
ctttttcatgtaaatatttttatgaagtttttagtatttaaaaatgttttatctctttaaatcattttagtatgtcacatttatttatttaataattattcatttctataagtttattattttttattggtcctctcttcttatctgtagctcagggtgggtttccggtgtacaagtacgtcccgtatggtccagtgaacgaggtgatcccctatctgtcccgtcgagcacaggagaaccgcggcttcatgaaaggagtgcagatggagagagaactgctgtggaaagagctgatgaggagactgagcagcggacagatcctctacacaccacctgtataaaacacacactcctgctgtttattcctcttcacccatccattcataaatctatttatattctca

SEQ ID NO: 625972 - DNA, 634 bp, Homo sapiens
  misc_feature (455)..(455): n is a, c, g, or t
  misc_feature (461)..(461): n is a, c, g, or t
  misc_feature (479)..(479): n is a, c, g, or t
  misc_feature (492)..(492): n is a, c, g, or t
  misc_feature (501)..(501): n is a, c, g, or t
  misc_feature (556)..(556): n is a, c, g, or t
  misc_feature (562)..(562): n is a, c, g, or t
ggtcaggcggggatacagcctggaaggtaatgcatgtccatggtacacaaattcacaaggtttgtaaatgagaaaagacgtgaggttcctttgttctttacctgtggcctccctgccctacacggggactctagggtggaatgtagcaaagcccatccaccagctcatgatacataccccccaacctcggccaggctggtagcgacctgtgtctggggagctcgagccccagctttctcgcttgcggtgagcccggactggggcacgtcactgctgcagactcccacgcttgcgtgtgaggcggagcttcccgacaagaaccgcagcactccgcatccttctccaaccacttcgtttcatgccttgtcctagacagtaagctggggcccagcggaggtagcagcagacgcctgagagcgaggccgaggcccctcagggtttggagaccctgacanacccancttctcacctgggctctncgtatcccccagncttgagggnagatgaagcctaaactgatgtaccaggagctgaaggtgcctgcagaggagcccgncaatgngctgcccatgaatgagattgaggcgtggaaggctgcggaaaagaaagcccgtgggtcctgctggtcctcatt

SEQ ID NO: 625973 - DNA, 778 bp, Homo sapiens
taggggtttcatgtgcgcagggttgtatgtggtcgacagtgtgttcgcggtcctgtgtgcgggcgggaccctgtggacaggcgtcgggacggggtccgtatggtccagcgggtgtgtgggggtgccctgtctccccggggggaaggtgagtgagcccgccgtgcgggagccggttggtgtggcgccgggtagccgggcgggggtgtttccacggggccgccctcggcgggtgttctccccgggaggggggtctgttgcgccaattttgggggggggagccccctgggggcccccctgtgtccacatcacgcattgagagtgggtgcaccgcggcagaggatgacctttcctgttagttggcccacaggacgcgtttgtatatcgcgcgttgacccacaaacggtgttgctgtcaggctacttcggctgcagtctaaacgtcggggcacgccttgcctggccagtcagggtcgcgccccgccctatgtgggggaggcgaatataattgtcaaaactctgcccctcggggaagctcgttcccggcctcaacaaaggtttcaggcgcttcaggagccccccccaaaggaggcggtgtttgtattggaatctgtgggcaataagaccgcgcccatcgtctcgggccaaacacggcgttgttaggagtgtgccccccccagtcttggtctcatgttaagcagttgtcttatgctcatctaagaagaaaacctctttcagtgagcggggataactctttaaaataaaaaccacaacaacaataa

SEQ ID NO: 625974 - DNA, 264 bp, Homo sapiens
gtttgtgtggcacgaggacggcacttcgcgtgcccatgttctcaagcgcgagtacaccccccgctactacgacatgatgaaggcgctggaagacctgaccggcaacggcgtgtcgctgaacacctcgctgaaccgccgtggcgaaccgatgatctgctcaccgaccgatgccctgaacatgttcttcggctcggacctgcagtacctgatcatggaagacatcctggtcgtgaaggacggcgccgccgcctatgaccagccgct

SEQ ID NO: 625975 - DNA, 108 bp, Homo sapiens
cggtggtcatgtatccacctccacagggggcgagctgccaaacaaggggtacacatgtgcccccttgacataggccaggtggtctctgccctctgtagctcccatgag

SEQ ID NO: 625976 - DNA, 256 bp, Homo sapiens
tgtagtcatcacttgtgagtggtaacaactcgaccataaaaactgataacagttagaaaacaacacagtttatcgttgataccctgtggagagaattttgaagaaaccacaggctgatggctgaaaccatgtcatactgtctgcaactttacagatggtgcattggttcagcatcaggagtgggatgggaaggaaagcacaataacaagaaaattgaaagatgggaaattagtggtggagtgtgtcatgaacaatg

SEQ ID NO: 625977 - DNA, 329 bp, Homo sapiens
tctagaggatcctgatccaataacacctgttgcaaatggatcacaaaaagggaccagagtgagccctctggactcttaccccgccctgtctctggcttgccgtgtgctctctactgcctggtgggggtgggagcaatggagcacctgcagttccctctgggctgtgagctggtttggggtttggaggagagtctatgtgtaacgcggaggagagtccttcttaggaagacttggagctagggaagtgtgtaggatggccagcgccagggaaagtcgaaaagggagtgctgatgggtccatgggctccgtgctacagaccatgaaggtat

SEQ ID NO: 625978 - DNA, 1415 bp, Homo sapiens
  misc_feature (240)..(240): n is a, c, g, or t
  misc_feature (324)..(324): n is a, c, g, or t
  misc_feature (786)..(786): n is a, c, g, or t
caatctgtggggggggaattttaagttccccatctgcccacagggggggagtattcctctggcacgcgcggaaattcttccgggggggacaccaaccatgcacgaccaagtagctgggtcccctacgccccgcccacaaaaaatgggcgcgtgtttctgtttaataagcccgggggaatccttctccacgccccgcagaaaatggctctggtttacgaccaacaatgtgttgtgccgctncaccaacctggggggggttttttataaatgtttggtgaagggacaattataggaagagaacgtgtgtgtggggccgcccccccntgggcggccgccaaaaagttggcccacaagccacccacacccctgtgccaactaggcctaatgaccctccttcccccccgcagaaattcctgggggggaaataaaaagcgcccctctttgtcgcagaaaaaggaaagaattttgggggtccccctctcgaaaaagcgctcgtgagtgatatctcctcggaagtaatatcccccggcccacctctcggggaaatttggattagtagaaaagaacttgttgggtttgccctgggagattttttgaggaacacccctcctggtgagatttagagaaaaggttttataacacctctgtgttgtcccccccctctggggtaaatattttgtgttttaaaaataaacacccccctgggtggaccacaacaaagatttctctttgggagagtgtctcacacccgctctctatagtgaaacgcttctgtggggcttcttngggtgcacactcttctgtgggcgtctataacgggttataaagaaaactgtgggtctcttgtgtggagaaaagacacacacagtgctctctgtgggggctctttggtgtgagagagtttctctgtggtttgcgcccaccgccacgcgcgcttctctcagagattctctgtgcacacgggcgtgattttaacacgtgtgtcacacggggctcgaagttgttttctcgggaattttcttctatagagaggctcggccacacgaaccccacagtttgtgtttggttctcttgcgggttctctgtcacacgggtttggagaaagttcccacaggccgctatggagacccacgttcttcctctttcttaagcctagaatgttctttggcccacggaacacccgctggggctgttaactctggctttgagagttggaaagccgcgtttgcacatttataccgccctgtaaaagtattcattctttaatttatgtaaggtgtttttttgtaccccaattctctgagttcttttgaagagatgaccacaccaaattttggttttctacctgttatgtgagacacccttaggccccagccacacgtcattgtgtaaggaaaaataaaagtgctgccgta

SEQ ID NO: 625979 - DNA, 416 bp, Homo sapiens
acagcaataggtatggtgtcgagtgagggagtgagggaagcttcgtctgtatttacagacactcccctatgctcacattcccgcctgagctccaccttctcagatgagcagcagcattagatgctcataggagaacgcaccctgttgtgaaccatgcatgtgagggatctaggttgcgctgtccttatgagagtctaatacctattgatctgtcactttctcccatcacgctcaggtgggaacatccagttgcaggaaaacaagcttaacacgcccactgattctacattatgacagggtctccctctgttgtccaaggctggagtgtagtagtgctatcgcagatgactgcagcctcaaccttccaggctgaagcgatcctcccacctcaacctcccaagtggctgagactacag

SEQ ID NO: 625980 - DNA, 696 bp, Homo sapiens
gggatcccccgaacatgtcgtgctgaggcaagagaactgctggaacccaggaggcagaggctgcaatgagctgagattgctcactgcactccagcctgggtgacagagcgagactccatctcaaaaaaagtaaataaataaaaataaaataaaacaggactctaagtttaaaaataccaaagtagccaggcatggtggcacatgcctgtaatcccagctactcaggaggctaaggcaggagtatcgcttgatcccgggagacggaggttgcagtgagctgagatcgtgccatggcactccgcgcctgggcaataaaggtgaaactaccatctcaaaaatataaataaaaatatcaatactttccccatagggctctgtgtgaacataggaaccccggacacataggtctcatggggaccctaaaatagtctgtgctgtcacatagactagtacctgttccttccaaacatgtaacctttaataattgtgacattttgcaatgggaaagggcacaaaggagggagaggggagtcatgctgtatatactctaaaatgtgatgtgtgtggtgtttctctgcgctgtgtcacacctctgagcccgagagaggctagcattttccccccccagtgagtctcgggagctgtgacacacaaagactctctgcttgtcccccgacagggttaaaagcgcctttg

SEQ ID NO: 625981 - DNA, 285 bp, Homo sapiens
gcaggcagggtgtggggtcagtggggcagacatacgggctagatccggaagccccatagggaggaggtcaccaggaggcagctgtataaatcagatatctgatcaatcacactgaggaactggaaggaggtgaagaactgcaaactatttcaaaggtgactgagccctgcttctggtatgagaaagtccaacttccatccaaaacggatgccaaggcattgtaaaattgtaagcattcacaaatactttcgatgcattcttatttagctgacttctagattttac

SEQ ID NO: 625982 - DNA, 322 bp, Homo sapiens
tctgaggatatacggaatgctcaatcttattaacttggaatagcataaggtaacagccacattgctactccccactgttattgttatacatcaatgcatgcttcgactgtgatccctcacagatgtaacacttgatatgcacggtagaggatatgaaaaaatacttccgaaaccaggaattcagtgtatgtaagttttatactgtttgataagaaaagtcaggtccagccttacagcagcacagcatgcgctgatagcatgcatagtcaggaactttaatttatttcttttaggtctagggacaggagtgaatagaaaggga

SEQ ID NO: 625983 - DNA, 272 bp, Homo sapiens
tccctttaatttgaaacggcaacactaatgactgtaaaatgtgggcacaatatttaatctttcgccttattaaaagcttaatagtggattataggggggcactttcaagggataatatgggtgcccacagtaccaaagcgtttagaaacctctgtttaatttaaggaatgagatcaggtactgcttctctagacttcctagcatgggctgccgcactggagagaacgagagcttccacaagactacaatgcctgtgactttctcatatgaca

SEQ ID NO: 625984 - DNA, 1312 bp, Homo sapiens
  misc_feature (247)..(247): n is a, c, g, or t
gttgacatgacccttcctggattggccgctatccgctcctgtagttgtgatatgtcacttccagtacacgaattcaacatctggcgtccattgcacgtctataggaagattctctccctctcatctacagggacgagacactccttaccagcaagttcgtcctagggagtatcgagactagtccgtaaacatagcttgtctatcgtgagggacgcgtaggtagaacactcgcacgacgctctagaangctgtgatatcctagactatgtatattatcatgctcactgctgcgtttactcatcagttctctagaattgcctatgcactcctctgtgtcacatctccctttgtgtggtaccaacgttgagtctgtcccgtttagagactctccactatcaactcagagagtgacacagtcccacgttggtctacatatatataaagacacagacacaagacacacacaaataatacatagaggaagagagcgagggccagcgttgtgccaaggacaaaatatctttcccaaaaggggaggggacgcccatagtcgctccttttcctacgtttgccctggctaatgtcctctgtagcgtctcaataggccaggtgtgtggagtctcctcctctctatgtaacgttcgagcgcctcaaagctcttcctatgtaccgtcctcactagattgttctctctcgaggggctcgcgagtggctaatctaataggagcacaaacccgtctattggaaagagtatcgcgagcggcgatcccactgttcgccttccaaggaataggagtgcctaaactgttgttcctgttgcccacttgtggggcccccacttctcaaagaactcctcttagaagcggggggaagtctagaattgcgactggtaacttatgggcgccaaaagtaaggacttttgagtcggcccacaagttgccaacagggtctattatgttccctaaacgcccaatgggggccgcttgccgcaacacgcgggattaaatatcctagaaggcgcgtggtttatattaccccgcgagatttttctccacacccaaagtggtgtgatgtcttttaaacacccccaaaacaaacccgcgtgggggagagaaatgatttcgcgtcggggaggttttgttttgtcgacaccccccacagatttttaaacacgcgggaaactatcacccccgaggggaacccaactttggtagcccaacgcgggggtgtgccaccacagcgctatgtttttccaaacgggcactaccagagctcgcgatgcagagagcagggtgtgatatactcctacacc

SEQ ID NO: 625985 - DNA, 575 bp, Homo sapiens
tggccactccagatctgaatgatagaccgagactccatctcaaaagaaaaaaaaacagccgagtgtgcatgtgactcacggcctgtcgatcccagcactttgggaggcgaaggcgggtggaacatgaggtcgggagttcgagaccagcctgacgcaatcatggttagagaccccggtctctacttaaaaacaacaaaaactacctgggtgcgtgatgggcacctgctgttgccagcatactcagggactggcttgacggtccaggtgaccacatggcagatgacaaaccacgggaatgttgcgtcgggcttgcacttggacacatggaagcactcgatggacaagtggacaacatcccaacgaccgatggtaccgatacagtaacgacagacacacttacgcatagtcacaaaagaaaaaaaacaaaagtagcagaaccattagcggctgtaccatcgtctgaccgtgacagagcaacaacgtggatacgcatcatgatcaaatgttgtggtagtgaataaagcaaaatgaacagacacacccagcaaaaagagacacatcagcaagtcagtaga

SEQ ID NO: 625986 - DNA, 1290 bp, Homo sapiens
agcgggctggagtgcgccattggagccggcttgtgctggcgagcccggctgagtgagcctcttgtggcctgcacttactgccgctgtcctgctccctggtccctggcccctcagctggcatggctgtgctggggctgactgctgaatgctggcccatgtgagttctgaggcgtgcgctgctgatgcccctggctccccgaagctggcgtgtgctgctgccccatcatgcaccagtgaacaccaactccctgggcactcagtgcccacctgtgacgcctgatgccggactgccggccggtaaatacagaacggcaagaagcaacaaacccggaaggaaggtctcctggaaggaaaggcccacagacccaacggcccgggtcgacagacggtaaatgagcggggggtggctcttatccacacgagtattacgctgaggacgcgcaactaattttatttctgccatgtaagacccatttaaacgcgccccagagggaacaatacttacgataccggttggtactcccacgaacgcgctgcgaagagaacgaagtttctacgcacacggcttggcttccgtagttagaatcccaatgcaaaggttggacaggagccttctggcttggcgtatccaggggcaaacaagggctcacaagacgctgtcgcaacgtacgcggtccacggcgaccttcaaaccaaagaccaagcccataagagcgtacttcccaggggatatacacgtaccaagttgcggatcttgcacactgaaaaaggggaacaccaagtgcacccccaagccgattatgtaagccgagccgtacccaggaacacacacaggcctttgtggccagcttacgacactaacgttggatcgcaagcggcctggcccaggttcgtctatcacgtaacaccggaaccgtaactttgaacacggagcacttaccatacctcaatctgcctggcgtagccatgcgggcacgggtacattgggacgtgcgagacgtagttccccctatcccagacgtgacgccaccaataaaacgcgtaatggcccgcatgtacaacgcgacacactcagcttgtaaacatttccatgctgaagtcgggtggaaagcgcggtttcaccaggccagccaagtagggagttgcgaatgtaacgtatcagttggctggaccagcggaataaatggggcggcaaccaacacggtgtgtgcaacacgcagagcggcccctagccttaggtgcgtacccacttggaaagccgcgatcaatatgagctcgaaccgcaattaa

SEQ ID NO: 625987 - DNA, 458 bp, Homo sapiens
gactagttctagatcgcgagcgcccgccctttttttttgtttttctaaaaataaaaaattaattcgggtattaaaaaaaaataaaaaaaacatatgagaaagggaaaacccatagaaaaagaaagaagaagaaaaaagaaaagacgggggaaaagttgttaccgaaagtgtggggtaaaagacgcgcggcaaatgacaaggtgttttaccattgttgcgtgggagagcccgaccaccttcgaaaaaattgtcgtacatgagctacaacgattaagtattctaactaataatagggatgagtagagacgatgatgaaggagttatcacaacataagactagtgagaggtaataatacaacggcagtagacacaatatgggataatacaacagataataataataatgagagatactagcataagatatatcagacaattagattcactatacaactaat

SEQ ID NO: 625988 - DNA, 738 bp, Homo sapiens
gattaaatatctattatatgtcaattttttattgttaatacttgtgaaagatgttgatttgtatagtacactgaaagcactcacacggtcaacattctgctcccgagtgactgtattcacagatcacaaggacataacttctccataatagacaaaaaaaagtttttttagaatgactaccattcatctaaaactcacagatgcgggttttcctccaaatgatccacaatccagttttaataaacacgttggtgcttgtaagataataacccctcagtctccctctcctcaaagaacagggcagccaggaaactgcactctccagtaaatgacagccggcgggactcgctaaacagggcgccggaagattgccttctcgcagagagagactttcaagactcaagatgtccccgctccctgattatcctacaaaggacagggctaacccaactgcggactgaggcagtaaattatcatgtcttccagctaatagcatcatccacccaagaatgagaggtaccattttcattctcggggggactgcttacaagcacttaatttaggttgtagtgattattggggcttctgtgttggcgtcttatgcggtgtccctcaaagcagtttatactcccctccgggaggaatctgcccgttaccacccgacatgtataagaacttttccctcaggcatttgtttgctccagtttcatttctcccactgtttttctaaaaagagtt

SEQ ID NO: 625989 - DNA, 460 bp, Homo sapiens
ccctgactggtagacatcactctcgaagtggagcgagtgacaccattgagaatgtcaggcaagatccagaccaggaggcttcctctggacagcagaggtttgtctttggtgggaaaccgctggaagatggacgcacccctgtctgactacaaaattccgaaaggagtccaccctggcacctggttagggattggcttcgacagcatcctaaacagcatcggtggatgtgtcatcccacatgagccttcatctccccatgaactttgattttaaacaaatttggtagaattctggcaaaagtctctggggactgctcctctacatccggcaacacaggacccagcttccaaaaacatgctcctgctcccaggggaggtgctcagccacgagggatggcaggtcccgagaacgccatgccacatcactcagcagctgctggtagaaagtgctgaaccttcat

SEQ ID NO: 625990 - DNA, 689 bp, Homo sapiens
tcgccccgttcctcccaatgaccccccccccctgttaaaccttgcaaataatttaggacccttttttcttattgaccgatgcctacgccgccttgtttacgccaactccccttttgagcgctaccacgagatgaccaagaggtttcaaccgcgccccaggctctcactggcaccaaacactctgtcaaagtgtctatcattccccaccagggtatccgctgcgttcatccggaagcagcgaatacctaggtacaatccgcactgaacagggacgccctcgacccggataccctccctcattgcggcgggggccccactgcgggacccctcagccacacgcgccgcgcatataatatgatgagaccccactgccgccgcccgcgcaaccagaagaggggcatacccctcgagagaagggtaccccccccgcgatctgacccccaccacatggaaaacggcctccgcccaagaaccaatcttctctgtcacatgagatacttcggcgccataccctggcacgctcctaggacctctttggtggtaacacccccacagcggagaaccctctcttccccgcgtttcctcccccctacttcttctttttttctgtccccacatccccctctctttcctccacctttctcccccaccatagccccgcataactaaccttcgccccataatagacc

SEQ ID NO: 625991 - DNA, 101 bp, Homo sapiens
gaagctgatagaaaagatagtaactaagaagctgagacactgcacattatggagatgatactaagcataatatttatttattttttgagatccgtttcaac

SEQ ID NO: 625992 - DNA, 92 bp, Homo sapiens
  misc_feature (27)..(27): n is a, c, g, or t
ggatttgctggtgcagtacaactaggncttaatagggctcgaattcgagctcgaattcgaggctcgaattcgagaaaaaaaaacgttagaag

SEQ ID NO: 625993 - DNA, 357 bp, Homo sapiens
tcgcgtctgcctgggggaagactgctgggagttttctggcagctgtcctctaatgcatttcgagaacaagaacctcatgccacctcttcgtagtggtgcacgaccgtgtccctacaactccacagccacactctccgtcatcagggactacctggtccaaaaactacagaaatagtccagaatgtcacaggtccagggcagaggaccatcgttgagctgaggaccatcgttgagctgaggaccatcgttgagctgaggaccatcgttgagctgaggaccatcgttgagctgaggaccatcgttgggctgaggaccatcgttgagctgaggaccatcgttgagctgaggaccatcgtt

SEQ ID NO: 625994 - DNA, 200 bp, Homo sapiens
aggcatagtagctcacatctgtaatcccagtgctttggaaggctagtagggaggatcatctgaacccaggagttcaagaccagtctgggcaacatggtgaaacctcatctctacaaaaaaatataaaaatcagtcaggcgtggtggtgtgtgcctgtattcccaactcgtcatctgatctaattgggtaccgagcgtcga

SEQ ID NO: 625995 - DNA, 2556 bp, Homo sapiens
cgactctgcagaatggaacaaagcacccatccccactgggctcctggttgcagagctccaagtcctcacacacgatactgcctctttgacgaagcagctgtgtgcaagaacagactgcaatgcccagagtgccctgcccatttcttgtgtgtgctcatgtgtcccttacttgagctcaagtgccccttgtcccttcccctcgtgcacaggtgccacaaattgaaacctgagtggcagctccacgttatctagtgcaacatttgcctttccttgggtagcctgccaacaccttggccgtcgtccaatcacccgaagcctcgtcccaaccatcaagcgtgcaacacgcacaacgctgggcctggcctgcgcgcccacacaccacacacgcgcgccgcacttatccactgtcttgtggcccacccgtgtgaacccccgtggctatatcctacgcgccattattcgaccctaggccaccaggcacacacgcacactgcacacttacgccgcatcacttctcccccaacccgttggcgcacaacgcaacactagcctttcccctaagaccccgtactggcatattttacgaccccccggcacgtttttcccattcggtgggggcaaagatgcacatgtctagccggctggcagcccactttccgccattttcccggtcctctaacaagcctctttagcaccacaccggcgagataccacacagagttcccccgaaacaccgccgcgagttggcacgacacttatggcaacgttccatggacagggtccccaattggatcaacccgcatttccctaaccagtggctgcaaacaatgtcgtcaacccgccgttctccactgcttatcactacttggacggtcgagtcaaaatcccccccacgatgccgtgcggtgcaacgatcacgaactcgattattattcgtcaccgaccccaccgtcacgccgtttagccgctatcgctctcgcccacagcttctctgcgacgactggggctaagagtaacatattcgcgtttcgcctacataccggtccaaacactttatacactggccacactcgtatgcgcataacccctattctccctacacgttcatcatcgtttttcatcacccctatcttatcacagcccccagaacattctcccctctcggcgccttcggcgctcaaccagaccgccatttggtcggcacaactgcgagtgtgcaacgctcatctcccccacctgtcgtctcacatcatcccgcggctggctgcacacaacggctccgctccccacgcgctgcggtaccatctggcttcgctacagccatccctcatctgtgtctccccacttacactcacgtccgtatcggaccttcatatagccccgtgctggccgccaccaacccatattacttctcggtcaacaaccccgccttagggtgcacaccgccaacaccatcctcctacttccccacctttgtgtcaagctcacgtatgcgcccctccagaaactagcacacgctcatttgtgacacctactatctctccgcaactatcgctgtgtcagcgtcgttagcacacaactgtgactcatcgtcgtcctcccctgtttctgtgtaagccagtcctgacccctctttgtccacaatccacccccttttctcgcggtctgagccaacagcacaagtgtgcccatctcacctcctctcccaccttctggtgcgtgcatttatatgcgcctttataaaggtgccacctcaactccacccgtattaactacacacgcaactggtcgcctccaaaaactgtctcggccagtataaacatagtgtggtaaaaggcgatctatcccctcaacaaacactctgcgtcagggtgtactattaactccgccgacagcaatgcacccgcagctattatcctacaagtagatccggtccacgtacgtgtctgcgctgcatcacctcaacatgcatcaaacaacgactcgccaccgcataatcctcatatacctcctctggtgtaattatgcattgttattctgtcttttatcacataaggtcaaccatgtctgatgtcgcgtccgaaatcgcgcacccctcatcctccctcaatcactgagtcgctcactcaactacttacaacatcactgactgatctgacgccaacacatattcccagcactagttcgctacacatacatccacactattcatggtcacaaaacgcacgatcgtgactcaccccacttcgattgtcttccccatcttgtcaatcacttctccttcctcctcctactacacaccgctgacaacacctgcagaccattcttacaaacgtcccgaatttacgccatacactacgtacttctttacgctcatcccactccctcttctcgctcctcatctctcataaccacgctcccccactttacaccccctcactcatactccatgccctctctcctacacactacacctcctacacccctctactactacacactcatctccctacgtcttctaaccaccccttcccctcaaccatcatccaatccgct

SEQ ID NO: 625996 - DNA, 399 bp, Homo sapiens
cggtccgttcagcgaagcaaacacaaaaggaaaaaagcatatgtaatataatacaagagtttacaaagtttatattggaaatatgtgcatctagttataaaaatgattattgctaaggtgatgtgtgttttgccattgatggttatttctgtaggtttcttaactgaatctacatatgaatgtgcactgagtcttatggaaagaaattgaagagctccccagataatgaatctactatcagcaatgtccctctggagttatgtttactcctgcgggtcctgcctattttattgccctaagttataagttatattgacgtacgtcatacaggtgtgatactaggtggtatctgtggtctcatttacacagttagttttacaggttaggcgttggctggaa

SEQ ID NO: 625997 - DNA, 161 bp, Homo sapiens
acatagggccgaaggaactttttctgacatatagctgcgcacattatgaggtagacctagaccgacacgcctccgtacgacctcctggagtgtcaacacggacgtgcaacagaggaattcttgaatagacgtaattggatccaattatggcagcacgtgct

SEQ ID NO: 625998 - DNA, 263 bp, Homo sapiens
  misc_feature (213)..(213): n is a, c, g, or t
ccgctgatcgttacgcacacaaaactacagcattacacttgggttgcgttattctaatcagcagttgaatgattataatcacactttgctattttaacatacattggtgcttagagcattaagaggaagcgcaggcctgtactcagtattattatttcttagctcagaatgcgaaacaactttaaagtgtctatattcatatatatgtgcatntcttaagatttaaatacaaactgatgttactccttaagcggatccacggg

SEQ ID NO: 625999 - DNA, 305 bp, Homo sapiens
ccagcccggagcagcgagcggggggctgcccaggcgcgcaagaccagcgcttcacgcacctgagccccgaggagaaggcccttaggaggaaaccttaaaaccagagtagcagcctcagactgccaaagatcgaaagagggttcgaattagttaagctggaaccgcaagtggtagatttggaggaggagacccaaaaccttttctctagaaaatcagcttttacgagagaaatctcatggccttatagttgagacccaggagttaagacagcgcttggggatggatgccctggtttgctgaggagg

SEQ ID NO: 626000 - DNA, 191 bp, Homo sapiens
ccaaggcagagtttattaggtttatgctttatatttatatataaggttttattcatgttaaaaacttaaaaccaacggattatgcaaagtgataagtgtatcaatgaatatacaactgactggattttaaatatacacaaaccagtatacccccagtacttaaatgaaggcactcagtatacaccaaaatt

SEQ ID NO: 626001 - DNA, 685 bp, Homo sapiens
agtgtttgaataccattagcaagcgtgctatcagcagagtgaacattgaggcccagatgccatgtgaccgttgacatcatgtttgacaactcttgccctgcctctcattcgcatcctttctggcactgcaggcaaccaaggatgctaggacttagctgcgcagattttgaagcgatgagcttacagcgctggctatgctatatggtacaactaatgctcgacctacagcttatgtataccgatgatgctgacgtattcatgaaagcttgcatgtctagactcgacatttttcaggatgattcaagctgctttatggatgcttccttgcatggcattgctatgcacatattatgggcttgagaccctgcacttgcaaccacggatggctgctttagtatgtacaattttgagttcacagtcagtctgacatatcaccaggccgtgataattatgaatattctatccattactaacctttcattgagtcagtcatgtactatagttcaatgtactaagatgctttataccacgatcctattgcgtattaggacattccttatttagtacagaattgctgctcgatattcactatatggagttctgagtttacccatcgtaatacctggtcacagcattccaacccatagtaactaggatcccgatggcagccacatccacggcgtcc

SEQ ID NO: 626002 - DNA, 408 bp, Homo sapiens
ggctcaattcctggtaaatcacgtgttgggctttttccctaaaaataggctcacaggcatcctcctgactcagcctctggtctccctctggctgagaatggttcaaaccaaggatgagtgtgatgagtacagacacagagatggtgatagagaacaggatgggaacacggagggaatgaacgaagaaggaagaaggggaaagggacagaaagtggggagaaggagaaagaaagagaccaggagagagaggaaaagagagagagagagagcgtgtgcgagagagagagagagagagagagagagagagagagaaagcagtgatgcgtggatgctactgtgtgtggcaaagaggactccaggttacaggtacagcacagcgacaatcatgacaacagagaatcacaagag

SEQ ID NO: 626003 - DNA, 220 bp, Homo sapiens
agcggggaacaatcacttacttgaggttgaaatatgagaagacaatatgtggtttgctgctatagataacagtggggcggtcagaacaagcaaagacgttggtaggtagaaagagaacgaaaagtcctcaatacggtgggctaggtgcccaaagtacactactaaacggtcgctacaacagaactgtctacaatgtatgcagcccaaaagtagacaaagc

SEQ ID NO: 626004 - DNA, 995 bp, Homo sapiens
ggctaattctcgcactctggctgcggcgggtccgccgatgtcgttcctctgccggtcgtaatgcgaagacgagatcggcggctgatcatagacaatgggtccagatgtgtaaatgatggtgttgctggggacaggacgcctacccgagacgtgtatccttccatgcgttgaggacgctccatgagacaggggggtcatggtggagcattggtgtccaaaggacatccatcacgtgcggcagacagcatgccctcgatgctagtgcgctatgtgatcctgaccctgcaaagttacccgattaagcatggcgtcatcatcaactgtgacgagatggagaagatctggcaccacacctttctacaaactgagctgctgcgtggcccggaaggagcaccacatgtgctgctgaccgaggccccctgaatcccaaggccaacacgagagaaggatgactcagattatgtttgaaaccttcaacgaccccggacatgtacgtggcatccaaggcgcgtagctgtccctctaagcctctgggcgacacacactggcattgtcatgagactctggagacggggtcaccacacggtgccatctaacggaagggctacgcagctcccccaagcaatcctgcgtctggcctggtaggtcgggaactgaccgatatctcaatgaaaatcctcactgatgcgaggctacagctttcaccaccaacggccgagcgggaaatcgtgcgcgacattcaggagaagatgtgcaggtcgcctggcatttgaacaggagatggcaccgacgaatctcatttctctgagacgagctagaatgcgatggccatgctccaccttggcatggacggtcccgtgacgagaggcgacacactcattctggatggaatgcgatccgaacacttatcacatgacggtatgatcccagactagcaacggatagggaccaacgattgaaagaagaaccggccaaaatatcaaagaggacgaggc

SEQ ID NO: 626005 - DNA, 200 bp, Homo sapiens
gtcgatgtgcttctggatcaggcggacaatgaaggacgggatgttcacacctgctgcggacctgatatgcgctgcgatcagcacgcgagcgtggtggatggacttggccaagctagcttgaagaccttggcttcaggcgtctctctagaatctctatctcagcctagatgtatcagctcatctgcctatcagcacctaat

SEQ ID NO: 626006 - DNA, 110 bp, Homo sapiens
ggttcaaggcccgaaagcctaaatggaaccttaagggaagcccgttttaaacttacgggaaagccggaacgtgccgaaaaggaagggagccaaggcgccctggcccttgc

SEQ ID NO: 626007 - DNA, 965 bp, Homo sapiens
cactgtattattatcggatcttcactgtggacgacaacctactgcccgtgggcaagacagtcgtcatcctcattgagacccccgatggcattcctgtacaagagagacatttctgtcttaccaacaaccaacacggatcttgccttgtcttggaacattcctgaactggtcaacatggggcagtggaagatccgagccttttacgaacatgcgccgaagcagatcttctccgcagagttgaggtgacggaatacgtgctgccagtttgaggtccgggtggagcccacagagacatttttattacatcgatgacccaaagtggcctggaagtttccatcatagccaagttcctgtacgggaaacacgtggacgggacagcctacgtgattaaggggtccaggatggcaggataagaagatttctcatggcccactccctcacgcgcgatagtgatcgaggatgggtgggggatagcagtgctgacccggaacggtgatgatgggacggggtaaggcctacaacgccagacgccctggatggggaagatccctgtatgtctccgacacatgatacatccatgcactcagggcgtgacaatggaaaaggcaagagcgcacagagggatcccgatgtcactaaccccgatacagataccacttgacaagaacatcacaatattcgttcaagccaagccaggccattagtaccatgggtcgagaaccaccccgaaggatatcggcagcgacagggacggagacacagagagaaactaatgcaaggcgcacccagaagaggcgtggcacatagctaaaaacccaaagagacaacctacatgagtgagaccgaggaaaccaagagacagcaccagcatgaggcaccatgagcaaaaagcaacataaatgacagtagaagggcaacgagaagacgataccggatgagacccgaaacaaacacaaggagagaga

SEQ ID NO: 626008 - DNA, 442 bp, Homo sapiens
ggggggcccccccccaggttgttcattcccaaagggcccaaaattccccaacggttggggaaaggccttaaacaggaagcctttttccccaaaaaggttcgttttttttaaaaaaaaaccccccaagggcgggcggggacccaaaaaccccggaagcccctttaagaagaagggccaaaccaacgcttttaaacccaaccggggggggcccccggggcgaaggccgacctttttttttaacccttcaaagaaaaacccaaaaggaaaatggggttttcccttttagggtggagggcaattcccaaaaaaggttttgggcccttcccccccggggctggaaaaaagttttttaaaaaaaccggggttttggccccgaagggaacccccaccccttttcagggggggttcccccccccccaaaaaaatttggttggggggggga

SEQ ID NO: 626009 - DNA, 838 bp, Homo sapiens
tccctcttcgaattcatctgttcctggccccttttgccacacccttctttgccgccggtttttatcccctctctccgggtttcctcaccgaaaatgggttaagaccaccgcacaaaagggtcccccacaacatactgtctagaccaacttgcctcctctgttatagagactcctcctcccaaatcttcctcccccactttttcttttgaggctgtcctcccgcggcccctctctcacagaaagaagctgttctcctccacacccacatctttgtgaacaaagagaggtttcccccgacgagtgctccctttgaagaacctcttcggaaacctcccctctactcacgtcacttcctcccaagactaccacaccgaacaacacccagtggggaccgccctcaaaaaccatgcgccgcaccaccacttgtgcgcgcccccctatcagttgtggtcgaaatataagccggcacgcctccaacaaaacacactctctcgccacacggataaacaacaaccctgctccccgcttagggttaggatgaagggcgccccccttgggcaaaaaacaacttcgaatggacgaattcaatgccagaagaaagatattccttgtgtcgcacccccaccaaccaaacagccacgcagcaatgtatttagagattgtgccccccaccctctcagaagcgacgatagaccaggcacgtcagctcctcctgctcctacaccgcgtcgagcgaatctaatcctgtaaaagacaagagtctcttgcagtcctcggatcaccacttcaaggaccccgccccccgggcctcggacacgcacacacggcccacaagaca

SEQ ID NO: 626010 - DNA, 289 bp, Homo sapiens
tggtttgtagcctagcagtgataggccataccacatagcctagttgtgtagtaggatatatcatcaaggtttttctaagtaccctgtatggtgtgtgcacaacaatgaaattagcctaatgacatgtttttcagagcatattcccattgttaagcaatgcatgactactcaggagggtgaggcccaagcatcccttgagcccaggaggtggaggttgcggtgagccgggatcgcccccctgtacttcatcctgggcaacagagtgagactctgtctcgaaaaaaaaaaa

SEQ ID NO: 626011 - DNA, 483 bp, Homo sapiens
gttcagaaatccccaccatgagattctgggaagcttatagagacatctacttgtctcccgatcggactggctcctcctttgggaagaactccgaaaggagggagaggatgggcccaccacgacgactactaccagccggcttcggggaaggagaaaccctagtcccgacccactcctaccaaagaaatggggaatcccagaggaaaagtagtcgtcccacggcgggaagaaatctcacccacgcaccactccaagagtcgggaagagcgcacccaattcacgcggagacccacgaggaagaaaatagggacccccagccacggggcccccaccggggccggggcaccggaccggaccggaccggaccgcaggacccccgcaaccggacccaattcctttaggtcccgaatctggcagagaggaggtcgggtaatagaaccgaactgttcagatccccaatcccaataaactattttgttctta

SEQ ID NO: 626012 - DNA, 1595 bp, Homo sapiens
  misc_feature (451)..(451): n is a, c, g, or t
taaattgttgctcaacttttatttctcctttaaaccacaaaatagagtcttgggtgtgtacaaacattcactagtttacagtctcgccgaggttcctcggcgggggtgtggggcagttagtaagctcacgaggccagaaattccgtggggggctcctctttataacaagtgcgttaaccaccccgaggtgttaaagagcacttgtgggcgcagagggtgtgggtgctgtggaacctgtggcgagggcccccccaaccccaaagtctctgtgggggaaggtgtgcctgtggtctccctctctatagggaggcgccacagagggggccccagagcgccacaaggggggcgccccagaggcgctatatacggggcgcgggcgggtctgtgctgtgccacaaagtgtgcccccacaattcttctcgagggggccccccacaagagagcgcccggnggttgtgtgagtgcgcctgtgcgccagaaaagagcacacgcgagaaacgccactattctctcgcaatcgctctcgctctcccgtggcggggccacgaggggcccgtgtgagacagaaagtgggctctcccggaggggacaccctctcaaaaattctcctctcgaaggcaaagagtctcgcggggtggaacgaggggcgtctcccccgggggagaggtgtcgcgtgggctctgtgtggggcgcccgagagagctcttctcccaccagagggggtgtgggtgccgacaccaggagtgtgtggtgcccgccaggggggcaacagggtggggccctctctgggccccaaggtctccgccctcccggagggggggccccccccgggtgttgtggcccccggaggccttctccctgtgagggccacctctctgtctgtaggggggaaccccaatatctgtgggtgggcttcctgagaaagaacgccgttcctatgtggtgtcccccatactgcggacttttccaactcccctggggcttttagcaccctctccacaaatcagggggggccacgcggccttttcctcaggaggaccctcaccaagggaggccccctcgggaagctctccgggcaagtgggcgcactaggggccacccgtctcccggcggttttgccccgcggttggaggtgccccgggacaatttcttttggcgacgctgcgcagagaagcggcgtctcctcttggtgtgggggcggccccgtcagcagcttttgaggccgcgttgcgctcgaacccggctgggggcggccccctctccgcccaggggggcggtggcggggacgaccgccgggcactatggcccttgaagagggagggcgaccgggagcagtgtccccaggggggggggggacgaacacccaccgggtgtgtcatcctcttgcgccaagaggatacccccgcaccaggagagagagccgattgttagtcccacaccttgttgagttccgacgaaaatagagccctcgatggggatggatagtgagtgacccctccaatctacgaacggatgataccacagcaaaaagcaaactgtgagctgctggagggacccccaacaaatattatgtcgatgcgagcggaggactggct

SEQ ID NO: 626013 - DNA, 366 bp, Homo sapiens
aacagcggtgggtgaatcgactttctacttgtatgagatttacagactttccttctgggttgtatcatgacagaggggtactatagggttggtttatactggcatatagaggatcagaagccatttgatttggtaggtgtgtcagaagggagaatgatggctgacgaagtgctggaataggtcagaagatagccatgctaaaatgcgattatatcctcatgtttatcccaaactaatcttggacttttccactcattagcttggtttagcccttgtttccctgtgaaggtttaagttcaaccatattctgtcaactgtacagtttcagtggaatcttgtatttctggttcattataacaaactgtt

SEQ ID NO: 626014 - DNA, 259 bp, Homo sapiens
  misc_feature (65)..(65): n is a, c, g, or t
ttttttaaaaaaaaaaaaccccccccccccccaaaattttaaaaaaaaaaaaaggggggaaaaancccccaagaagaaaaatccccttttttttaggggggcccggtccctttttccccaaaaagggcccccaaaaaaaaaaaggtttgaagggggctttaaaatttaaaaattgccttttgttttaaaaaaggcccatgtttttttttttttcccaggaaaaaaacccatgggatccccccccccccgggtggtttta

SEQ ID NO: 626015 - DNA, 506 bp, Homo sapiens
gacgctgtcctggacgtagtgcggaaggaggtcgagagcggcgagtgccttcagggcttccaggctgatccacctcgctggggggtggctgcggggtcccggaaatgggcacgctgctcatcagtaggatccgggaggagttccgcagaccgtgtcatgaacaccttcagcgttggtgcgcctcggcccgagaaagtgtctagacatgggtggtgtgggccctacaatgccacgctgtctgtgctccagctggtgcgacgaatgcggatgagacctactgcatcgacaaggaggctactctacgacggtctgtgtccgcaccctcaagctgaccacccccacctacggggacctcaaccacctggtgtcggccaccatgagcggggtcaccactgcctgcgcttcccgggccagctgaacgccgacctgcgcaagctggccgtcaacatggttccctttcctcgcctgcacttcttcatgcccggcttcgcacccctgaccagccg

SEQ ID NO: 626016 - DNA, 1276 bp, Homo sapiens
agcggagctgggctctcaggcgctgccggaggagagaaatagccccaggctctccgagggacacacaaagacacaaacacaggcggtaagagtaacaacagcaacagagtaaacaaccacaaaaacaacaacagaccacaacaaatagaaacaaaaacccaccaaacaccacacaaaacagaccaaaaaaaaaaaacccagagtgaaaaacaacaaacaaaaaaaacaaaacaccaaccgaccaggcagcgaagaaaagcaggtaacaaagaagacccgagagatcaaggacaggagaccctaatagataactaaccaacagagagaaacaagcgtcagagactgaagagataaccagtgatgaagcgcagaccatcgagacaacgaagaccagagacagaaaaaggagacaggacccaggacggaatccgagaagaagaggaggcaggtccccccaagtgacgaggccgttaacgccggaagaaaagagcctaagctaaggatcgaaggaagaaaccgaacccggatggaacgagagcgtagtccagttcgagtgcaaccacgaggagtcggagaagatgccagatgagtagaggagagtccctcgaatgcagaagattacaaggaaccaaggcgaacggaactggagaggtaagtatcacagagctgacaccagccccccagagtggaaggccgttcaggactaaacgaggtccctagtgaaacccgaatggaactgaatctaaacattgatgatgaagtggtaagctccccctctgggtgagctgtctgctgactgagcccagctgggaaagagtgacccgaccatgtgtaacgaaatcgtggatccaatgttcccaaatattccattgagctccccttagtgtgcttagaagaatctagccactcgtgaataataaatgtaatctaggtagtacttatgtaagacccctgaattggaagctagtcttgccctggtgcatgtcctccccttaccaggagtctcaattaatggtttcaataatctgaaaaactgtgtataaatgcttcaagtccaatctaaaatatgaacctataacttatttgaattatttctatcttgttacctaataattattttatctgttcctctaattcttaagagtatacttaaatttcgcctctaaagtttaatctaacttttaaatgtctaatttagtaactctccctaggtttcttgtgattattttaagtttagtaattgatccttacgtaaccttcttcaatgtatacccct

SEQ ID NO: 626017 - DNA, 119 bp, Homo sapiens
tagatcgaccctacaaaagtcaaaagctgaaaactctatgtcacatcagcaaacagtcaacatcatgccccatacatcatcaccaattctgaattgttctcaaaggaggtcccggcgtt

SEQ ID NO: 626018 - DNA, 221 bp, Homo sapiens
cgctacgagcacagagcttcagcatgctggccagactggtcttgaactcctgacccatctagagcaagctaggtgctctttccatgtggactaggatctcgtacttactcaacacaccgaattgtaaatgctctgatatgtgtatcagcactgcttaccacctccacctaaggggagggcagagaatgtctcgtttacctcttttaattcctgaggcttag

SEQ ID NO: 626019 - DNA, 785 bp, Homo sapiens
tgggaaggggtcccaactttattaaaaaccaaacgggccggctaccatgcccccgctcctcagctatggctctaggggaggagcgggataaactagggcccttctgccaagcccggggtgctaggggaggaaccccttggcttggagattgtccgggatgtggacctccttcatcttcttcgtgggctgtggtgcccggggcccgctgtgaatctcttgggtcagcgtggtggccccattctgtggtggcctcccggtgcaggtgggacaatctacgaggctcagcttcagcctctcattcccggggtgttcggatgggccaacaatttggcagcctgggagccacattggccaacaaagaagcaaacgcctttgacctttcggcctcgggacccaggcgggagaagcaatctttcgtgggcatccgaatgggtaatgtggtatcaggcagattctccacaaagggcggtgtacgcccaagggggtggattcgctggctctggggaaaaatctttcttctagctctctcccaaatctttccaaaatctggccaggggggatgacaagttttacagccaaccaaagaagcctcctgtgtgcagggggatgcggagaaagctcacatgttgcacagagtggttctgacacggctgttgtggttaacccgccaaagaaagtggggggcgcactggagttcatgtgtaaaacacggtgttaggaatggtgcccccaattctcggttataaagagcccaggagtaaacgaaaagacggaatgagaccccg

SEQ ID NO: 626020 - DNA, 467 bp, Homo sapiens
tataagaatccccaatttccgctttttggggcgcttttccaatttcaccaaggacttggtgaccaccaaccttgcttaccaagcggcaaccactggtaacttttcagtggagaaacctggccgacattattttaaccaagtgggaaacattaacctcaacaggaatgggacaagttgacattgggtgactcctaatatgggacactgagaaaaaaggcgcattctttctgggggatttctgcccgagatgcctaaatcatgaggacacagcagacaaatccaaacttgaagacaacctacaaagtcattgacctgtatttttcaaaaatcttggccagagaagggaagcctgaagaattgttctagaataaattagactgaagagactccttgaaggcgactgaattggatgctgggcctgtaaagtctcatcttctgccaatgaatagtgcaaagttccagagaag

SEQ ID NO: 626021 - DNA, 604 bp, Homo sapiens
gtgtcgtcctccctccccggactctgcccctctaggtgtcgtcctccctccccggactctgcccctctcggtgtcgtcctccctccccggatctgcctctcgcatgtgtcctccctccccggactcttgggacctgccgtttcttccctctcacccatcctgacctaagaagctgagagaatctgtgccctcttggtagactgggaaggcgggggagaagcccctctgccctcgtcacccagcaagggctagtgcagcctcacgtcatgtggattcacagcagaccctgttacaaggcagaggcagtctggtcaggacctggcagaatacaacatgggtccaggcagcttcccgagggagatgccacaaaggttacctgcgactgctgtcccgggtatgacccaatgtgactagataaaacgaagactcagggaaaaaggagcaaaataataggtggccaaggtaggtcatgaaaagggaaacacatcgagacaaggcaacgagggcgtacaaacacaaagtaaaacaggcacaaactcaaaaagagggatggaggcgacaccaaaaacgcaaagaagtggcgattcaacaaacagggtaacag

SEQ ID NO: 626022 - DNA, 887 bp, Homo sapiens
  misc_feature (176)..(176): n is a, c, g, or t
  misc_feature (440)..(440): n is a, c, g, or t
gtcctccaccgaggcccatgcgaagttttccactatggcttccagcactgtcccggtgagcgctgtggctcggtaatgaaactcccgaaataccggacaagtgggagatgggcttcggggcgtctaccgttgtgccactgataggaatgacttccggagacctgtgatactaaatngggactcttgtgctgcgggagtgggctggccaggaacttgagtgacattgacctcattggcacctcagccaggggtgtacgccaagtagttctaatgccacctgtcgtcttatcatcgtgatggcagacaaagtggaatcctgtgctgaacccgaatcttccaaaaaaacagctacaatcttgtgaccaccaaagatgtgccctgatggcagctgaatgttggattcaggaatgggcacttttcttccccttccctgcctagtntcctttttggtttcctgtgagtccacgcagaaattccattctctggtcagcagacagggcttagctaaagtatggcctctattctgtaaagggtcctgtaccatagtccccaaggcttctgcagggggtgattttggtctggtctgagaaaataacagtgctgtttacacaacatttgaataaataccggactcagaaaaaaaaaaaaaaaaaaaaaagttgtgggggggccgggcccaggaaagttctacacattctgttggccgcgcgccaggttgtaagcacatgccactggcggtccaggaacctggctaccagtcgggttccccaaaaacgccgggcccggctctgacaccagggtcgcgccctgggtacaggcccagcccccccccgcccagcgggacgcccggacaacgagaaactcgacaaccgaaaggacagaccacc

SEQ ID NO: 626023 - DNA, 1402 bp, Homo sapiens
  misc_feature (134)..(134): n is a, c, g, or t
ggtagggtggggggcatcgatatagtcgctccaggtgtatcggagggttctgtctgactattaggactgtgcgcctgtcgaatgcggaagagctgtctcaaagtcactgaaaagttacttgaagtatgtactgncgtgattacgaggaacattgacatgagcactagagatgactaggactggtttcactgctggtggtatgcattcgggtgtagatccgagatgaaacgatcgtgggggcaatttcacgggattatgggaccgaagtaacaggtaggtatgttcgggcacaggaacaggctttcacgagtatcttaggtcgcgcactgtacaatgaatgcaatgaggatcgcacaaagtcgtgcactatgtctcggactgctcatgtgcttctcgcgcaactgacgtgtgtcgtcagagttctagatagaaactactgggcgagaaacttcattgtagactttgagataggccacttcgctacttgcactcgagacaaggggtaggagagttctcggtactctcgagctatgagacccacctaggattggcacatggttgaggctctgagcatacacgataaagttagctcgttcaatgcggaagactatgacgaagggggaggtggggtggggtagcctgcaagtggttatgtccttccgtgcgttacacattaattcacccccgttgggagaaataccgagggacgcaattgcgggtatggtgccgccaatagaatgaaaagacgttaagtgaagaaatctctcttcgagagagttcgtacgagaaggccaacgggagacagtttatgccatggacgaaaatcacttaacaataaagtacgcttattctccttgactggggaaagggtaaattgtgcaccagaaccggtgcggaacgcctccatatttcccctgtacacggaacaccggaccacaggcggaagaagcgggggaaggtcaccacacggaaggttgtagagtgggagtttccgttgggagaccaacgaagggcgccatgtggggaaaataggaagttacacccctttctgtggggcgtcgcaaaaacccgcccgggtattagttccacggaaggcggaacgcggaaaggagggggaatgaactcagcgcggtggtttgttggtggacaccctaagccaatggagcttttcctctcacaccgaagaactgtgggccattacggaagatatacacttcaaagaggggggtttaccccatggggttcaaaggcacgagattgcaaagtcacaacccaaatagggcgttggaaagaaaacttcttcctcttgagaacatgggcgttggtagaacatgttggggggtacacctggaaccgaggtgatcactctggggagactcttctgagggccaacagagaagtg

SEQ ID NO: 626024 - DNA, 257 bp, Homo sapiens
gtcatgactatataaccagacaagagaccgagcgacctgggcttggaggagcccaactgaatacccagctgcagcttactacggatcaatcttaaccaggactttatagacttaagcagtgctctgaacagtactgttgccagcgtgctgcgagctgtgtgtgctggcactagactggcttggttggattaccatgctagagatttgatactgttcactgatctcattggacgcacaggcatatacgtgcatgactg

SEQ ID NO: 626025 - DNA, 374 bp, Homo sapiens
tttttaagccccccctccccgggatccgggggggggggggtcggggggggggtccccctgtaaaaagccagctgttatttaaacaaaaaaaaaataaaaaaaattgggtcggttgggagttttattaataaaagatttttcgggtggtccttaacaccccttcctgaggttcccttcacccctttttttggccttccttccctttcccttttttcctgataagccccaagtcccttcattgggatttggtaagcaaaagtccctttcctttccttttttttccctcaaatttaggggatccttcctcccccccgggccttcctttcctttttcctcctcattttccccgtaaggctcccttggccccgccctca

SEQ ID NO: 626026 - DNA, 157 bp, Homo sapiens
ttgacccccaaaaagtgctatttagaggcaagggcccatatatgtgcccataaaaagcactatacaggtgaatgtctgtactcatccctctaatcatatgtaaataaaattatatcgcagtcaataacagacaaagataaggggtataccccaagga

SEQ ID NO: 626027 - DNA, 201 bp, Homo sapiens
cgtggagcagcatcgaagacgaagacaaaagcagaacaagacacaaaaagacaggaggacaagacacaaggggcgcggctcgacctgcaatggcccaagctgtctccagccctacataccctgagggccctaggcacaccccgaaagtcggcctccgggcatctggcaggcctgggctgccgggccgtttactttttactg

SEQ ID NO: 626028 - DNA, 128 bp, Homo sapiens
cagggcctctcagggggacagggggtaggagaccatcaagacaaacacgtggatacatggaggggaacaacacacaccagggcctctcagggggacagggggtaggagaccatcaggacaaacacgtg

SEQ ID NO: 626029 - DNA, 374 bp, Homo sapiens
gtcaactttcactttccattcttcacccagagcgtcaacagcaacttctgtgcccatacgcttctcatagaaagtccaaagtttgcgttcatggtccactccattgagtttgtgacagccagtgcctggaaagaaaatgtctcagtataagaattaaaaggggggaaagagtttacgaacctatcatatccaggtaattgtaaagcctatccacaaagttaattcctgtgcaaaaagcctttcatgtgtgcttccacacaaccagaatatataagatgcggcgtgcactcactaagagcatgtgagaacagagtaacagtcaaagagcggcgcactcaacagcgcgttctcgcgtgccatattcgtacagcccg

SEQ ID NO: 626030 - DNA, 136 bp, Homo sapiens
cagctgtctggctaggcggcccgtcatgatgccactgcgcaactcctacacagcagtgcttcccagtctatcacctgccaatccgccccatctataagctggcagatgctgctctagacctcaaggtgagggaaca

SEQ ID NO: 626031 - DNA, 504 bp, Homo sapiens
  misc_feature (37)..(37): n is a, c, g, or t
gtggatcactgctgcaaaccagacttcgccttcagangaccactgctttgagcatctgaaagctgatacaacgtatgagctcccatcagtctccgcacttgtatctgctttgcatacagactggtgtcagcctcgtaaggaggaccttcagaataagaaacacaggtttctggtcaacttggtgaagtggatgccagggatcacggatgaggagtggctgtgcttgttcacaaagttcactgctgccagggaggagtgcagcgaagtgcaggagcctgagtcctgtttcagtccagagagttcaaaaactggtgacgaaagtcaagctacagagaaacaaagataaccgaccaaagccagtgccagtttgcaggaccgtcctccgccctgtggtgtggtgaaattcagcttttgagaagaatggaatagaaggtttttccgtaaccctttcttgaatcatgttcctacaaaaggcaataaaatgaaaggataaagttaaaaaaa

SEQ ID NO: 626032 - DNA, 318 bp, Homo sapiens
gtctattaaaatacacggagcggctactgtaacatagttgctttatacatccttctcctcaatacagaaccaggaatgtaatttccctaactcaggcaggcactgatactgatggacactgcgcgtgtacacacacacacacatacacacacacacacacacacacacacacacccccaccccacaaaaaacaaaatacagagtatgtcacaagacaaaggtttgttattgtatcgctcaaaacccagtgaactcaaccccatctctcttaacttaacatgtatgctgtatcgctcttgcctctatattactgaactc

SEQ ID NO: 626033 - DNA, 366 bp, Homo sapiens
acatgttctttacggtggcgttcttgttttctcggtgggcagctgatattcttcctctaaagattgcagcccctctagaagcacccaggctgactttgatgtaggccctgcccacattgagagcagacaaatgaagagaacaaccctctttctgcctgtggggtctggtttaatggtgtctactcttagagtgaagttaagggagcgccggatttttgattttgacatatgacaagtgactagctacagtgtcttagacaagtcataggctccaggccttagttttctcatgcatataacaaattctctgatttcatgatttcaatataaagccattcttaagtcagattttaaaactatcatttt

SEQ ID NO: 626034 - DNA, 288 bp, Homo sapiens
  misc_feature (163)..(163): n is a, c, g, or t
  misc_feature (237)..(237): n is a, c, g, or t
  misc_feature (277)..(277): n is a, c, g, or t
cattttatagatccacgcaatagagagcttccttcctatgcaccttgagatctcttttttttgagacagagtctcgctgttgtcagcccaggctggagtgcaatggcgcaatctcggttcactgcaacctctgccttccaggttccagcaattctcctacctnagctcccaagtagctgagatgacaggcgtgtgccaccacgcccagctaatttttgtatttttagtagcgatggngtttcactacattggcaggctggctcgctcctgacctcangtgacccccgc

SEQ ID NO: 626035 - DNA, 305 bp, Homo sapiens
acggcaccccggcaactgcttcggatggccagtctaccgccattttccttctcacgggaattttcagggtaaactggccatcccaaaatagcaacaacccaaactgggtccttacttccttttccatcactaaaaatcacaaagcaatcagagggacccagtaagaccaaaggaggggaggacagaacatgaaaaccaaaatccatgccaatgaaatgtaattgggacgacccttacccccaaatcttacatttcaattcccattctaaaaagcacttatactttatgcatcccaagcattgccg

SEQ ID NO: 626036 - DNA, 206 bp, Homo sapiens
gaggttgcggtgagccgagtatcagctcactgcattccagccctggcaacagagcaagatgctatctcaaagaaaaagaaataatagatgaaagggaagactgaccatgttggaatgtggtgcatcctaaggtgatatctctagatggaatattaacttcttaggcctttttccctttactcattgactctgcaacctcacctcct

SEQ ID NO: 626037 - DNA, 163 bp, Homo sapiens
ccaataaggggaggggaagatagttggacccatagtctcaggggagtcttcaaccccccgaggacacaagggatcctcgggcctcagcctccaagtagcgggaataacgggtgctggccaccaggcccaattaattttttttttttttttttttttttttttt

SEQ ID NO: 626038 - DNA, 246 bp, Homo sapiens
cggtcacggacaggtgagaggagagccggtggcctcctggctcaagggcagccggctgtgtgtggatcggaagaaggctgggttgacgcactggggttgatgtcagagctgaggtgtcctcatgacacagaaagaggtgagctggttcccaggcatccagctccagcccgggactataccagcccgtcgtagagggggacctcgcctgcactattgcacgggtctgccagggtaacccacgcgggt

SEQ ID NO: 626039 - DNA, 178 bp, Homo sapiens
gagatgggtcggagaaaagcaaagccttttcactctgtaatgcacgctggtaatgaccagcctgcagtccagttcttgaaaatgtggatacaccagaattgctttgcaaactgtgttacagtgcattctatttggatggctcgagtgttacccactatagttcagcgatctgacggga

SEQ ID NO: 626040 - DNA, 161 bp, Homo sapiens
atagggactgtggtgtgtgtgatgtatgtctagatggttatgtgtgtgtgtgtgtgatgggatgtctgcatgtgtgtgcgtacaattgtgtgtctctgtgagtgtgtatgtagtctatgtctgtggtgtgtgtggtatgtgtgcatgtgtgtgcctgatag

SEQ ID NO: 626041 - DNA, 435 bp, Homo sapiens
gttatgtacgattcagtgtggccttacctcttctctctcctgagcgcctcacagtgcttctgagcctcgagcctcaagctgctgctgcgcatgctgggcatgcatgctgctccttttcgcgcatcgcttgcagtccagcacccgggacttctcctccttcagcttcctgtagctgagcgtgatgggcctgtgtgtcctggtgcacgcaagcctcctgtgtcctctggcacagctgctcggtcagcgagccgctcgtgccgcaaggcctcttacagctccagggtgcggctctttctcagccgtaaggtccttctggagctcagagagctggatccgctccctgagccagaagggcctcgcaaagtgaaatagcatcgatacgcagaatctttctgcaggttgtaccttggccgtcttaccggttcccaaggtggt

SEQ ID NO: 626042 - DNA, 139 bp, Homo sapiens
aatcaatagatccagaaaaagtagaatcgcgtgaataaaagattatattcagtttccagaaagagggtagaatgaatgacccatccataaggcttagcaggtctagtctcacagatactcgcaatttttcacagcaccc

SEQ ID NO: 626043 - DNA, 965 bp, Homo sapiens
aggtgctccggaccgagtctcgggtgtatggggacgtaggaaccggctcggggcccgataacggggcgtccccgacagtagactccgggctggcgtgagggtctcccttgagtctggagaatggctacctcgtcgatatgagccagtggttgatattggtgtcggggtctatgggacagtgtgcaaggcccgggatccctcaatagtgtgacagttttgtgggtgcatcgaagtagtgtgagagtctggaatgggagtgatgggtaggtggtaggagggcttccctattggcacttggattcagggaggtggcgtttaggtgtaaaggtgagtggatgcattatgagtatgtcaatgttgattggtgtgatggacgtctgtgtctagatacgcgtgatgaccgggatatctatgtaatgcctggtgtttgagtatgtagtaacaggactcataaggactatatctggagataggttagatcgccaggtttgtcagacgaaatgatcagggatgtgatgagcgagtatctaagagggctagatgtagcttcatgtcaattgcatcggttcaacgagatttgaagactgagtaagatcgggtgactaagtggtggaacagtctgaggatggtgactttggctggcagaatctatagtttaccagagtggaacttactaccggttggtgtgagcctcgtggtagcgaaactggcgaaggtcattcgggagtccagatatgcagcactgtggtcatgtggcgctgtaggctgtatgttggacgagatggtttgtgagagacccccgttttggggagacctggagggacgcagtgggtaaatgttgacgagttgggggggcacagggtaaggggcagaatgttctcggccggggggttccgaagggcaccaggagtggacagaataaggagcacggggatagcgacacagacagttgaggggataaagag

SEQ ID NO: 626044 - DNA, 2821 bp, Homo sapiens
acttcagggagagggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcggagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccaggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgactttcgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtc

SEQ ID NO: 626045 - DNA, 154 bp, Homo sapiens
tattagacatctccctacttagacatctactataagtaaaggaaaaagcagaaaaatatcaacaaagtcaaaaggtggtcattagaaagattaataaaatgggtaagcccgggcaatactgattttttttaaaaaggagaaaacacaaaggtat

SEQ ID NO: 626046 - DNA, 1063 bp, Homo sapiens
  misc_feature (108)..(108): n is a, c, g, or t
  misc_feature (1032)..(1032): n is a, c, g, or t
  misc_feature (1044)..(1044): n is a, c, g, or t
tactctcatttcctcttcaaccctccccccccacaaactttttttctttccaacaagcgcccagcaacgccagccgcaagcaacgacgagccatacatcgcgaagagncatgtacgatgcccacggacctgtacactacaagaacaacgacctccccgctccaaggtggggcgcggccgcacccggggccacgacacgagggaaaggagaggagccggggcggccggaggggggagggaaggagggggaggcggcagaacctccgacagcacgagcacggaaccaccccacgccgcgcaccgacctggaacgacgccacacgagtagaacataagacgaggcaaacccgcccacccaacccactccctcacccactatcttattacaaattgaggaaaataaggcgcggagacacacaaccggacgcggaggggacgtaggagaggtattaattgatactcaaaatgatattattttacaaaaccatagtggcacagaatacgacgtgagctgatcaaggcggcggagagcggagagcaaatgaagacaacaaagatagtatcacgaaccacctcgcgacagcggcgagaggagagacgagacgagaatatagaacgcaggtacagaatagcacgacacggagaaggttaacaagaaacgaaagagtgaatgcatgataagaaggaatgacgcagacgtgaatcatacgagcgcgtcgcattcaggcagccggtcccatacatagtgagagcatggcgaagaccgacgtgacgcaacgggtgcgaacgaacgtagggagcgattacgaagcacgaacgacgcggcacacttcacacgtggagaaatcacagcgaggatacagcaacgcacatcgacccaggtgcgcgcatacttgcgaccgcgaatcagtcgcgtgatctacacgcacagtacgagcagatcgatgcgtacgagcacagacactatgcctacgaatatgcgatttgactgtacacatagaaatactcgtcgctcacatcagacacactaacnagacagagatgnctgtgacgatcgacacacg

SEQ ID NO: 626047 - DNA, 960 bp, Homo sapiens
gtggtgtaatcaccaccgggggtgctagaaaaaattgttgtagtggtggtgcacccccgcctcggtgatgatttattgtgataggatgtgggtgcgacttatcttctcaataggcaactaatatatggggggtgcgtgtccacccacaaacggctccacgggggcgatcctgttgttgtgttgcgacccacctcctggggggtgtgtagcccgccctttgaccgacgtgcgttttggttgtttagaaggtgtcgcgccgaggctttcattaaatagaaactctggtgtgtgtgcgtcaccagacgtggatagatagccatgtggggccagacagccctcccgccccttgtggggaggcagccctcgggtggccccccacgtgtagcaagagaatggctccacgcttcggggggaacgtctccaacagctggaagagttttccccccggcactcatccacgcgcgttttctggaggaaatatttcttcccctctgcgtccccacaatctctggcagaaattaatttattatttgggccccctcggcccctccaaatatgttcttgtgaagtgctcacctctctcagctatactctcggactggggtcatgaggtgggtgagcgatttctcttcgatgaaaagagaagagagaccacactcacaaagggtgtcatcgccgacaagtcgatgaattgtggcaccactcggattggggcgaagacgtccaccgcgacgctggtttgtctagaagagcccagaacatactgaaaggggggcgccgcacaaaaagacggcccacgcaacgactgttagaaaaaacaaacggcagtaggggggggactaccacaagccacagccccaaggcggtcgttgccgcgaagcaacaagacgaggaccacgcgagaaggaaggaacccccaaacaaaatcaaaggaggtattcgccccccacaaacatgaca

SEQ ID NO: 626048 - DNA, 2786 bp, Homo sapiens
gagggcctggggtgcaggagcagtggtgccaggtcccagaagccagagagggttttggaggcctctgtagggggtgagggggtcctggggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcggagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccaggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgactttcgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtc

SEQ ID NO: 626049 - DNA, 137 bp, Homo sapiens
tcggccctcttagtcaagacacagtaaagcggttgtcttcttccgggtcacagcctgatgtctgacagtcaccaccttcccgtacatgttcagcacctggaaaggtctcccgttctagtcgcacgatgcaaggtgaa

SEQ ID NO: 626050 - DNA, 149 bp, Homo sapiens
gaggggcatggacaggtgataacgactgaacctgtgggcatgaggaggaacgacagagcagtgcatgctaggcagcaggcaccatgtgcaaaggcatggcagagcagagcttgttgggcaccaggacacaggctgcacagcactatggc

SEQ ID NO: 626051 - DNA, 2993 bp, Homo sapiens
acttcagggagagggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcggagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccaggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgactttcgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtccacgacaaaacgctccagcacaacaaaaaaacaaaaggggggcgcaaaaataccccagggccccattagccccctttggaacaggggccaaaggcgttaaagcagcggcgggaacagcggggagaaccccgcgctttgggaccccgggggcagcacacccaaaaagcggaaa

SEQ ID NO: 626052 - DNA, 432 bp, Homo sapiens
tcgattgctccctcttcaccaaataaggccggtcatggcagctcacgcagtaatcccagcactttgggaggctgagtcaggtggatcacttgaggtcaggagttcaaaaccaggctggccaacatggtgaaaccccatctctactaaaaacaaaaattagccaggtgtgatggagagcacctgtaatcccagctactcgggaggctgaggctggagaactgcttgagccagggaggtggaggttgcagtgagcagagatggcaccactgcactccagcctgagtaatagagcgagactctgcctcaaaaaaaacaaaacaaaacaaataaaaagtataacatagattcagtggcttatgcacaacagaaatttatttctcacaatcctggaacttggaagtccaagatcaggatgccagcatggttgggtac

SEQ ID NO: 626053 - DNA, 2675 bp, Homo sapiens
tgactatgtcaggtactaacttgacactgtctcataattcaatcacattcaggctgagggttgcagctggctcccctcactcttctcaacttcagcacacaggacattggctgtgcacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcggagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccaggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgactttcgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtc

SEQ ID NO: 626054 - DNA, 2948 bp, Homo sapiens
acttcagggagagggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcggtgagcgatgggcccagcccgagggggacgatctgagctctgcagtctggagagtgggaggctctgcagcgggcccggacacaggtgagcccaggcacgccactcaccgccccctctcgacccacagggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcggagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccaggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgactttcgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtc

SEQ ID NO: 626055 - DNA, 430 bp, Homo sapiens
taaaaggggggggtctcgtcgaaggttacctaggcgggtctccaactcgggggctcaagcaatcctcccgcctgggcctcccagggcgcggggattacaggtgtgagccattgagctgccgaacctagagttgggttttctgaagtgcttacactgggggagacccaggtcaggctctgctgggctggcgaggggagaaaccgtatggcagtgtgcttctccatagagcaagtccacacgttacccagactcgggggaggaggacaatagggaacccaagttggtcacggcttcgtggtagccagtgcggaagggggcggctttccctaacaacaccgggcccaagtcagaggtggaaacccatggctcgggcaaacgggtcccttctcagttaggtggattgtcacacaattgcacatacataggaagg

SEQ ID NO: 626056 - DNA, 2902 bp, Homo sapiens
acttcagggagagggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcggagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaaggtgaggggcgcggtgtggaggagggccgtcccccgggccgccgctctgacccgcgcccctgccccgcgccccctcccgcagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccaggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgactttcgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtc

SEQ ID NO: 626057 - DNA, 1514 bp, Homo sapiens
  misc_feature (1271)..(1271): n is a, c, g, or t
  misc_feature (1285)..(1285): n is a, c, g, or t
  misc_feature (1294)..(1294): n is a, c, g, or t
  misc_feature (1319)..(1319): n is a, c, g, or t
  misc_feature (1328)..(1328): n is a, c, g, or t
  misc_feature (1336)..(1336): n is a, c, g, or t
  misc_feature (1339)..(1339): n is a, c, g, or t
  misc_feature (1343)..(1343): n is a, c, g, or t
  misc_feature (1346)..(1346): n is a, c, g, or t
  misc_feature (1349)..(1350): n is a, c, g, or t
  misc_feature (1355)..(1355): n is a, c, g, or t
  misc_feature (1357)..(1357): n is a, c, g, or t
  misc_feature (1359)..(1359): n is a, c, g, or t
  misc_feature (1364)..(1364): n is a, c, g, or t
  misc_feature (1375)..(1375): n is a, c, g, or t
  misc_feature (1377)..(1377): n is a, c, g, or t
  misc_feature (1387)..(1387): n is a, c, g, or t
  misc_feature (1393)..(1393): n is a, c, g, or t
  misc_feature (1395)..(1396): n is a, c, g, or t
  misc_feature (1405)..(1405): n is a, c, g, or t
  misc_feature (1418)..(1418): n is a, c, g, or t
  misc_feature (1425)..(1426): n is a, c, g, or t
  misc_feature (1430)..(1430): n is a, c, g, or t
  misc_feature (1433)..(1433): n is a, c, g, or t
  misc_feature (1437)..(1437): n is a, c, g, or t
acttcagggagagggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaatgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggtgaccaccccgaccacccactcgctgccccctggtgacctccttcgtgggccccaccacctcccactgtcctctgctcactgagcacccctcatgatccccaagctgactggntagaccccactctntctggagcnccctcagcagaggaagagcagaagnatacaattnggatacancantatnacntgnntcacntncntaccnccacatatacntnatcacctccntacacncnnacacctgcntcacctccgtacncccacanntatncancacntcgtacactccatacaccactcacacatatgaatcacctcctctgcccggggatctctctagatcaccatcagaatc

SEQ ID NO: 626058 - DNA, 1247 bp, Homo sapiens
tggttgcactttccatcctattttcctcccttctctgttcgctttcctgtcccgttgcttttgctcgtttctcgctttgctgtggtcttcgcctgttgttgtgcagcctgtgtgtgcgtgtcgttgctggcgtgttgtgtgttgcttcgctgccgcgtggtggtgtttgcctgtgcgcttcctctttgtcttttttgttttcttttgtttcttttgtctctttctgtgtgtcatcttttctgcttgtctttctttttttcgggttgctcctatacctttgtttttttcttctttcggcgggtgctgttggtttttcttcttggtgttggtggtctgtgttttttctttcttcgactgtgtttgtcttgtctcgccttctccttgccttcggctctgcttctgtgttgtctcgcgcgcgagagcgggcggggtgaaaataaaccggaagcctctttttttttgggaccccccccatattgtctcctgcgttgtgatcccacaacatcacccctctgtttttgttacccctctccatgtttatttacaccgggggtgcgtagttacacattcccctccgggatttttttccatctttccccccgcggggtggggataccttttttctcccctccgggacactccgttgtgtccactcttgggcgcccttttttgggtccgcccattattatccacccgtgttgtgcgcaccccatacacacccgccggtgggttcctccgcccgcgaaattctctcgcgcgcgatattttttgctccccactctgtgtccctcccccgcgtcgtcgccgcccccacagatggtggcgtgtgttgtggagcacgcgaagtatattttggtggccccccccccccccctcactctcacatattttctatatatcacccacctcccccgcgcgcgtgtgtggtgttatatatagaagagggggcgcctctctcgcggggagatacccccgtctctctctatgagggggcgccccctcctctctctgagagaggggtgtttctcccccccccagcctgggggcccccacaagaaattacttcaaccaccttctttctccacccggcggcaggagacaataataacaagaaggccgcgattgtccacacccaaagaagaagatgagctccccccaccacgagcctcccccccactcgtggcgcccccccttttatttgtcccccttttttgggggggggggaaaaaaaatttttttttttttta

SEQ ID NO: 626059 - DNA, 106 bp, Homo sapiens
atccccctaaaatcgatttctatcatattcatctggcgtacatctaactttcttcccacaacactttctcgtgcttatccttgaatgccctgacgttactcggact

SEQ ID NO: 626060 - DNA, 1113 bp, Homo sapiens
gggtccaacatggagacctttgatgtggctgagttggaccatgtaactgccgcccaatggtgcacccaggccatgtgagcatgctactcatgcagccgtgcctatgtggctgggcagtgccctgtgccgtggccagtggacactccgcctggatctccaagccaccatggcgatggctctgcccacggatctcaccacctggctgtggatgccaaagcccatgtgtgacagacacgacgacctgcgtgggccccacgggcgcccccacactacacctgaccatgacatccacctcacagatcgcctacacctccctcagcctgccccacatatggctcagccttcccctccatactcccgaccccagtattgactaactctgaccatcagccctcaggaccctattatggccacgtcgggccaggcctctggacctctactcgtgccttctcctatatggggcaccatcgcacgcggcccctctacacggccatctctgacacacacagacccctcacgggcccctaaacacacacagaccccacaccactggggaagacagctccatgaaatactaccgcacacctgatcccaggtgcccttacaccagtgtcgccgtgctagccaaccaagctcaccgtcacctcccgcctacctacatcccaccgtataatacccactgcatcctacttcccccccatcaccccctcaccactacctacctcactcacactaccaatactcacataccccatacactacccaaaccaacaatcacgccccctcactatcacccctcccccatctattctcacccccgctctcccacaccacctcctcctcccccattcatacattcaccctcactcaccactctcctccctcctcccctaaccccgaacataactccactaacccccacccttctcctcccagaccctcccagctacaccttctacactctactcccccccctcatcccctccctccactttcaccccccctcccccctgcacccctcttcccctccttcctatcatctcccaccttaatacccactcccctgtcccctccacccaccactagatcatctcacacacccccctacaactc

SEQ ID NO: 626061 - DNA, 1077 bp, Homo sapiens
tggtgtcgctctctgtgtcgtgttgtccctccgtgacctctgtgtcttgtggggttggagccaccacgggcctcactggtactgaatgtgttccgtacctgtggtgcgacttgctcagcctgtttgtggatattattagccccgtggcgttactccgcgtttattccgtcatcgtagttcgtcatgtcgtgttggatcacgggataccttttgaattggctgctgcatttcgtgtgttggccggaatctccgcccctccctgttctgtgatctggtgcggtttaccgggcccgctggcttttttcctagcgccacccaggcgtggcgcccctggcgtgcagcggtgatgatgctctcccctggggctggaggccaccttgtgccaggcccaatttctccttagcttttccggggcccccgccatttaggtttcggagctgagtgcggaactgcttcatgggctataaatgtgattttcttagattgatgctccccccctctctgaagcccccagattccagtccccgagggtttgtcatcgttcaagctctgttgtcattcgtttccccggggaccccttgcgcgtattctgtgggctttcgctagtgtcctgcgcccgacgctcggaggcccccccccgtggtcaacggccatgcagcagcagtgtgcgaatggacacgtacttttgtattcgggacgcgcatcgggccacgtagtaccctgtttttacttatgccagggtattctactcttctgcttgttgacaccttttagggcccctccgtctgggagggcttcagtgccactgcattctgggacctctgttgtccccccggcctgcacgggatcaacatggcctggccagccatcgggcgccggcgtgggtcgcgaggggtgctgcctttttcagctgggccgtaatccatttaatggtcctttaaaatgtctgtgtatttaaaatttaaggatacccccccttaatattaaatattcataaggtctagtatcttgataataaagtagatgttttaataaccatttttgtccttcttaaaataaaatggcaaggaacttgga

SEQ ID NO: 626062 - DNA, 411 bp, Homo sapiens
  misc_feature (45)..(45): n is a, c, g, or t
  misc_feature (53)..(53): n is a, c, g, or t
  misc_feature (86)..(86): n is a, c, g, or t
  misc_feature (108)..(108): n is a, c, g, or t
  misc_feature (138)..(139): n is a, c, g, or t
  misc_feature (175)..(175): n is a, c, g, or t
  misc_feature (395)..(395): n is a, c, g, or t
  misc_feature (400)..(400): n is a, c, g, or t
ccccccaaaataagggcccccaattccaaataaattaataaggtncccattanatggtaaataattaataattaccattaaatgtnccctataatattacatgccacnaaaaagaataaggtagcctgtatatttccnngtatggaaaaaacatattaatatgttataaactatnaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttanagccntaaaaaaaaaa

SEQ ID NO: 626063 - DNA, 1560 bp, Homo sapiens
  misc_feature (422)..(422): n is a, c, g, or t
ttagccgccacgcctgtgtgtttgaagaagctcgcgtgctgtagtcgtggggtttgtgccgtcgtggaggaccaccgagggtgcacatcccggctccgagtatgttgtgatggggggcgctgccccgacagcctgtgcgcttggttgcccctgtggatggatacgttgtctccgcagtattgcttctgtgttgttgccagggggggaagccaccacgcttgtgtgggagcccctctctgtttggtggtgactcctgcctattgtgtcgacgtgtgccaccgtaggtgccccccaccccgtgtggtggccaccacctggggtgggttctctacgctccgcctgtgtgagggtgttgttaagggggcgccccccccccccgtcggggtggtgatccgtcggggccctgcacgagttgggtgtgntgtcgtcccaacagagggggagtaggggggggtaattgtgggacgcactcagtgtgtggaagggacgtcctccccaacgagtgtggtgttctacttgtctgctgctgcgccgtgtgtgaagatgtgtgtggagtgttggttgctgtgtgtgtgccgccccgcgccccgactatgcttctaggcgcgcaccaatatgggccgttgcgcacccttggggcggttcctcacccgatgaggcgccgccactattctcgggggaccacttcttgttgtgttacacatattgtccgttggggtcgtttgtcttgtgtgggcggctggccggttgtctgtgtgtcgtctgtctacgctcgccggcgccattgttggggggtgtgtgctcacatggggatggatttatactcttggggcgcacttttctcatcggccaactctcgggcgctgtcacacacgcttgctgtggcgcgccccgcacatgttcgttgtggggggtctcccaccattgtgagagggatatactcacagcggcccctgggcgtcgcgctctccggagcgctttttgtctctcacagcgcggtctgtgtggtgtttgcgcgcacacgctcggtgtggtcccactctgcgcttctccgcacagtggttgtccctctgtagagagcacacactctgtgttgtctgcacagagactgcacacgttttggtgtctgtcctcgccacagagtgtgttcacgagagatataaacccacactgtggcacacctgttggagaatttgtgttccccagcgcccgctctgtggtttccgcggggttctctctggtgccacactctgaggaagactcggggggagacccacacccacccgcgtttctcccacactcccacacggttcacatacccacgaagcctgtggggccacaactgtggcacacctgtgcacacctgtgcctctcacaaatgtctgctatacgaagtgagaccacgctgctggtgtggaaggaaggccaagggcggccccctgggaaacccggctttcaccacgtaacagagaaaagaaaacttgctctgttttgtaacagcgtgttccctttcctcttttttgtccaccttaaagaccccaaaagaattaagaaaaaaaa

SEQ ID NO: 626064 - DNA, 227 bp, Homo sapiens
acacggcggtgatttcccccaccacagctcacagcaacgccagatccttaacccactgaacaaggccaggatcaaacctgaaacctcatggttcctagtcggatttgttaaccactgagtcgcaatgggaactccccatttttttcttctaagagaggttttgttcttatcacctgatgccttcacttctagccactctgtgtcaccacccatcggggtaccgagct

SEQ ID NO: 626065 - DNA, 317 bp, Homo sapiens
tcttgccctgttggccaggctggtcttgaactcatgacctcaaggagatccacccacctcagcctcccaaatagctaggactacaggcacataccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatt

SEQ ID NO: 626066 - DNA, 561 bp, Homo sapiens
acctgcgagggcatcaccagagaaccgagacgatactaatatggaccaagagaagagtaggaacacctctcatggaacgcaatggcaagggaccgcgccagagtgagggaaccaggcaatccggccattatggccggggaggggcgggcagaagatggaaacatgcggatgtcggtcgctgcagggaccacccagggccgcgtataacgccgtatgggcctcggacccgagtcccgcatccatctgtggcggaactggctcacagggctggagcggcacgaacgcatcgaggcaccatgggcgcgagaggacgaaatgaggggctacgcggagaagcacatcgactatgggaagctgggagacactaacgaacgagccatgcgcaaggcggacatctggctaacagagaaggattagatcccaaagctggatcaagcacgggcccctcgggacaaagatcaaaccgggggatacacaagaatgctgaagagcccaaatcggagattggaacgggccaagagggcagagaacgagaataaagggaaacgcctaccaccccgg

SEQ ID NO: 626067 - DNA, 155 bp, Homo sapiens
tggtagtatacacttagcttaccttctgcttgtctttctctgcactctagtctaggcaaaatgctgcaaacatggcactatttaggtcacctagggtatatcctggctgtgggaatctaaagtctatctagaataacgtgtcctttggttgttca

SEQ ID NO: 626068 - DNA, 149 bp, Homo sapiens
ggacgtatacggagggtcgttacggaagggctgttacggaggcgctgttacggaggagctcgttaagagggctcgttacggaacggaggccgttggcgctcggtaacggacggctgttacggaggggctcgttacggaaagcgctcggt

SEQ ID NO: 626069 - DNA, 407 bp, Homo sapiens
  misc_feature (3)..(3): n is a, c, g, or t
agngcatctagcagagaggcaggaccaactgggagagggtcattctgtgacacctactgcatcaccgggctgtgtgaagtgactcagctgccagaactcacacaatatcattctacaccaaaacctcacgggaaaaatcactaaagtttcaatatggcaccttaattccttaacgaagagaaagaatgtatatcttgtggtaatggggacagcagctccatgaatcaaagctttctgtggctcgatctagttcagagtctgagtgatacatttaatgtgccagcaaaagcctctggtaaacagggagcagtgttacagccagcagacccaagagcttgccagagctgatggagattgaagggagcaggttggagctctcctgaggcagaatgagaggaaggctctcc

SEQ ID NO: 626070 - DNA, 244 bp, Homo sapiens
tatcctgtgtcggtgttggcagctggggtgccaggagctccgtaaactgggtgatgcagagtccagtgtcagccccatgactcagtttatggttttttgtctttgagaaagggtctcgctgctgtcgccctggcttggagtgcagtggtgttgacctagctcactgtaatcttgaactcctgggctcagtgctgatcctcctgcctcagcctcccgactgtagctgggactacaggcatgtgcc

SEQ ID NO: 626071 - DNA, 203 bp, Homo sapiens
ctgactatttgttgaatctgacaaagattctttggagatggatatttgtgtagagtatgaataaattaccaaggaataaatacaatcgacgtttaagaacacaggccatacacagctggcttaaaatccttattagcatgagagaatcttttaaaacttgtgaccacgaagccactatcatgcttagccttgggcagaacaac

SEQ ID NO: 626072 - DNA, 669 bp, Homo sapiens
atactacgaatgcctaatccaaggattcccaaatcgcccgcacatcctgaacggtaaaagccccagaggccctagtacgaaatccgcgactaagggattaaacccctagaagactttatatcatcttaggcagacgacccgaaacctgagaatggccattgaacaaagtttgtatacgctacctacgtagactaacggccgaccgacatcccttaatagagggaaagttactagaacgccatccgaaccccgccaaccgaaccacacccgacgagaacatgctgcccgactctatcctcttaaccgtccttctatatgccgcttcctagaacctcgttttaaaaatcgtcttaagggaaaagaagacttctcccgatatagagccccgggagctctaagaatcgtctaacaagaatctctaaagacccgaggcccgcgtggggaccccgacttaactcgcggaacccgaagagcctccgactgggcgccggcccctagcctgccccgaccgaactcctgcctatctactaccgacgcgatgaatcccaaccgactctaagattctctcgtcaagaacccgtaccctccgctccgctacctttaaggaaatctctctccgaatcgacctaggaagcgatgtcatttatttgttgggttaccgctaaagcg

SEQ ID NO: 626073 - DNA, 390 bp, Homo sapiens
ataaaacatgacctattcccgttcatttacgaagctgtcactgtctgtgcttaccatgctcttgtatcaatcagtaggcagtatggtgcatggagagttgtcaaaacaaaactttgtgtttgttgaatgacgtaggggaattattctctttgatttcatgtcgtgtgtgtgtgtgtgtgtgtgtgtgtgtgtgtgtgtgtgtgtggtttttgagatatagtacgctctagcactctattatagtctcctgaggctgctgtcccaaaatcccacaaagcgggctgtgataaacacagcagaaatatattctcaataggtggggaggctgtatctctgatctcaagatatcagcagggcccatgctctctctgaatacaggctgtaggaaag

SEQ ID NO: 626074 - DNA, 501 bp, Homo sapiens
ctcgtgctcagcgtggactggtacatgccgtgggcctcttgttacatttgtcctgctttggccaggctttgtgtttggtcgtggtctcaatccagagagagatccagacatctccaatggattcaggctaatatcagtcacacaatttctgcgtctgtgcatcttgctacgtgacaacaacatagcagcaatgcatctcttcccaggcagcaacttggggattgtggcattctctaagtgagctcacagcaccttaatggcccggcatgaccagacttcaagcaagcaacgggcacgatgaggaggcgtctcaagaagcaaatgcagcactcgtatggcaaaggcgcacgaacagaaagtctggttgtggtctctggagatactttatcattcatttcctcattcagatttggaggctgacactgattataacatctgatgtctctcgatatatggaagaccctggtattgggtatgaagagttagccagaaatatcaggg

SEQ ID NO: 626075 - DNA, 161 bp, Homo sapiens
  misc_feature (137)..(137): n is a, c, g, or t
ttctagaggatcccgcatagttaacaacacatgcgaaacgatagatatagagaaggtaggagtgtagttcactgctcagtttcctcaccttgaaaaatggagagaataagccaggcattgatggttgacgcctgtanatctgtagcactttgggaggctga

SEQ ID NO: 626076 - DNA, 1002 bp, Homo sapiens
gcaagtctatgaactgtagtaagtgtgaggaagtctagcgcacagcatctttcattcaacgagtgtacatgtacagcagttgggagagtaactgatgagctctatgaatcttcacagttatacagtatatgaccagtcatactcgatgagagcatgagtcggttcatggtgtccttttggagattcagctcttaagggattacactctcccagtgagctgctaactaaaggcaggctgctgaagtatatagcagcaatcccacaatagcacacctagcttcagattcagaggatgagcccccttcttgagccctgtagatatgtgaaacttaattatgtagatgcatttcatggcaccagatcctaaggtacagtataggtatttcactggagaccacttactttgcttgctttgctttttgttggcattttggcaggattattcaacttcaaagaaagtacgttgagaatccgtggccctaccaacgggtgatggaaccaggctagggttcctatggagtcggttggggcctctccaaaaagtttcatatactgtgaataaggaatatgataaccttaagcttcgaatgcacagggaagagaacccatgattataagccaaagtttgcacggaaatagggtgagtcttggtgtaaataactagtgagactgtgggaaaagggtagatagcacagggaatcacccccagggtccacgagttaagcagccgccacgaaagagcttggaatcttgagacggggccaaaaattacaatagtcacaaggagagtgcggtgcactcaaccagatagggaaaggagctcacaaagtgcatgaacaaaacaggaacgcagggggcgccggcagagcgcgcacaacaaggcactgaaacaggaacgacagggccgggtgcgaaacgaaaagaaaaacaacacgacgcggagagaatcagccaccgaacagaaaaacagcgacaaaaggagcagaggacacaaaagagacc

SEQ ID NO: 626077 - DNA, 451 bp, Homo sapiens
  misc_feature (61)..(61): n is a, c, g, or t
  misc_feature (99)..(99): n is a, c, g, or t
tggatggagccaggaaagcatgaaagtgagaacccaccatggaagagatggtgtggttgtnttggaatatgcttggccccatgggaaagtggcactatnatgaaggtgtggtttgttaaagggaagtgtgtcactttgtgggtggactttgaggtcctatgctcactcaagctctgccctgtaaggagagaccctcctcctggttgcctgtggaagagaatccccttctgtctgtcttcagatcaagatgcagaactctcgggctggtgagatggctcagtgggtaggagcacccgactgctcttccgaaggtccggagttcaaatcccagcaacacatggtggctcacaaccatccgtaatgagatctgactccctcttctggagtgtctgaggacagctacagtgtacttacatttaataaataaataaatctttaaaaatatatattt

SEQ ID NO: 626078 - DNA, 530 bp, Homo sapiens
  misc_feature (79)..(79): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (171)..(171): n is a, c, g, or t
  misc_feature (173)..(174): n is a, c, g, or t
  misc_feature (176)..(177): n is a, c, g, or t
  misc_feature (180)..(181): n is a, c, g, or t
  misc_feature (183)..(186): n is a, c, g, or t
  misc_feature (191)..(191): n is a, c, g, or t
  misc_feature (195)..(195): n is a, c, g, or t
  misc_feature (199)..(199): n is a, c, g, or t
  misc_feature (204)..(204): n is a, c, g, or t
  misc_feature (213)..(213): n is a, c, g, or t
  misc_feature (220)..(220): n is a, c, g, or t
  misc_feature (228)..(228): n is a, c, g, or t
  misc_feature (232)..(232): n is a, c, g, or t
  misc_feature (235)..(235): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (267)..(267): n is a, c, g, or t
  misc_feature (274)..(274): n is a, c, g, or t
  misc_feature (284)..(284): n is a, c, g, or t
  misc_feature (286)..(286): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (348)..(348): n is a, c, g, or t
  misc_feature (362)..(362): n is a, c, g, or t
  misc_feature (369)..(370): n is a, c, g, or t
  misc_feature (398)..(398): n is a, c, g, or t
  misc_feature (400)..(400): n is a, c, g, or t
  misc_feature (413)..(413): n is a, c, g, or t
  misc_feature (420)..(420): n is a, c, g, or t
  misc_feature (425)..(425): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (452)..(452): n is a, c, g, or t
  misc_feature (459)..(459): n is a, c, g, or t
  misc_feature (469)..(469): n is a, c, g, or t
  misc_feature (494)..(494): n is a, c, g, or t
gagaggtaaacaaaccacgcgcgggctgcccgcggcacggcgggcgcggctggcgcggctggggcggcaggggcggcangggcggcggagagcgcgccgagccgcggccgagctggcccgcccgcccgtcgcacatgttccggaacgctcccgtccntanccnccatcttntnntnnttnntnnnntaaantttnaatnttctnttgtggttnagtaggngggtgatntggnaantctgtttntcntcntcngccgtntgntatagnagattcntgatggtcangncatactgagatttctgtctcttttcccactatgtcgcggtgttgcttngnatngntngnacngggggtcgttgcancatgccnngggggcgatcattttccggtttgcactncngcacagcaaatangactgcnacagnagcgttggncgnantgatcgcgcgccntctgttnccccccctgncgtaagagctattgtgattttattnaccgagttaccacccttgtacttggcgtcaacggct

SEQ ID NO: 626079 - DNA, 232 bp, Homo sapiens
ggaaggttgagcttacacacatcctccgctggcatcttgtatttatctacatggtatgtgacacaacgtgaacatgggtcagaaaatgtctagctgcacgaaaacatttcagccgattctaacacagagggagcatacacatggaggggccggaggtaaggcaggtggatgaccaggcttccctgctcacggctcgtgtttcatgcccgctagcagcgggtgctctgggtgg

SEQ ID NO: 626080 - DNA, 262 bp, Homo sapiens
tgaataggctaggtacgaggctgggttggcttaagctcaggagttcgagacagaaagcaatggtcctcccttctcaagaaaacaagagttggccaggtgcaatggctgacatctgtaattccagtatttgggaggccaaggtgagaggatcacttaagctcaggagttcgagaccagccaggtcaacatagcaagactccatctttacaaagaaaaaaaaagaggctgggcgcggaagaacaggaaaaaaataagaaaaagg

SEQ ID NO: 626081 - DNA, 120 bp, Homo sapiens
caggatatacggggctggacggggtcctcacgccctggtggacttggggtcacgctactgctggtctccagacactcacatactgtcctgacaagtggcatccgtcaagcaacttctctc

SEQ ID NO: 626082 - DNA, 268 bp, Homo sapiens
gcccgccatccgccgcctacttacgcttcaccatctgcgaccctggcgcgctcggctgcagggcgcggcgtcctcttcggctcctcctcggaatagctcgcggcctgtacccctggcaggaggcccctcagccccccggtgtggacaggcagcggcggctagcgacgatacccgggatttcggcggtccccggcgctccctttcccggcctcgttttccggataaggaaggccgggtcccgcatgagccccggcggtggcggcagcga

SEQ ID NO: 626083 - DNA, 251 bp, Homo sapiens
cgttctcaattgctgcaactactagctacaaatcaatacggttataaaaccccaggttctgaaacgggcatttggaaaatccttttttatttttaatttttacggggggcaaaatagaattataaaaaaacgatggatctcacaacagatgaataaaaatatccagaggtcctctaaattttgcacattcacatctttttattatctcacacgggcaagattttgggccgccctcaattgtgtatcaaatc

SEQ ID NO: 626084 - DNA, 551 bp, Homo sapiens
  misc_feature (551)..(551): n is a, c, g, or t
gccttaaccctggcagcatagtgtgagaccctatctctaccaaaaaaagaattacaaaattagctcggctggttgtgtgcctgtagtcctagctacttgggaggctgaggtgtgaggatcactttcagcccaggaggtcaaggctgcagtcagctatgattgtgccactgcactccagcctggatgacagaaggagaccctgtctcaaaaaatagaaaaaccttagagcccaacctttcagttgcaatccagaggttcttgaaggatcagcgagtgtgctagggctgctggcatgaatattagtccaagaaagacctcttggagcataatgtttgcgtgtgctgtttgatcattttccaggtctttctagtaactctgagtaggctagaggaaaagaatcactaaggtaactgtcaacatgctcaagtatttgctttcacctgaggtttaaccctgaatgttgaccttaacccctgactccagcactgtcccatcatcaattttcccagtttgagtaataatatttagtccatatctaagctatggtctan

SEQ ID NO: 626085 - DNA, 209 bp, Homo sapiens
aaacatcctcagctttcctcggattctttggtcctggggacttcgaccccatctgttgacgtctatgccatgaaacgccatgacagttcccccaagaaggaggtgtatttcatgtgccatcatttgatatcctcaacgccatacgtatacaaacgaagaaagcgtgcacatgcttgacaacaacggattttacacggcggcaggggcct

SEQ ID NO: 626086 - DNA, 129 bp, Homo sapiens
gctacttgtgaatgctgagtgtgggaggatcgcttggggcaggtgtgagggacaaggctgcagtgagccatgatcacaccactgcactgcagtgtgggcaacacagtgaccacctgtctcaacaaaaca

SEQ ID NO: 626087 - DNA, 1787 bp, Homo sapiens
  misc_feature (1358)..(1358): n is a, c, g, or t
gtgctgctagcaggtggctcttgcagccgtcaatatacaggccatggtgcaggcagcatcgtgtgattgtcaaccaatcatcacgaagcatgagtgatttatccttggcaagcgcggccgcagattcgatatttccagcaaacgtccagtcaacattgtacagatgcttgggttcgcgatagatagattcgtggagaagatgcatgtggcattatagaaggtctacaatcactgctaatattcaatgtgcagcatattagcagcaaggaacaacctatgcatgggagtgcacagtggtgcaactgaggttcttgttgcaagccacaatagtacgagatcgaggtaaatgtcattgaagatcattttcaaatgtgttgggacagacgaaatagtgcacgcgatggttacgtgattaaaaggcagggctacaagacattgtgagtcgtgttgcggactggttgcagagacaatatgggcaacgatgggacatcaaggtgaggttaccataagaactttccactgcactttacgacccacacgcgcgcgcgtttggaaacctatggacgccagcatagggaccccacgaccaatggaggcaatggaacttaccacaaacagcatatacacctcgggaccatataaaacagtgcaccattggggattcgacccacttggagacatccccctccaagagaacacgggacatataccgacacatccgcaggcggccccgcacctttatgacagatagatttctaggagttgtgggaataaagaagtttgaggaggattcgtgcagagagttaacatttgagagtgctcttttggcatcagtaaatccgtataccacaagatgtttgaatgggactcaaagtggcgagagtgttggcgattaaacaatgttcgtatgacgactaacagcgctacaccagcgtgattaagaggaagtaaacgagataatatttgggggacatagagaatgttcacaatgagagtagacacgcaaatacgattacatgacggaacatgtcgttactaactcagcccaaacatacagcgaacattcaaacacactatatgcgagtagcaagacaaaaatctaatcagcacgacgttaggacagagagatagaacaagcacgcatagtccggagtaggacaaatagcataaacggagccggctcgggaggacactaagacacagaaccagggagcataccactataccatcacagccgagtctggaccggaacaccagaagaccacccatgagacgtcgccccatacatatgagagaccctagaatgggtgacagcaacacaaaacccccacaggaacaagcgcaatcatcagcaatcnagccgacatagccagagaacaatggacaagtaccaaaccatgacagtcgaacaattatacagcacgatcagacaaccagtggcaaaacaacaccacagatgcgcccggagagcagaaccagaccagcccagaacagagcacaccgaaacggaccagcggcaccacgacacccagcacaacaccaacgaccacagactcaacagcagcaaccacagaagatacgcgatagaggcacagcaaacaccactagaaacatgaaggagcagacggcgacagggagcacgcaacgcagcgagcaagaacacagatcgacaagccagtgagacacagcagcaacgaaccagcacaagatgagccacaaaccaccgatcagatcgaccgaacccgacgcagcgatcgacagcagaagacgagcacatcaacagcagc

SEQ ID NO: 626088 - DNA, 167 bp, Homo sapiens
ggctgccttttaaaacatgctgctctttttgtctttgcaaggggtagaaatttgaattctctttgggggtagatcttctgtaatccccttctggtcccagagccttctgacaagttttgtcgactctcacctctgggtctcacctgtgacaactaggagaggaggca

SEQ ID NO: 626089 - DNA, 423 bp, Homo sapiens
  misc_feature (126)..(126): n is a, c, g, or t
  misc_feature (194)..(194): n is a, c, g, or t
  misc_feature (324)..(324): n is a, c, g, or t
ttcggcccggagcaattgtgccacaatctaatcaagataatgactgacacccactgcggacccaaggccatgtggacatgagccggggaaatggtcaggggctgcaggagagactttactgggacncctttttgtggaacccaagctctgtgattccaaaatctatttgtgaagtcccaatgggagcgagagtncgactgggagaatatgggaatgtgatacctgatggaatggaaacggtgagggttgagcaggctttatgcaaagcgactgcagctcctttacctgaatgtactatgggggtggatattgggtctggctgangtgtttctcttacctagcatgctaaagcggaaggcatgtgaatctccccacctgccaatattgattggatgtacttgatggaaaccagtaagattgccc

SEQ ID NO: 626090 - DNA, 238 bp, Homo sapiens
  misc_feature (155)..(155): n is a, c, g, or t
acttacgatggagaatttgttatctaccctccacaagatcttatatccagaacttacaagggactttaaccatttaccagaaaaaaacatcccctttaaaaagtccaggcaaggatatgaaccgacacttctccaaagaagacatttatgttggncctgaaatatgaaaaaactccacatcactgatcctcggaaaaatgcgaaccaaaaccacaaagagataccctctcattcccgg

SEQ ID NO: 626091 - DNA, 165 bp, Homo sapiens
agtattgaaaaaacttcactacgtttctctactgtgcatcggtatcacaggtaacatcaaatcaatgtaatagcttcagtaaacgtcagtagtgttcagctaagatgctgtaattaaatttgtactagggaaggttgatgagaacaaagtgggaaaacttgtaaa

SEQ ID NO: 626092 - DNA, 94 bp, Homo sapiens
aacgacacgccattattatgatgttcgacacgactgtgtatattcgaaaagtgattttcttatatatggcaaattacaaagtttaaaaaggtta

SEQ ID NO: 626093 - DNA, 459 bp, Homo sapiens
cttatccttactgaggcacagtctcgctctgttacccaggctggagtacagtggcatgatctccactcactgaaacctccacctcccggattcaagcaattctcctgcctcagcctcctgagtagctgggactacgggtccctgttaccatgtctggctaatttttttgtatttttaatagagacggagtttcaacgtgttggctaggatggtctcgatcttctgacctcatcatccctccccctcagtctcccaaagtgctgggattacaggcattagccaccatgcctggccctaattttgtatttctagtacagacagggtttcattatgttgcccaggctggtctcgatctcctgacctcatgatctgcctgcctcggcctcccaaagttctgggattacaggtgtgaaccaccatgtccggcccagtttttcctgttctaaggaaacagttgag

SEQ ID NO: 626094 - DNA, 424 bp, Homo sapiens
agcaaagagcccagcctttctacccagacgttacctgtgatcaagtgctttgggcagacttcaagactttttgcttcctccactttccagtcaatcagtgactccctcctggctgtgagcccataactggcctctctccaaaagcctttgcccaggagcatgggcatcagctccctcacgggaaccagcctgctgttcagaccagtttgaccccctacccctttcaccctgtccctcctcaaagtattttttgaagtggttgcattataaaaatgggtatttgtagggccggagggatggtagtgatggggaaaaggtaaggaagggtccccctctgtcccctgtttgcctggctggcccctcatatttcagcaaaaaagccagtggtggccccccacccttataaagcaggttttggttttta

SEQ ID NO: 626095 - DNA, 229 bp, Homo sapiens
aatttttatttattaaaaatttggggttttggttttaaacccaaaattccggctagcccctaccctttcaccaaagggccccttttagccccaaatggcctgttaaagggttttttttttaaaattaaaagattaaataaaaaatattaaataaaccctgcccataagggtccgcctattaggaattgaaaaggggggccccctaaaaaaaccaaaaaagtctttctta

SEQ ID NO: 626096 - DNA, 974 bp, Homo sapiens
  misc_feature (24)..(24): n is a, c, g, or t
  misc_feature (181)..(181): n is a, c, g, or t
  misc_feature (195)..(195): n is a, c, g, or t
  misc_feature (390)..(390): n is a, c, g, or t
  misc_feature (561)..(561): n is a, c, g, or t
  misc_feature (727)..(727): n is a, c, g, or t
  misc_feature (731)..(731): n is a, c, g, or t
ggtgggggatgtgggaaaagatgnggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggatngtggccactgtgtnaggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcantgtggtcatcaatcttatgtggacgagactgggaaaccaaaaactttgattttgaggatgtatctgtgaagattccccaagcaattgttcaatgtccaaggaagctggagttgaaacaattcattcatgtttcacattctgaatgcgaatattaaagctcttctagatatngagaaataaggctggtggcagagaaagtagtgagagatgcatttccggaagccataatcgtaaagccgtcggacatctttggaagagaggatagattccttaattcttttgcaagtatgcatcggttggtcctataccccttggttcttgggctggaagacagttnaacnagcagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgtttcctcccattccccttgccgctttttggctatcgatgggtagcacagagtctttgaaaatagcccatttgagccctggataacaagggattca

SEQ ID NO: 626097 - DNA, 297 bp, Homo sapiens
tttttctgacccaccacggctcattgtagcttctagcctcctgtgtgctcactgcaatcttcccacctgagtctactgagtggctgggactgcgggctcttgacaccatgcccggttgatttgtgtattttttgtggagacggagtcttgccatgtttcccgggctggtcttgaattcctgggcttaggagatctgtccaccttggcctcccaaagtgttggtgattacagtgcgtgagccatcacatccagacaggactgaggtgttctgtttgtgaggcctttaagggtcctatt

SEQ ID NO: 626098 - DNA, 191 bp, Homo sapiens
ggttgttgtatgtaataacagaggcagtatgtacagacaaagtgggaggtttaatttcttggtctcttcctccttggataaaagtcttgattgatctcctaccttcttgggctgggaggcgctcttcacgtgcgcttgcgtgctatcctgtggtccttagaccctgcggggcctacagccgtggtcatgcc

SEQ ID NO: 626099 - DNA, 403 bp, Homo sapiens
aaatcccagctgaggaacattctaccaaatacctgaccaatactccttgaaatcatcaagatcatcaaaaacaagaaaagtctgagaaactgtcacagccaagggagacctaagaagacatgatggccaaatgtaatgctgcatcctagaacagaataaggtatatttaggttaaaaaaaaaaacgactaaggaaatctgaataaagtatgaacatagtttaataataatgttaatcttgtagggctgatatcaatagcagtttattaattgtggcaaatgtaccgtactaaatgtaagatgatgataataggggaaattgggtgtggagaatatgggaactctctgtattatttttgccatttttctttaaaacttttctgaagtaaaaattttatatcgaa

SEQ ID NO: 626100 - DNA, 375 bp, Homo sapiens
ataagacatagtttatatggacatacacttggtatacatagctgtaacacattgtgggtgatgctgtagtagcagccagaattaagagctccaggaccctgaaggagagctaaattcttgccgtggagcccttgtccaaatgctttttttgaggagccttcatttagagttgggccttacaggagtaagtaggagtccctttgttttagggtggaaaggaagtctagacagagatacagtgtgcgcaaggacataaaagtggccatgtacgtggtgtcagtcgcagtactgggaagtcgccactagattagcagcaaagtctgcttggcaggcagcagcaaggaggtaggacaggacatgcaggttggctccaga

SEQ ID NO: 626101 - DNA, 1679 bp, Homo sapiens
  misc_feature (1)..(1): n is a, c, g, or t
  misc_feature (1177)..(1177): n is a, c, g, or t
ntgtggtcccccatgtgggttgggggcgctcctgcactcgttttctcgtggggtgtgctgttgggttgtgcgctcacgcgcagcgccgtatggtggggttgtggcgtccagtcgtgtttttctcacacgatgttgggattggggttgagtatgtgggtggctggcgaggtgtatttgtgtcgctccccgcgtgcgggtgtgccgtccgccgcacccgcctacgtggggtggtttggttgtggagtgtattatggtgctgcctacaccgtgtgtgttcgtgcttggactagtttgtagcacgttgtggggtgggagggtgtgtgtctcgtctgcctccgcgccgcggtatgttctgtccttttcttcgtgatgttgccagcttttgtgggcgtggtcgcctccctatgagggtgttgtttgttgattggcgtcgtccgtgactgttttttggggtgccgccccagactgcctcctgcctctgggtgtctctcaccctttggtggtgtgcagcagctatctccgcctcaatagtcgtccgcctctcgacgcgccatcattgtgcgtcttcaccagcacgagttggtgctctcgacgctgttgcgtcagcagctcacgcacgcgttgtcgcgactgcgttggtccatcacctggcgtgttgtgctctctctgctggggcgttccccgctggtgtggagcacctccttcttcgcgtctggttctaccgcgggggtgtgtttgtcctccccccccttcctgtttgtatgagtggggggttgtttatatgggtggttgtgctccacacagctgtttttgctccccaccgctgtggggtgagagatatattctcagcggcggcgcccttcgcggatgatgatgagtgtgtgtgggccgcttgtgtgccaccgacagtgtcgttccgtagtagtgaacaacagcagtgtggtgttgttaccaccaccaccacagtggtgaggactcccctcctcaggagtagagcacctctctgggggcgcatataatattagtggtggtgtgttgggagaaccaccacccttgctctcacacaaggagaggagatagaggactacaccacacttctgtttctggtgggaggacaccacatcggcgcggctctctgtgagaagagggcaacacgagagatctctatagagagggnaacacactacaacacgggtgagatagagagcacacacgactctatcacgcgagtggacgtgttgtgtctcacacgacgagagagagtgatataagaggagatagaggggggactctctggtggtgtacacacaccacacggagaggagatagagagggcccactgagagtttctctcgggattcaccatcaacccctcttcaacacggtattccccaccacctcatattcacagtcttctcccacaatgttcccctctttcaattccacctctttccttacacacccttatccgcgccaccttccccaccacccccaccccgagcacaccccaacccccactgggaatgtggctccagaattcccggcagcgtggacatttgttcccaagggggccatgatttcccattgaaggactgagaccccttgaataataaaaaaataaaaatatacatcgagcattaatgtcggtctgagaagagtatgttcacctctgttccctg

SEQ ID NO: 626102 - DNA, 944 bp, Homo sapiens
  misc_feature (6)..(7): n is a, c, g, or t
cgatcnncccggtagaggagacagggtgaagagagggtggtacgagaccgaagcagagcatatcaatggctcgaggtggcgtgggcgccatttattacatgacgtgcgcggctacatggtgtccccccgcctgtgcccaccactgtgtgcaatgggcctgggtctcccagaggtaaacggtcctctcgggggctcccgccgccgatgggccccgcccgctggccgatgtgtgcatacgcgggcgaagacccgcaaacacaagggggtcgtaaaaacctggccgccgttcgtcggaggattaaacaagctgttaaaaaaagaagcatccacaacatgtgtgtgaggcagcgccccactaaccggggcggtgtttccgcgaacaagttcgcgtggggcaaccagaacggtaggagaggggctgtcccccctgctctcgccctccagctggggtttggtactcggttgtccccaccccacctggggtcttgtttttaaggggttgcacatcgactgcccgccagtctggaaaagcaacaagggtttataattcaaggctcgccaaaacatctgcgggcttatgtgcttgtcccgcgcgacaacttttaagtggcgttaggagcccaccccaatgtgtgaaaaacttgaaaatagaaatgcttttcggacaaatatatgagtttgtgacacttggcctcaaaatgtatgcgaattgttttttaaattgatggacttgcatttacgccgcctaacatggcatgtcatggtgctattaacattttcacaaggcgccatgtgttattagaaacctttgtgtttgcaaacatccggcgtgagtcacccgtgtaagacagtggtgggctaaaaggtagccccgggaagacaataaaaaattatagccaagatcggagaatttaaacaaaaaggttttttcttcaacaaaaaca

SEQ ID NO: 626103 - DNA, 362 bp, Homo sapiens
taccagggcagcctgcacatgtggctctggcttagctctttgtaagcaccctaaggttttggaaataaattttccgcatttgaaaagtgctgatcgttcacacttagtgcccagatcatctttaataaagctcattcaccactgtaattcacgttgccttggaaactggccgggcaccgaggcccgggtatgtaaagactcctgaaccatggttaagagggccgacatgctcatcaccgaggttcttactggtcaaatccgtgtcactgagagcatcacgctcaatggtaccactagtttgccacatataggatctaatgcatgagtccatgcatgataactatgtactccgggagaccgtg

SEQ ID NO: 626104 - DNA, 952 bp, Homo sapiens
  misc_feature (1)..(1): n is a, c, g, or t
ncggatatgtaaataataacattacacaatcgcccgaggaccctttcatatttgcgagagcatcctcggtgccactatgttcccgtgggggcacgaattcctatcagggtatactccaaagtttcatttgagaggcgtcccgcagggggtgcggacacacccctgagggcatggaaatttatctgctataaacgagtgtcgtgatgtgacaaactggataattccgcgtcccgaaggccccccgctcgtgtttcttcaagaggaatgcttcctcccgccgcctcccaaccgggatctctcctccttggaccgacagagtaatatctgcgtcaagttggaactcttcgcgctcttgccaatggtgttaagaaactgtaagataattccggggaataccgccaaaatagacgttcgtcctctggtggcacggaaccaggaaggtcccccaccaagggtctgtatattacatttccccccccgggcaagatgaatgcgtcagttataaacgacccggaacgttgctcccgtcggggagccagcggaactgttattccctggtctggccacttcccccggggaagtatcacaaacgcgatatcgaccacacccgagtggggagagagtagcgagttatcttatccacccacatgaatattaaagaggatgaataaacacccatagtgtacccaaagacggcgtgtatactattcttgtgttgctcagaacgtgccgcctccccactgggatgtttgcaaaaagagtgcatttactcggagcacgttctgtaaaatccgggcaaaagaacagctggggaagacataaaccccactcctggcgatgggggagccccattctattccgggcagacttgtacaacataccgttttatatcattatagccgcggccccgtttttcaaaacaattctcacacccttcattcttcaaaaaaca

SEQ ID NO: 626105 - DNA, 228 bp, Homo sapiens
tgccatgtacccaggctggtctcgaactcctgagctcaagcaatcctcccacctggcctctcaaagcgctgggattataggcatgagccaccgcacctgagcgacaaccttcatttctgactagctttatactgccaacgacctctgtcaactactacacgcggccactacctcactggcgctccctggcggcggctcagcgcacactgcaacaccactcctcagctg

SEQ ID NO: 626106 - DNA, 128 bp, Homo sapiens
ggaggacgacaacgaacggacggaccgtgggccggtggtcggcactcgaccctggggaccacctactcctgcgtcggcgtgttcaagaacggccgcgtggagatcatcacaacgagccacgcaacggg

SEQ ID NO: 626107 - DNA, 966 bp, Homo sapiens
ggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaattatgggtgaaaattccttattaaatccaggatgggctcttgagagaacgggggagaccattccgtggcctaacagtggttgaaaccccatttttccttacttaaaaattccaaaaaaaaaatttagccgggggttggtggcgggataccgtgttagtcctaagctaccttgggagaggcgctagagggcagcgagaaaaaatggggcggtagaaacctgggagaggggtgtggacgctttggcagtggagcgccaaaggatccggtgccactgggacctcccaaggcctgggcggcagaacaggaaggcaaaaggaactcccggtcctcaaaaaaaatctgtccatgcagcacgaacagaacacaacactgcgggggtggggaaacaactcccctataaaaaatccccagaggggatggggcgactcctgggaagacatcaagtgagggcgaaaaacccaatgctgggggtctaaacggtgggggggaaaaccccccatgtttttctacctaagacaagaggaggagcaaacaaaaacaacagagcaacagcaacaaacaaaaacaatgttgttgtgcagccgccgcctactggtggcgcccctcgagtagaaaaaaagctggttttattagaaaccagaacgagttgagtggtgagggagcgccgggggccgccaccaaagtgtgctagtagtggtacaccaagcggggcaaaacaagagggtgttgccacaagagaaaaagctacgcggtgaaaaacaaaaggagtgggggggagtactccccccacaagataaaagtcg

SEQ ID NO: 626108 - DNA, 666 bp, Homo sapiens
gaaactatcaaggtacgacagtggcatgtcatcgacactcaatttcatgtgaattttagcaaacaggacaaggatagatcatcagaggatcggcaatttatccgggtggaccggaggagtggggtgggctcaaggatctggcgtgggatggatgagctacctgtagagtagtctgctgccgctggtagtagtgacagtcaggtcagatcagtgccaacccagtctctgtttactgcttgaacagaattcttccttcccatgcttgggtactcgggtgacctgttgtgcagatgccggctgacctgaggagcaagaggtgagtaagaaaacaatctgcagggtccaaaagccagtcacagttcagattggcctgcccttcaacatctgggcagggctggctcctgggcagggtggggagaatagagagtgaagagttgacagaaagggaggtgggtctcagagctcgaacagaggccgatcgccgactctggagggtcgacgagaagagagccggtcagaagcagagcgtagcgagagcaggaggaggggggcaccagggggcgagaccagcaagcgaaaaacaaagacgacacaccgaggagagggggagagaggcagcgcacaaaggtcaaaggtcaaggggacaaagaacagaacgggaagccg

SEQ ID NO: 626109 - DNA, 207 bp, Homo sapiens
  misc_feature (8)..(8): n is a, c, g, or t
gggtgcangtaaggatagatggcgttggtaagggagtgcactctgagtgaaacctgagcatgacacagctgccgaggaaaagactgcacatggtcaggggcacagagtgtgccggctgtagagccgctttcaggacaatggaaaacattttcaagcaatactcttgaatacatttggactcaaagagggggcggcgagactcttgga

SEQ ID NO: 626110 - DNA, 698 bp, Homo sapiens
  misc_feature (100)..(100): n is a, c, g, or t
  misc_feature (179)..(179): n is a, c, g, or t
  misc_feature (199)..(199): n is a, c, g, or t
  misc_feature (223)..(223): n is a, c, g, or t
  misc_feature (226)..(226): n is a, c, g, or t
  misc_feature (235)..(235): n is a, c, g, or t
  misc_feature (262)..(262): n is a, c, g, or t
  misc_feature (275)..(275): n is a, c, g, or t
  misc_feature (312)..(313): n is a, c, g, or t
  misc_feature (341)..(341): n is a, c, g, or t
  misc_feature (353)..(353): n is a, c, g, or t
  misc_feature (362)..(362): n is a, c, g, or t
  misc_feature (368)..(368): n is a, c, g, or t
  misc_feature (464)..(464): n is a, c, g, or t
  misc_feature (486)..(486): n is a, c, g, or t
  misc_feature (506)..(506): n is a, c, g, or t
  misc_feature (561)..(561): n is a, c, g, or t
cgggcgcctcggatccgcccccgggatggcccgcctcctcccgccccgcgtgaggcacgcacagggcagtgcgcgggtgggtgggtcctagcagcgcggnctgacgggaccaaggcggcgggagtctgcggtcgttccctcggctgtggaccgggcggcacgcacgcggtgcagggtancatggcggatgcggaagtanttattttgccaaagaaacataganganaaaggagcnggaagtcattggcagaagaagatgtangccgaaatacaanacgctgaagaatttcttatcaaaacctgaatccaaannttgctaagttggacacgtctcagtggcncccttttgctanaagaatttngataangctgaatgtaaggacaacacactatacacctcttgcatgtggttcaattcctctgaagagagagattggggactatatcaggacaggtttcattantcttgacaagccctctaacccntcttcccatgaggtggtagnctggattcgacggatacttcgggtggagaagacaggcacagtggtactctggatnccaggtgactggttgttaatcgtgtgctagaacgagccatcgcttggtcgaagtctacaacagagtgcaggccaaagagtactgtggggatcgtccggctgcacaatgctattgacaggggggacccagcttcctag

SEQ ID NO: 626111 - DNA, 142 bp, Homo sapiens
gtctatacgtctcatactctgacgttctgctgccgctccttggtcttctgcagttcatcctccttggcctgcatctcctccgtccgtgccgtgtgaccgtgcagcagtggcttcactttggtgaaaacgcctccacgcaggg

SEQ ID NO: 626112 - DNA, 310 bp, Homo sapiens
cccggcgtcgcgccatccttgatacgaggagctgaggatggatctggtgaccatcggtcacattaattcccatgaggtggtgaccttcctgagcaactatgtgatctgcgcttgggacagcctgcgtctcgtgtgtcttgccttctggaagactatttttccaaactgcaggaccgataatccgcaccttcaatatggattgctgctcctcctcgcagaaaccgcatcattgccatagtctccatggtttcctggaacatatcattatcctgtgctgctgtcgatgggcaccaagtccattgggggttac

SEQ ID NO: 626113 - DNA, 215 bp, Homo sapiens
tcgggtaacaggatatggcagaaggatataccgggactctaacgggacaggcggattaaaaaccgggcagccggaagcctatgtgcgcagggatttctcatggactaacaacatttcccccgcatcccccttccaaacaacaatcccccgtctagctaaagactcacagacccacggcgggtcacatgttcctaggagcttctagacaggcccgt

SEQ ID NO: 626114 - DNA, 479 bp, Homo sapiens
gatgtacacacgcttagtctggtgcgtcctgtcatcgctcctcatagtccctgctcagtgagagagctacggcacgagaatcgcttgtccctgtgatgcggctgttgcagttcgccatgatggcgccactgtactgcagactgagtgacagcgcaacactccgtctcacaataccacaaaatcactcaaccaaacggattttcactgaacactgaaagcataaagaggaaaaaaacacgataaaagggaggagatccttttgaagcatttaaaaaataagctgatcgattaccttgtgatctgtccttgaatggctaccgtataggcctctgcgaaaacggtccagcatggtgcaattaaagtagtgagtgaggctataagggtaccagagcaaattagcaattgcattcaaaaagagatagcgacctagaaattacgaaaccttgacttaggactaagtctgaaaggccttaacaatg

SEQ ID NO: 626115 - DNA, 224 bp, Homo sapiens
caagcgtttggtcgaaatgaagaattagaaatgtcgtccgagcaagaaataatgagtgacgaggggtttagacgggttgcaaagggcccgagatgtttggagatgccagaaaaggatcgaaaagtcagaattgacaagagatttcgggccatgtttcatgacaagaagttcgagttgaactatgccgtggataaaagagggcgcccattagccatagcactaca

SEQ ID NO: 626116 - DNA, 150 bp, Homo sapiens
gtaggtggtccgaggagatagcaggagtacattcaaatattaaacaactggtatacaggaaaggggacagacactggccgtgagcagtggcgagaaatatgctcagcttcaagctgatctgtagctcccgcatctgtcctgcttattcct

SEQ ID NO: 626117 - DNA, 316 bp, Homo sapiens
gcaagtagtaacccttcatttcttttgggttttaatttttttttttaaataaatggaaatgggttctccctatgttccccaggctggttttgaactcctaagctcaagtaatcctcctcccccagtttcccaaagtgttggaattgtaggcatgaccccccatgcctggctgcaattagtaagtcttcagatgcttccatccccaccccccatccgatgccacccccatgaatgcccctcaccaaaaactccctagttgaatccacccaaactccagccccatgaaaaaaaaataaaattgttgtttgagtcccta

SEQ ID NO: 626118 - DNA, 126 bp, Homo sapiens
cagacctcggaggtgcttgagataatcatccgctgagggtggaaggggatagagcacacactcgtgaaggtgtctatgaggctcagtggagttatcaatatatagaaatgtagtttgagtttggag

SEQ ID NO: 626119 - DNA, 1699 bp, Homo sapiens
tcggactcggcgcccagcgcgcgaagcgctaacccgctgagagtttctgcagcgaagatctcaggtacgatctggaccccgctgagaggaactgcttttgagtgagatggtcccacaggcctggatggagcgtgactggtaagcatgcgggagggtagtgggagttgtgcttctgacttggtgccttgaacaaggcttccacggatcattcgctatgagatcccggaggaaacgagagaagggtttcgcgtgtgggcaagcgtggtcgcgaaccttggctttggatctcggtagcctctcagtcccgcaggttccgggtggtgtctggtagctagccgaagattctttgaggtgaaccgggagaccggagagatgtttgtgaacgaccgtctggatcgagaggcgctgtgtgggactactggcctcttgcactgtatactctggagtcggtacgtggagaacccgcgtggagctgttcagcggtggcaagtggtgatccaggaccgtcatacgaacaagcaatccgtgctttacctacccaggatatgacatggagattagcgaggccgtggctccgggggacgcgctttccgcatcgatgagcgcgcacgatcccgatgtggcgaagccaccgtcttgacaaaaccttatgagcctggaggccgccacgatggaactacatatggccgccaatcgaggtggcagaacacccgagaagagacaggagccacaggtacccggcaccacctagacgcttgcgagcgcggtcccccggatacgcgaaaacggcgaagacaaaactacacacaaacgaccagacagacgctgataccggcacgcgaccccacacgcgactaacaccacgcgcagcgcgccgttcatctcaatctccggatgtgtgagtcgcaagatagatcaaaccgtcccgcgatctaatcacaccacgcacctcagattatctcaggctccactcacaacatagttatgctcacttaccacatggttgcatacactatttatactcattgcagttagattccaccgccatcattatagtacatctattacaacagcagcgcgacctctctattactcaactctagttaagatatattactttccgactcagttcactagtcacacaaccgacacgtctagcagaataaacaaatcaataagagaagagtctagatcgaagagactgacagctacgaaacggacgatacgaaaaagcaccaacacacggagagaaaagatacagaggagagaaacgacagaacagcactgacaagataaaaacaagcaagaaccaacaaacagccacgagaacgacgcacgacagagcactagcagaaagcacacaaaagaacaagagcaaacaagacaaaggcaacaaaaaacaagcagacacacaaccgacgacaaagaaaaaaacgacacagaaagaaaagaaacacggacacaaaaagaaacaaaacgcaacagagagaaaaaatcgagacacccaaagaaaaaaaaaacaaaaaccaacaacagcaaggaacacaaagagaaaaaagaagaacaaaagaaagcaaacaagaacaaaaagaaggaagcacaagaaaaacagagcaacacccacgctaacaaacaaaaaacgcacaaaacagacaacaagacgagagaacacgaaaaaacagacggcacaaagccagag

SEQ ID NO: 626120 - DNA, 149 bp, Homo sapiens
ctgagggaaggggtgtaactgctaagtgtgggtaatctaggcagttcctacaaattcacaaacacttaagtacctgggcctaggccctctccctataggaatgagtcctagcaaatcggcttacccctagcagataatgctttgcacct

SEQ ID NO: 626121 - DNA, 1239 bp, Homo sapiens
agcagctggtacgagccggaattttgggcatgttgcaagtcttttgctggtggagggtcttaccttgatgctgatggctgctgactgatcaggatggtggttgtcgaaggtgggagtggctgtgatgacttacccactgaagtcttgaatccctcaaagtcattgatgagagttggactcagcttcttccagactcctgtgaatcaacattttgaaggatatttgaccttctcccatgaatcacaagtgttcttaatgacataaatggtgaatcctttccaaaaggttttcaatttgcccacatccatcagaggaatcactatctatggcagctatcgtcttatgagatgtatttcttaaataagatttgaaagtcagaattactccttaatccatgggctgcaaaacagatgttgtattacgacaggcatgaacaataacattcactctgctgtgcatgtctatcagagctcttgcggtgaccaggactaaatcactttcgctacttgtacatatcacaatctgcgacagtacatcatagaagtctggcgacgcaacgggatctcggcaccacaatggactgccattatcggcattcctatgcagctaaaaccagcaacgacgagtatctctgtcaccgaaggtacccttcttcgattcccctctgcttccatcgctcttgcgcttgccctctgctgcttgctgcttcccctcatcgagcttgcctcttcggtcttaccctggacccctcctgactctctgcccttactttcccttgtatggcgccttccttgtccctcctcctcttccgccatccttcgccgtcgctataccgcgctctcccgtatccgtcactgatgaccgactccgcttaccacccgccggctctccgttctgctactgcttgagcctcccgcaccgacgtcgctcgtcaccgcgccttccctgccccctgctgctccttcgccgcctcgcactgcttcggtctgcgctggttcggtttgtgcgttgtctctgcgctcggtcggggtgcgcgtgcactcggggatcgtcactcgctccgcctcttggcttgcttcgctctggtgccgtgccgagctctggcctgagctcgctttgggctggctcctggctctgcgctcgccgccgtgacttcgttattcgctctccgtctgcctctgtctggctgtgccgtgtcgcacggcttcttgttggctcgtcttggcgcgttgccctacc

SEQ ID NO: 626122 - DNA, 1575 bp, Homo sapiens
ctacggctaggtagcgaggcctgggttgtaggagagactagtctcagtttctatttttgtttaattgtacagtgaagggcaatttattaagcagaaaatattgggagggaatctgggtcacagacggggaccgacggtgcgaccccccttcctgcgagggctggtcagaggggagtggggggtgacattccttcaactccgcccgaatcttcaatacccgaggcgggcaagtggctcgtgatgggccagacgtgtggcccacaggtccagggggtctgggatccatagtttccctccgtggtggccgcggagtttggagtggtgtatagggcgggggaataccacagctctccttgggcacactcttggggccaaatgtccgtggggcagcgcaacatataggcagcatatagtgggtgaggatttcatcttgcgggtcgtggccttatacctttcattccgcaccaggtcacagcgggcagagtgggttctccttgggccaggaaagactcaggtgacagtggaccaaagaggtggtcatgtgaagggagtgcaagagaatagtggcagaaaaccaaattacatttctcttcctttcgaggccaccgtggaggttccggaggcgtgagatgaccgtggtatctctcctatcgtttgtcctttcgcccttcgcggagggtgccactttctgtgcacgttcgtactccagaacgtccggaggagaaacgtagggtctctcgaaagggtattatatgaagtatacaagtgattgtgtctatctattgttttgtaatttgtatgttgtatgtgttattatcattctatttcatctctcctttgtggctgtagtggagaagaaagaggaggggaggggagagcgcgacaatatacgacgaggggggcggacgtaacatcgccaaaattcatgatgagacaaaagggagcgaggaggacaacctcccccccagcaagccggacgaagaggcgcgcattggagtgccgggcgcgaccgagggaccaacccacccacacacatgagcagagaccgaagacaccaccgcacaggaagtaagagggcacgagtccacatacaacgagagagacccataccatcgaacgaaagcaggggagaccgaagtagagtgagagcgacactgcggagacccaccccacccagcggggtgaggggaccccaacagcctgtgaggaccaaacaacgcgcaggcggggagaaagcacaacacggcagcggcgagaacgaccacccgagggaaagagaaacacacgcagggcaacgacacgggggggaaccacaccacccgatgggggcgaggccacccaccatcggatgcagcacgacgggggccacgatacccgccggtgtaaaacattcacaccgcggcaccgcccgacgcgggcctcgagcagatcgcactgaaagggaggagagagaggcccaacggtgggggagcaagccgcgaggcagaagaaaaaaccagcagcagatcgtggaggaggacgcgggacaccacagtgcggagaacaacctagcacaacgtgcgtgggcgaagccgt

SEQ ID NO: 626123 - DNA, 110 bp, Homo sapiens
agatgctctacaggtgtctccgatggtgtttgttgagttggcacagatcgagattaggagttgtcacttcgattgtcgaagaggtatctctaggccctctcggtaatgca

SEQ ID NO: 626124 - DNA, 762 bp, Homo sapiens
atcggaggtggcaccctgggatgccggcagtgagcggagctgcgtgatgccgactgtgtctccgcgtcggtcatcggtccgatgcctgcgtcgttctgtccttccgaacgcacatcttcaggagcagccgcgagggtggcatggtgaagcgagcacagacatggctggagctggaggagatgcttccgacaaagtttgccatccatggtgaaccccaaggccagtgggcaagaagatgaatggcgaggaactgggccaagctgtgcaaggactgcaaggttggctgaccggaacatgtccgtgacatgggaccgaatgtggacagtcgtcttctccaaacgtcagaggggaagtcatgctctgggtcatcaactaatgagggagttcaaggaaggcccatggaagaagctggacgagcaagcagattcaagggcgaagacgcaaggaggaggcctatcgcatgcccatctgccagctggatggcatggcacaagagcccagccaagtgtgggcgtcactaaatgcaaaaaacagtggggtgctggtagaaccggcctgacggaccaccagcagaatacaccgggctcccacaaggaagcgcttcgactgagagcggcaatggtcaagggcattagccgggaacggcatggacaatcctgggacgaacaggtgtgctaacgttgagcgccctagcaagaacttgccagggcaccttaccgatggccaagggtgacaggaccgttgagggcttgggcaagaacc

SEQ ID NO: 626125 - DNA, 677 bp, Homo sapiens
gctgaaattctttcacaatcagggtgtagaggaaacaacttacaaagaatcaagaatcacctctcagtcagagcatggtggctcatgcctgtaatcccagcattttgggaggccaggccggaggatcacttgagcctaggagtttgagaccagcctgggcaacatagtgagaccctgtccatacaaaaaatttaaaaattggccaggcatcgtggcccacgcctggaatctcagcactttgggaggccatggcaggcagatcacctgaggtcaggagttcaagaccagcgtggccaacatggtgaaatcctgtctctgctaaaaatgcaaaaattagccaggtgtggtggtgcacgcctgtaatcccagctacttgggtggctgaagcaggagaatcacttgaacctcggaggcagaggttgcagtgagctgagatcatgccattgcactccagcctgacaataagagcaaaactccatctcaaaaaaaaattgtttttaattaaaaaatcagccaggatggtggtgcacgcctgtagtcccagctactcgagaggctgaggtgggaggattgcttgagcctggaaggttgaggctgcagtgagccatgattgtgccactgcactccagcctgggtgacagagggagacctggtctcaaaaaaaaaaccaaaaaaac

SEQ ID NO: 626126 - DNA, 175 bp, Homo sapiens
  misc_feature (49)..(49): n is a, c, g, or t
  misc_feature (69)..(69): n is a, c, g, or t
  misc_feature (152)..(152): n is a, c, g, or t
taaagttgtcatccttccacagaaaatgatagaccactagaaatacacngttattttcgtaatgtaaanttcaagtgttacgcttttagaattctgagattagcctgcttttaggatgagtcgagatagccgtcgttgttgtgaaatgatgntagatcataccgtttgggcgttt

SEQ ID NO: 626127 - DNA, 126 bp, Homo sapiens
tccagctgatatcgtttttgtctctttctaaactgtttccctctggtgtgtcctcactacctggcatagtgccacgacacacaagtagttgctcaataaatgtgttgactggctgttgcagaaacc

SEQ ID NO: 626128 - DNA, 130 bp, Homo sapiens
tggtgattagaggatctcgggagccttaccctggtctagttctcggtagctgggtaactgggcaagtcacttaaccctttgagcctcagcttcctcatctgcaaaatgggaacagggtaaggtctcccgg

SEQ ID NO: 626129 - DNA, 365 bp, Homo sapiens
cgcagagaatcgctgggcccgggaggcggaggttgcagtcagcctgaggtcatgccactgcactccagcctgggcgacagagcgagactctgtctcgcaacaaaataactacgtaacttcacaggcttcactactggacattactcgtgtgacgatcagttctcacttctctgagcttaaattcccaggaactgcaatactgggtcatatcgcacttacgagctgctgaattctactaagaaaactgtcaaatcgtttcctagagtggttttaccattttacattaccactaacaatgtgtatcagttatccagttctctgtatccttgttggcatttagtgttctcactgcttttttattttag

SEQ ID NO: 626130 - DNA, 683 bp, Homo sapiens
  misc_feature (666)..(666): n is a, c, g, or t
tctctaatttaaacctttatgggaagcttttaaagttttggtcaaaacatggagtgcttggcccaatcactggatagggatatgggcaccaatggagggggtaatcaatggaatatagtctccataagaactattttccagaagtctcttctggtggtagaaagcagtcacgagttatcttaagtggtcaaccagtttatatacctaatcgggtttttaataacttctggtgaagagcataatcaaacgggaatttgcttttctcaggggataatacaccagagaaaacagatgtggcccaaatttttaaaagaagtttattcctggagaagtctcatattcgggtggacatctggcatggatttcaggtatacactggatgggtacctggtatatccataagtcatattaaaccattctctccgggaaatcagggtacagtcactggcccagaaggtcactgaggaaacaagccacatatgggtccggcacaatggctgggtggtacaaaggaatctacaagggaaggtgtggtcaaaattatgttgctcctgttggtcggcatcactatcgtgacgttactgtgttcgtagaacgtgccaaaaccgcttatttcacaaactggcactttcttgggccaattgaatttatgcttccaaattatcnaggctgttgaacagcag

SEQ ID NO: 626131 - DNA, 315 bp, Homo sapiens
ttcttctttcctcctcccacccttctttctgtcattcttctcccctcatccttcatttttcctccctccctctccttgacttattttgctgagcatgataatgcccagtttaatttgtttccgtttcatctttctttgtgttgaattcactatagacacattatagacacatttgtagacacaccctgtttccattatctgttcacccttgatggacttgcagatcccataccctaattattgtgaatagcactacaataaacacaggcattcaatattatatttctactatgtactgattttgattgtcgacgc

SEQ ID NO: 626132 - DNA, 687 bp, Homo sapiens
attctaagtggagacgaggtcttgctatgttgcccgggctggtctggaactcccagactcaagcgttcctcctgcctcagcctcccaaagttctaggatttacaggtgtgagccactgtgccctaccaaataagcagtcaccctcattccctcttttccccagacctggacaacccccaatccgcattctgtccctgtgggtttgcctgttctgtacacttcatatgaatggctcatacaatgtggggctttttgtgtctggcttctttcacctggcttcatgtttttgaggttcgtctatattgaggcatgtatcagtaatccattccttttaatggctgaataatagtccgttccttgcgtggatggaccacaatttatttgttcatccatccatctgtatacattgtttttgtggacctgtgtggctgtcataggcaccgggccctctagcactgttatgaacaagtagcgcgtgaatctttatctcaggagtggggaaacaccaaccaaacactcccatacgcaaatatcttggacgaaaaccacggtagaaatgcagagtggggctgagcgcggtggctcacgtctgtaatttcagcgctttgggaggccgaggcaggtggatcatctgaggccagcagttcagaccatcctgggcaacatggcaaaaccctgtctctattt

SEQ ID NO: 626133 - DNA, 419 bp, Homo sapiens
ccacgcgtacgcatccttctaaaaaagtccattaaaaatgtttcttgccaggcgcggtggctcgcgcctgtaatcccaacactttgggaggccaaagcaggtggattacctgagatcaggagttcgagaccaagcctggacaacatggtgaaacccttgtctctactaaaggtgcactgaattgtgctgggcagttggtcggtggtgtgccttagtgatccctagcgtgagtcccggacggctgcagacaggcagaatcagcttgagaccttggcgaggtcgcagggctagcgacgtgaaagctcaggatcgatcgccagtagcactcgactcctggactaggtcgacgagcagcggacgacatcgcagcgtacgacatccgttactacaataaaagggggactaaaaaaaaaaagggg

SEQ ID NO: 626134 - DNA, 219 bp, Homo sapiens
tgcatactgggcgttggaaagcacgtctcaagactgtagctgttccagacttagctgcagatgcttacctaccacggcgtctccaccagaaaaccatcgccaggtcgtgcgatcagcttgtgacttacaaaccgttgtttaaaagctgcttacatggacttctgtcctttaatagcttcccctcggttgtggggcgctctgtgtatgcctgggatcctt

SEQ ID NO: 626135 - DNA, 303 bp, Homo sapiens
tgaaatatgacgacatttttaacgaaattgtataaactattttcttaaagcacacttcctccactgccagagatcttgaatagcctcttggtcagtcatccggaaacaattcttcacataattcgatgaatttggcttcccctttgggatgagaaccacctttgtctatacttgtcttgcatatgtgcgttaatgtcttctacataacttacgtcctttcggtgtcttaatggcacttctttcctgtctcttgaaggattcttgtccttttgatcttgtgtgttgatatgggtcgacgatccg

SEQ ID NO: 626136 - DNA, 928 bp, Homo sapiens
gcactgggaccaggtaaaactgccgcctttgccctgcctgtttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggctggatgtgaggtctcaggaagcacgtctctgcgggcagcgtgatgatcactcatcggtcgccacccgagggccggatcgatggatcacctccatgacggcccttccttccacctgagcagacatcgaggtgctcatcctggacgaggctgacaggatgctggatgagtacttgaggagcagatgaaggaggtcatccgaatgtgtcccacaccgcagaccatgctcttctcggcaccatgacagacgaggtgaaagatctggcttctgtctccttgaagaatcctgtccggatattgtgaacagaacacagatgtggctccctttctgggcaggagttcatccggatccggctaatcgtgaaggagaccgggaagacatcgtggcagttgttgacgaggaccttcactgacatgtgatgctgtttcacgcaaaaccaagaagcaggaccacgatgcaatcctacctggggctcatggggctgctcggtgggtgagctccattggaagttgtcacagacgcagggtggaggcctccggcgtttcaggatgacagattgaatctcggtggcatgatgtggagccggggacttgacatgaggggtcgaaccggacaatccaatgctatacatcaagctatgtcacggggggcaagaagggtggaggaggcgcacctggtggacaacaacgagtaccagactcaaggagctgagagcggacccaccgccacggacacgaag

SEQ ID NO: 626137 - DNA, 128 bp, Homo sapiens
cgagaaagagatattactaggcatttctgtcactttccccctagagatccgattgcacccctgtgggcccgtagggccctctcgcagaccctgggtgagggtgtctttgtgaggctccactgcggtct

SEQ ID NO: 626138 - DNA, 603 bp, Homo sapiens
ccatggtatcagcagagaaggccgtgatgttaccaagaaggtgaaacactcaaggacagtgaatgccacaggcctctgctcatagctgtacccatgttgctaaagatgggaatgagctatcaatgtctaccctatctccttgttacatcctttttacaatatccttgggtgatgcttcttttcatggggctattggaaaggctccaacaccaaagagccagaccagccatttacgaatagccattcaccatcggactgaggaacctactgggagagtgtgaatatgttggtgtttcctgacttgtgctcagagcccagatcaaaacactggcttgatcttactttgaaacatcgacctcaggtgcagcagtgtaaattctacaccaggaggtgggttggactcaggaagtccactacaagagcagcaggccatggtagaaaatgatctgccatacccagtggcaaaatctgggccagtatcctaaggacccactcagtagcccacagaccgattcttaataccttcacaatccaggcttgttggtgctacttcaaattcacaaaagaaaggggcttataataagacaagcactgatacactcc

SEQ ID NO: 626139 - DNA, 340 bp, Homo sapiens
  misc_feature (123)..(123): n is a, c, g, or t
acattcctaaaaacatattttatggatattatttcctaatcctcccaattatcccatagtcttgcaaggtattaaaaatgtcttttgtggccgggcgcagttgctcacacctgtaatcccaanactttgggaggccgaggcgggcggttcacgaggtcaggagatcgagaccatcctggctaacacggtgaaaccccgtctctactaaaaatacaaaaaaaattagccgggcgcggtggcgggcgcttgtagtcccagctactcgggaggctgaggcaggaaaatggcgtgaacccagcgggggggagcttgcagtgagccgagatagcgccacttgcac

SEQ ID NO: 626140 - DNA, 256 bp, Homo sapiens
tattaaaaagaggcctggaactcgaaatgggtggagtccaccacatctcagcaattgcggatacccctccacctgccaagctgcagttcatggcaggtcaatctcagacctgctgcgctagaagggagcaaggctcggttgctttggaacctgctcagccaggcaggggaggaatattcccgggtctgccgattgcaaagacttggggaaaagcgcagtatatattgcaggagtgtaccatttctccaggtacaga

SEQ ID NO: 626141 - DNA, 796 bp, Homo sapiens
  misc_feature (531)..(531): n is a, c, g, or t
  misc_feature (795)..(795): n is a, c, g, or t
gttgttgttgtttttgaggcagagtctcactctatcgcccaggctggagtgcagtggcgctatcatggctcactgcagcctcaaactccccaggctcaggtgatcctcctgcctcagcctcctgagtagctgggattacagatgcctgccaccatgcctggctaattttgtatttttagtagagacggggtttcactatgttggccaggctagtctcgaactcctgacttcaggtgatctgcccgcccggcctctcacctgccaaaaaaaaaaaaaaaaaaaaaaaaaaaaaaaaaaaaaaaaaaaaaaaaaaaaaaaaaaaaaaaaaaaaaaaaaaagggggggggggcccaaaaaaaaaccccggggggggcccaagccccccgccgcattttttgatacaaaggaagggccccccctagagggggcgcacaataaaaaacaacgagaccgaggggcgcgaggcacataaaaccaacgacggcaggcaagcgggaaacaaaacagcagtgacaacggaggcgagccacnattggggagagaagaaagaccacccccacactgccgagggggcggagaaacacaaaggggggagacaacacacctcgcacagagaagtatatcacacccccccggggagcggcaaacaaacaaccacggacagacggatcataagatggcggaacaaaccaccaggcagcaatcagtggagtgcgaggcagagaaagacataggtgcgccaacagcgaattactagtgtacaacaattttcaccgacgggggggagataagaana

SEQ ID NO: 626142 - DNA, 1462 bp, Homo sapiens
ggtcggccctgcctcccggaccaccctgcggggcgccaccagcgatctggaggtgcggggctcggacctccctgcgctcctggctgacggaccgagaacgtgacagctgtccaaggctctgatacctatgccctgcagccatgagggcctatgaagctggggctatcccatgggagctggatacctaaggttggagctgatgcccctggaagacaccgcaggacactgacccaccgcatgcatagatccagtggatacatttcatggtaagcaacatgagccagtccaataccatacatcaaaagagacctagtccatgacacagtggcacaggcacgcaacaattacagccatgagaacaccaaagatagtgacacatggatgacacaccagggataatcagatctagatagggcaattgacggaatcaacaaataatgatgcaacatcagcatgatagttacaagtcgaattgggacaccacgtggagacttcatagagcagagcaatgagacattaccccatatacatatcaccgacacttgaccaaaattaggagggatgagtatcatagaagcatcacaaggggacaaataacatagaagtgaggcatatcccaatcccatttcacccataagaataacattcaaacagtgaaggagcacacgattgcacaagacttaccgacccgcgatatgcgccgacacaaagtccccacattttcgccatatgtgcgctgggattgaattgcaaagacgaccagcaggctgtcacagcgattaggaccccaaaggcgacgaggtttccaagacgcaacagggagggaggaatccaaacaagatagagataatacaatataattagaaaaggcaatattatacaaaggttaacaagcaaagagatagaataaagaaaaataaagagggcactcatagacgaggagttggaacacaacgcacggtaaaggacacagggaaacaagtgatacaaatagcgtagtatactcgtagccgagaaagtacgggacacaacgaggtgaacaaaacaacgcagaaatacccatgatgggaggcgaacgaaaaaagatgacaagaacaagcccgaggaacaactagaatactgaaacaagaggccacgggagagggctgtaaggtgttgatggatggtgggtgagatcgatgagcatggtgtagttatagtaattaactctaaaataacaatatatagaaatctatggctactacaattactaattcaccattcacttaacaccactatagcatagtcagcaaatactgagatatagacataaacacaacactattacaatgagtataatatgataagaaaacacacgaatacaaaagatagtagataaatcaacaatgaaaaatacactcctaatgcaaaccgcatcataagatcaaaccgaatcataaacaacaacattagcatacacaat

SEQ ID NO: 626143 - DNA, 550 bp, Homo sapiens
gcgtcgacgaaaatcatagtgcagtcatccctcactgctattggtgagtgttatttacgttttactcttttgtgctctataaaacagtttacaaacatgcagttaagtataaaagttatttaaaataatgaggctctgggaaaacagataagaatagaaagtccaaaacttggtggaaaattggagcacaggaaagttggccataatcacacatgtggtttttaaaatcaagcaacagttttgactcttagcttcttgaacacttattgtctttaaagaaaagtaataccagcttggcattaggtttgaaagagttttcacatagggagtggtgagggatagagtaggtcccagcagcgtccctttaacactcactcacataccatgtttctgaaagttatagattttggcatttcttgttagaacttgccggcatgctgggcgcagtggctcatgccttaatcccagcactttgggaggcaaaggtggatgatcactggggtcaggagtctaaccaacccaacaacatggcgaaaacctctcactaaaa

SEQ ID NO: 626144 - DNA, 264 bp, Homo sapiens
ataatcccccactctttataaggggctggtaaggcagagtattggacagcaggacttctttggccagttagccctcttaggagttacctttgtttaaatagacccagaacttgtatgaagggaggaaataatggttaatcttaattacaagcggatttagccatgaatggtttaggcttttcctgggggtattcctttaggcacagttgaggttggacagggccagcatgcatatgtctctctaaatgtctgccctgggtattt

SEQ ID NO: 626145 - DNA, 429 bp, Homo sapiens
  misc_feature (157)..(157): n is a, c, g, or t
ggaccagacttgcagcctaaacgtgatcatgttctccatgtgacattccccaaagaatggaaaaccagcgacctttaccagcgttttcagttgccgtgtgggtaacattcagatatcctgggattgagtgacacatcaggcatttgtttcccttagnccagcccgaggcaagtagaagagttgcgtgtcaataccaggcaagatatggcagtaaagcttatcggatccgaaatcctatgcttggaatatatggggagcaaatacaggcaaggagacagctagatcgaaatcagaaagttggactgggaagattagcttggagaggcacggctgtacagcgaataggggttaaacgccccagtgcgatacccgtacaaccgctgcacgaagtcactattacgcgcaacaagtagttttgacagctcgccc

SEQ ID NO: 626146 - DNA, 477 bp, Homo sapiens
tcccagcacatcaaagcaatcagttagtcactccaacacaatcattcatcatttcaagcatgctcaacaagcacacacaacaatgcaaatgtcacatcatttttttccaacattcacttcctttattggcactgtgtcccagaatttctcacacacagtctggccttaacccacttttcaagataaacaaagcttatttataaaaaaatctcctagaattctcccaataaaatttcactataggatctatcataagtggtcatagcctaatcacaatggggacacattccaacagagaccgaaaatatattagggcccaaaccaggggcccaagcaagaagctgtgggtgaaacacatgggtaattaaatagggtaaagccccccaaattttaggccctgtgtgggacacacaagacacacgcgttttttcacaaaacattttttcaaagcaaaggcggcaaaagaaacaggcccaa

SEQ ID NO: 626147 - DNA, 102 bp, Homo sapiens
ccctctatccttagatgctttgaagctgtggggcgacctactttcccttagcctttaactggacttggcgtcactgtagcctttatcgggggttaggcttta

SEQ ID NO: 626148 - DNA, 161 bp, Homo sapiens
tctgaggatctcaatttcatttcccaaaggaacctattcccatcaggagtattctccccattcctcccatgctccaggccctgtaactactaatctgctttctgtctctattgatttggctgttgtgggcatttcagatcaactgggattatatcgctgtg

SEQ ID NO: 626149 - DNA, 1187 bp, Homo sapiens
gttagccggcagaacgacaggtgtcgtgaaaactacccctaaaagccaaaaagggaaaggaagaagactcatatcaagcattgtgcgtgcactaggacgtagattcgggcaataggtccaccacctactggccgagtctgatcgtataatatgcggtggcatcgatcgataaagaacctatctgaaagaatttgagaaggaggctgctgcagatgggaaagggctccttcaagtatgcactgggtcttggataaacatgaaagatgagcgtgaacgtggtcatcagcattgatatctgcttgtggaaatttgagaactagtaagtgactaggtgactatgattgatgtccctaggaacacatgagactttagtcaataaaccatgattaccagggaccattctcaggctgacctgtgctgtcctgactcgtggctgctgagtgttggtgaagttcgaagctggtatctccaagaatgggcgagatccgtagagcgatgcccttcgtggcttcacacactggtgtgtgagaatcgaattaattgtcgcgtcgtcacacgataatggattccactgagccacctacagccagaagagatatgaggaaattgttgaaggaagtcagcacttacattaggagaagttggtagaacgcgagagagtagcatttgtgccaagtttctggtggaatggtgacaacatgctggagccaagtgcttaacgtggcctgggttcaacggcatggggacaggtcacgcgtcaggatcgggccacgccagattgggaaacaccgctgctatgaaggcctggggcaggattccaaccacacaacctcttccaaagaaagagccttggcaacgcgcatccacgcaggttacaaccactgcggggacatgtcaaggcgcatcctgcacgcagggagcaaaggggcgccaaccggagggcgggggcgaactgcgatacaaaaacgaagaagcggagacacaactagagacgtacacaaaggtagtgagcccacgagaaaaagagagcaagccaaaaagacgccagacggatgctgcacagaggtagaacgccaacacagggaaggtcgacacgaaactaaaccaacaacgactgactacaaaaagcgcaagccacacaaaaacaccagctcgtggcatgcaccgctcgtcgcgccagcactact

SEQ ID NO: 626150 - DNA, 1364 bp, Homo sapiens
ggacagatctgagagagcagtgagttcgtcgagttcgtgctccgtctcgtccatgacttccttgagctatcgccagtcgtcgggcacggtcgttccttttcgggagtgcctgaggctggcggctccgtgccggtggggggccagcggggtcgccttgacgctgctgccggaggcattcatcgggggcctccgttgggcggctggcgtatcccgtgtgctcctgcccgcgtttgtgtcctcgtccgtcctcgggggtgcctacccgcggcggcttagggcgagcagatccatgaaccagcgttccgcacggtgtctgcctggcgtggcaacgaggagagcgtaactcaatgccaggagagcttcaaacgacgcgacatgagatctccataccttggcaccacacgttgtcgcgccctgtgaaggcgggcccaacagagacatcctaagaggtgctgaaatgaattccgcaaagtctggctacccgagagagcaaggggcggccaatggtgccccttcgccgtccggaactacaagtcgctagttacttacacacgacacaagtccaaggtcacccctgcgcgggaaagcgtggagttctatgagatggcatccgatagaggaacgttccaagtggaattaggtgcccttggcggaatcggcacccatatggtgccgcggtcttgggctgcacgattgcacgtttccctgaacccaggagttttgacccacgggagaacaagggcttacgtgccaggcaattgacctgttggaagggacccggacggatcacacctggtgcccatgcagcagacggcttgcctttgggacatgaaagcgtagcactcccttggggccacaggaaccagaaccatgggaggatagccagcaattcgaaaagagcccactggcgcagggaaaagcatgcttgggcctaacccttgaatgaaacgcaaccgatgagggaaggaaaactcaagtagcgcttagaagtggggcccatgctgtgagaaggcccaagggtcacagtggctaggacaggctaggaataccggctccgcggacacaccgggattgttcaggcacgaaatgaattcccctgggtggttgaatgattgcggcacaggccccaaatacttaaagcgtccagtgagacccgaacacattaacaccggggcaaagggattgccctgaaaggccctgtggattacacccatgaccacggtaccttacaagcacatatttggtaccccgagagatggcctcgttgatgccctagcatgcagtcagattccccaggaatgagacgctgataccgacacggttatcattgtatcgtgtggagtgccgccccatcacaggagtgt

SEQ ID NO: 626151 - DNA, 298 bp, Homo sapiens
ggtcgacggcagtcagaacaaaaggagaaacatgctcggtttctacggcacctattaagatgaagaagtaggccgggtgcagtgactcatgcctgtaatcccagcactttgggagaacgaggcgggcggatcgcttggggtcgggagtttgagatcagcctggccaacatggagaaaccctgtctctgctgaaactacaaaattagccaggcatggtagtgcatgcctgtaatcccagctacctgggggggctgaggcaggaaaatcacttgaacctgggaggtagaggttgcagtga

SEQ ID NO: 626152 - DNA, 202 bp, Homo sapiens
acctgtgacggaatgggcatgggtagggagaagcagggtatgggatgtgggtgcaggggtaggggctggagtaggcaggcaggtccctcacctaacctggcttagtcatctgagatggcatgtctgctgcagatgggcaggcgtcttgagtggtccaaggtcggggagtctgagccactgtggctgctgctggagctgctca

SEQ ID NO: 626153 - DNA, 436 bp, Homo sapiens
  misc_feature (300)..(300): n is a, c, g, or t
gctcgactgggcggcattgatgtagcggattacgtttcggggttggttcatcgcggcacacacgtcaggattgttatcggtccgttatgctaagttggcggcaaaacgcatttctgccaacaaactcatcaaaccagacagacttgtagaatcagacatgctaatcagccacttcctacacggcccagtcagcgcctatccccgcgactacgtcgacggcgcacaccaggaactgcacgtccatcaggaagcgcagttgctctatgccgtgtgcggggtcatgcgcctggtcaccgccgnccggtggtatcatcccgccaacccgcgccgtgtggattccgccctgggtcgagcatgagattttcatgagcggcgaagtgcgcatgcggtcgttatttatcgccgccgagtattccccggccaacctccacggttg

SEQ ID NO: 626154 - DNA, 230 bp, Homo sapiens
gggccccccgggccccacaggggccgggggggggccttttgccccccccctgggggggggattgggggtttttttgcccttggcccccttttgggggggggggaatttcccccctggggttgggccttctgggggggcccccccccccccccccttgggggggtccccggcccctttttttcctttggggcccgggggggcctccttttttaaatttttttgggttttga

SEQ ID NO: 626155 - DNA, 469 bp, Homo sapiens
  misc_feature (53)..(53): n is a, c, g, or t
  misc_feature (68)..(68): n is a, c, g, or t
  misc_feature (103)..(103): n is a, c, g, or t
  misc_feature (107)..(107): n is a, c, g, or t
  misc_feature (120)..(120): n is a, c, g, or t
  misc_feature (132)..(132): n is a, c, g, or t
  misc_feature (174)..(174): n is a, c, g, or t
  misc_feature (438)..(438): n is a, c, g, or t
  misc_feature (454)..(454): n is a, c, g, or t
ggttgcggggttcggggtttccccccaggtaaaatgaccctggaaaccgaagncttgtggtcccttgnaatttacaacaaaactggctgcaatcccaaggacncggnaacgccctgaggnaaggcccctgancgaatgtggtgggcgacccacaatgtcgtgtgccccgttgcncaagctggctgggcgactggctgccccagggtgcccgggtctaagcctacgtctttgaacaccgtgcttcccacgctctccctggcccctgtggatgggggtgccccacggctacgagatcgagttcatctttgggatccccctggacccctctcgaaactacacggcagaggagaaaatcttgcccagcgactgatgcgatactgggccaactttgcccgcacaggggatcccaatgagccccgagaccccaaggccccacanatggccccgtaccccnacgggggctcagcag

SEQ ID NO: 626156 - DNA, 682 bp, Homo sapiens
gggcctatgcccgggctgcggtggtgggggttgctgcgcgccgggggtcgctcctgctgtgtcttccgctccagcttcgcccacttccccttgccagctggggtgggcgcggagaagacctgccggagccatggaggacgaagtggtccgctttgccaagaagatggacaagatggtgcagaagaagaactgcggctggagcattggatttgctaaaggagcttaagaatattcctatgaccctggaattactgcagttgtgcagctgacccctaatggctgcttaatgcactctccactttccaagtccacaagaatcggaatgtcagttaatgctattcgcaagcagagtacagatgaggaagttacatctttggaaagtctctcatcaaatcctggaaaaaattattagatgggccatcaactgagaaagaccttgacgaaaagaagaaagaacctgcaattacatcgagaacagcctgaggcaatgagacagaaagtacttccagcggcaatgtaagcaacagaaaggatgagacaaaatgtcgagaatacttatgtttcatcctttactcgggcaacaagcacttactgattctgtgcggttgaagtgtagggagatgcttgatgaagtcttcgaaaggggatggactacattgcaattggagctgatgaggaagaa

SEQ ID NO: 626157 - DNA, 90 bp, Homo sapiens
tcagcattttcagcagcgacttgtctgcccgggaggatgcaacaccatctgcctccaccggccacctttcagtggttcctgctttccaag

SEQ ID NO: 626158 - DNA, 282 bp, Homo sapiens
aaggggaattccatgccgtctacaaggatgacctaagaaattgctagagaccgagttcctcagtatatcagaaaaaaggtgcagacgtctgttcaaaagagtggatatcaacactgatgtgcagttaacttccaggagtcctcatttctgtgataaaagatggcgtgcagcccacaaaaaaagccatgaagaaagccacaaagagtagctgagtttaacggcagaggctgggccactggacatgtacctgcagaataataaagtcatcaatacctcaaaaaa

SEQ ID NO: 626159 - DNA, 981 bp, Homo sapiens
  misc_feature (11)..(11): n is a, c, g, or t
  misc_feature (62)..(62): n is a, c, g, or t
  misc_feature (72)..(72): n is a, c, g, or t
  misc_feature (87)..(87): n is a, c, g, or t
  misc_feature (102)..(102): n is a, c, g, or t
  misc_feature (124)..(124): n is a, c, g, or t
  misc_feature (162)..(162): n is a, c, g, or t
  misc_feature (271)..(271): n is a, c, g, or t
  misc_feature (682)..(682): n is a, c, g, or t
tcaacgtgaanatgcccctggatgtggagattcccacctaccggaacctgctggagggaaangagagcggtntcaatctccccatcnagacctactctgccntcaacttccgagaaaccagccntgagcaaaagggttctgaggtccataccaagaagacgntgatgatcaagaccatcgagacacgggatggggaggtcgtcagtgagcccacacagcagcagcatgaagtgctctaaagacagagaccctctgccaccagagaccgtcntcacccctgtcctcactgctccctgaagccagccttcttccatcccaggacaccacacccagcctcaatcctcccctcacaacctctaacccctcctcactggccatccctcgtgtccccaacagcgacatagcccatccctgcctggtcacagggcatgccccggccacctctgcagaccccatcttttaaccttggctgttggcagtgagtgagcctggctcttgtgctggatggagcccaggcgggagcggtggccctgtccctcccacctctgtgacctcaggcaatagcctttggctctggagacagccccagagcagggtgttgggatactgcagggccaggactgagccccgcagacctccccagcccctagcccaggagagagaaagccaggcaggtagccanggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggggcccacctccccacgccctcccctcccctgctgcaggggctctggagagaaacaataaagagattcaccccca

SEQ ID NO: 626160 - DNA, 193 bp, Homo sapiens
gttacagtgagcactgtctatcatgtgactacccacagtcacagtgaggacactgggccccaggatggggcggcaatgccaagaggaccaggttaccctggcaatattggtcccgtatggtgctgcaagtgcacctaggtcctcatggacccgtggatcctgctggcaaacatggataccgtgaatggtcgct

SEQ ID NO: 626161 - DNA, 822 bp, Homo sapiens
  misc_feature (100)..(100): n is a, c, g, or t
  misc_feature (166)..(166): n is a, c, g, or t
  misc_feature (195)..(195): n is a, c, g, or t
  misc_feature (228)..(228): n is a, c, g, or t
  misc_feature (236)..(236): n is a, c, g, or t
  misc_feature (239)..(239): n is a, c, g, or t
  misc_feature (241)..(241): n is a, c, g, or t
  misc_feature (276)..(276): n is a, c, g, or t
  misc_feature (301)..(301): n is a, c, g, or t
  misc_feature (331)..(331): n is a, c, g, or t
  misc_feature (342)..(342): n is a, c, g, or t
  misc_feature (484)..(484): n is a, c, g, or t
  misc_feature (553)..(553): n is a, c, g, or t
  misc_feature (662)..(662): n is a, c, g, or t
  misc_feature (677)..(677): n is a, c, g, or t
  misc_feature (711)..(711): n is a, c, g, or t
  misc_feature (812)..(812): n is a, c, g, or t
ggaggcgggcacttggggggaaaggtgagacgtgattaccgggtggggcgggccccatctgggaggggtttgtgggtgaacccggggtccaccgcccgcngaggagatggatgaggacgggcatccccccaaggggtcaggcaaagacccgaccaaggtgccagcnaaacaacagaaaagaacgggggcatcccnaaaccaataaggggggcacacggaacagtaccncaaccgcnaancnacagaaagtgaggagaaacaggcagaccaaccacnccgaaaccaacaaaaagaaacaacncccaaaaaaaaagaagcaaagaggtcaacnaacccaggccnagaagaagtcacagtagaagaaaccccctaaaaagtcaccagtgtcacaaaaggagcacaacccgaagccaccacagagcaaccacagcagaacagaacacaagacacaggaccacaggaaagtgaaggatcagcagaaaanaacccaaccgtagccaaggaaccaagacaagccagacatcacaaaacggttcaagtgggtgtaccagtnatggcaataagaaacaaaatgatatcagaaggactagacccagatcttcttgagaggccagatgctccagtgcctgatggcgaaagtgagaaaactgtagaagaaagtncagatagcgaatctncttttagtgattaagcttaattttgataagaatnacatatgcatgcataggggtacatttacattctgtaagagattgagcctgaactctctcagtcataaaaacatcaaatggccacatgtccactaccaagcntctgctatgt

SEQ ID NO: 626162 - DNA, 108 bp, Homo sapiens
tgtggtgttctagaggatccgccgtgtaaatctattttcccccaagaagcctgcacgacaccagtgagtgagttctaaaagatacccttggaatagctgctgtagttg

SEQ ID NO: 626163 - DNA, 118 bp, Homo sapiens
atacccgagctatgcctgcaccagactaggggagtcccacctcccctgtgtcttatgcatgtgccatgcatgtttctgcttccgtgcctttccacatgtgccctgtgcaggcatacct

SEQ ID NO: 626164 - DNA, 402 bp, Homo sapiens
tggggaaaggaaggtggcacagaccatgttccctggttcctccctgccccttgccaggcttccttattccttactatgggaagaggtcatatcccttccctgcccctcgctgtttttagcaagcaggtttcactgcttcattagaagaggacaagtcaaaagtgaatctttttcactattaaggaaaaaatccaaagctttccaaaaatggctgctgccaccctgggaaagtttgggccaaaaacagggccaaagcatctgtgttttaatctccaaacaaaacatctatgggagttcatcgttcatgttggggtcagtgcttcgtggcaaatggctgtactggatatcccagctttgctgcccttgttttgctgcatgttaaataaaaccattttccctgta

SEQ ID NO: 626165 - DNA, 355 bp, Homo sapiens
ctctgcgcggggctgatggcatcctgcgtgcccacaagcaccatgggcaccttgctggcgttgcggaagctgcaaaaacccacgaagtagttgtacaccgtctggaaactgatttcatccttcaggctgaacacaaacaccactggattcacccaggcagcaaactggagcttaggggggcctccttcattttggatcaacagcaggtaactttggccattcaccacaattttctttttaaaccgccccccttcaggggactcctcctggacataagtccccgtcaaaaaacggggcaccaggggtgacttcccgctaaaaaggttccccactatgcccactttaaactccggta

SEQ ID NO: 626166 - DNA, 583 bp, Homo sapiens
ttcgacggtgtctgtgcgagtctccaacagctgcccctgattcagttcagttcagttcaacttgattcatttacgttgaattcaactcaactccaaaggttcaggctagagtcttccttggggaaggattgtcacgattcctttcttagagctctcagtcctatctctgaagcccagggcactctgcgtgcaggaggcacttaatgtttagaaagagaagtggaggccgggcgcggtggctcacgtctgtaatcccagcaccttagaaggctgaagcaggtggatcgcttgagaccaggagttggagaccagcctggtcaacacggagaaaccccatctctactaaaaatacaaaaatcagcctggtgcgatggcacacctgctaggcctagctactcaggaggctgaagcataagaattgtgtgaacccaggaggcggaggttgcagtgagttgagattgggccactccattccagcctgagaggcggagcaagactctgtctcaataaacaaaacaacaaaaaactgtccaggtgtggtggcacagccctgtagtcgaacaccgtcgaaggggtccgagct

SEQ ID NO: 626167 - DNA, 361 bp, Homo sapiens
atgatactatttaggcttattcaagaatagttcacagtactttgggacatgaacatcatcatctctatgcccacattctatattcagtcatggcagatggagcctaccacgaagacactgatgaatcttactcaagatgttgcataatcctcaactatatgagagcatgcgaatttggctgatcacgagtaccaagcttaagtgggaaatacaggacttatttatttcgccattcttcactgaagattctgatacttaatctatgttgttcattgaattccatggttaaatctcataacatatatactttattgaatcatccaaccgcataggatacattgacccagaacctgaccttggt

SEQ ID NO: 626168 - DNA, 529 bp, Homo sapiens
acatacaagaaaaggcagtaaatccgagcgtccatcaacaaatgaatcaaaaaacaaatgagatatatatgtacggtggcatattattcagccttaaaaaggaaagaaattttgacacatgagacaatatgaatgaaccttgaagacattaattatgctgagtgaaataagccagccacaaaagaacagatattgtataattcctcttatattaggtacctaaaatagtcaaattgatagaaagtagaatgttggttggcaggggctggcaaggagagggaaatgaagagaaggtgtatgaagggaacagagtttcagttggggaagacgaaaaagttctgacagtggatgatggtggttgttgcacagcaacatgaatgtacttaatgccacagaactgtatgcttaaaaatggttgaaacggtaaatttgatataatgtgtattgaacctatttccagatcaaaacagagagatctacattccttttggtggtgtcaaaataaaccattatcttgaaatagcctaaa

SEQ ID NO: 626169 - DNA, 1112 bp, Homo sapiens
gacgtcttccttttttttgtttttttgtgtgagacggagtctggcactctgttcgcccaggccgtggagcgtgccggggtgcgaatctcagcatcgcgtgcaagctccgcctcctcccgggttcacgccattgctctgtgccatcagcctccgtgagtggcgtgggactacagggccccgtggccaccatgtgcccagcataatttcttggtatttttatagatagaagacggggttttcaccagtgttaagacaggagcggtctcgaatcctccgtggagttgggtgactcgtgcccggcacttgggaccttccccagaaggtgacgtgggattatacgacgggtggtgacagtatacacgcgaggccccgtggacactctatttattattataattatattatatatacagcgtgtgtattgtccattatatttacatcctgggatatttagagggacccactacgagctctcccatacagagtgtgggcctctaacagagtctaggtgtataacactaccagggtgagcacgtctccggcactctatatctctatatgtgccccagagggcctgttgcaaaggttttcacacaatctgtgtgtgctgcacgcggcgcatgtggggcaccacaatgttgatccacacggggcgtgaaaaaatcaccagaattcgaaaacgaggcaaatcacacagggagggaatttaacacaaaggggtgcgggggcgcacatataacactaccaaataacagcgggggagcgaatcagtgcacaaggaaacgattggcccacgagggtgggtgccaccaaaagaaaatacgtgcgtcaaagggcacccacaagcaggaagcacacaaagaactcacgcacgagtgaacaagggggctaaacctcacccacgcccagatagaggacacgacccgggaaacgggcaaccatcaacccaccacaaaaagacaaagaaacaaaaccctcactacaaaccggtgggccagcaaaaaggctcacaacaatatggcccgacacagggagctcacaaccacaaaaaccaggtagacacacgagaacaaacagatgcaacgccgaaccaacaagccacaccaatagtc

SEQ ID NO: 626170 - DNA, 210 bp, Homo sapiens
tcctcgctcccctcccagcccctagcagcagcacttgtcacgtgggtccgcccgttctggaaatttcctgcgcaaggaatcggtgctacgcggcttttggcctgctttctttgccgagcaccaggtttccagggccccgccgccggcagcttcgtcactctgcgctaccgggcgacctaggggttgccaccacagtgagccgggggcctg

SEQ ID NO: 626171 - DNA, 919 bp, Homo sapiens
tatcgtcgacccacggcgtcgcatccaaatggcggatgacgccggtgcagcggtgtggggcccggggtgccctgtgtggccctgtggatggggaaccgcggtggcttccgcggaggtttcggcagtggcatccgtgggccggggtcgcggccgtgtacggggccggggccgatggcctgtggagctcgcggaggcaagggccgaggataaggagtggatgccctgtcaccaagttgggccgcttggtcaaggaccatgaagatcaagtccctggagggagatctatctcttctaccctgcccattaaggaatcaagagatcacttgattttcttcctggggggcctctctcaaggatgaggcgtattggaagaattatgccagttgcagaagccagaccccgtgccggacgaggagcaaccaggggttcaagggcatatggttgctatacgggggaactacaaaggggccacagtagggaccctgggggatggttaaaagtgggcttcccacaagagacaggcgtgtggcacaacacgtgccaatatccgattgtgtaaccatttaatattccatgtgacccaaagcgatcttaccaaattacgatcaccccacgataagcgacaaaacagcgcaataattgggtggagaaaacaagtgataattacggcaaaagacacacataaaaaagtgtgtgtaccccttttgacaaaagaggttggtaaaaacgaaggcaggaattagaaggaacaactatgaggatataagagaaatactgcctatagaaataaccactgagagatccaccaaggcgtggcaaaaaagatcagtaaaaaggaaataaccgcgaaagcacaagagtggtacattaaaaaaaaaccgtgtacacaataaaaaaggaagtagaacatcaaggataa

SEQ ID NO: 626172 - DNA, 605 bp, Homo sapiens
  misc_feature (39)..(39): n is a, c, g, or t
  misc_feature (111)..(111): n is a, c, g, or t
  misc_feature (124)..(124): n is a, c, g, or t
  misc_feature (147)..(147): n is a, c, g, or t
  misc_feature (160)..(160): n is a, c, g, or t
  misc_feature (180)..(180): n is a, c, g, or t
  misc_feature (188)..(188): n is a, c, g, or t
  misc_feature (203)..(203): n is a, c, g, or t
  misc_feature (205)..(205): n is a, c, g, or t
  misc_feature (211)..(211): n is a, c, g, or t
  misc_feature (248)..(248): n is a, c, g, or t
  misc_feature (254)..(254): n is a, c, g, or t
  misc_feature (259)..(259): n is a, c, g, or t
  misc_feature (279)..(279): n is a, c, g, or t
  misc_feature (293)..(293): n is a, c, g, or t
  misc_feature (300)..(300): n is a, c, g, or t
  misc_feature (318)..(318): n is a, c, g, or t
  misc_feature (325)..(325): n is a, c, g, or t
  misc_feature (337)..(337): n is a, c, g, or t
  misc_feature (354)..(354): n is a, c, g, or t
  misc_feature (550)..(550): n is a, c, g, or t
  misc_feature (587)..(587): n is a, c, g, or t
accaacacttatgtgggtacactttgtatatcacacttngatacaacactttgtatcggaatacagagaaagaagaacacatcccacagtgcataaataaccatatttaanacctctcaaagantttgtatagatcaaaaaggttancaagcagcagganatttccatcttctgtgaaangtttaggnggcagaatgtgtgancncaaggntttatagacaatgtgttccacagtccacttcccggcntttggnatggngccaggggcttcactctgcngggctgggggggtngggtccncaggtatgtactgcttcngggtggnatagaacatagngctttctttactggggntttcgaaacattccttttcttcgtcccaattcacctcagtggctagtcgaagaatgaagataggcagtccctccaaagggggcacatagttgtcaatcagaaggggtaatccaatcaggttcccttcctcatcaatttccaaagagaaatagtctgcaagcatctcagccttcttcttcagaaactcaacaatgtnttcagcaagtccttctttgggaccatcttcctctgtncagccactctctggacta

SEQ ID NO: 626173 - DNA, 718 bp, Homo sapiens
taaatgaagtaagcctttatttccttgattttggcaaataaaacgggctaagtgggtctgcttttgggtgattagtcaaagagaccaaatcccatatcctcgtccgacctcttccgactcattccttggcattcaaccttagcttggtggctgcagccagcagcatggatgcagcttgtgtgtggcagcatgccacaggggcagcagccacaaatggcagatgtgatcagccaagaaggccattgaccatttatcaggcaagatgtgagaatgagttgtaatcctgtctccacagcacaaaggccaggacctcgtttgtcaccctgttgattgataggaatgggggtcacttgtatgcaacatgttgggtgtaaccccaatctggcaaacagaccactgggcaactattgcggacaaccctccgaggacagcgaaaatgcagatgttccctctgtgatcatcaacgccctctcacgggtttgtccgatcgctgcccattggtcgaacaccttgcttggtttgacctaggccccatagaggccgaacgcgcggcgcgattgcttgacgctattgttcagccagctgtggtctttcggcttggctccccccctatgtgccctccaagtctgtgaatccagctgtcacatccactccatgggattcactttggtgccccctgagaaattcgctcggtgtacctaaacgctcgcacactggc

SEQ ID NO: 626174 - DNA, 225 bp, Homo sapiens
gcatggcggatctcaagtggctttctcaccccaggccattatttggttgcgaagccgatttaggccacagaattaggcatctccccccattggagcagctagcatccttaactgattcgcccgtacgtgtagagcgtaaacaacctcgtcctcgtagcacagtagtatctccatgccgtcggtgttggggaggaacgatgatggcatggggcgtgatctggctct

SEQ ID NO: 626175 - DNA, 893 bp, Homo sapiens
gtcaaccgcaaaagactcccttctgcccctcttcagagcagtccttcagctatttcatggctctcacccgtaggtttagatctctttttggacacttattatatattgccagggggaatatcatggcgcgcaaggttgtgcggagtgcgcgacaaggcatctcatggcgaatgggttccccttggttgccctccatatggtctcaaacatggcgccttagccacacgtgagtgtcatagacccattggtgctacacttgagtcacgcgcttaagaggtccccgaggagagctataagctgtggggtgtctaaccccacgattttctccagacactcacgcttagtgtatgaagctctgcgaagacacatatattgagcactaaacgcaagtttcaacacccacacatatgtggggcttgaaaattctcactacggagagaggagattagaaaccagattctcctaccctatagtgtgttgggccccaacagcagcgtgtggcgacaccctcagaacactcctcctgtgtgggcccaatcaacatgacaatagctcccttctcgcgcaggctgtttacaaagccatatttcacacctaacaattgggaccagcgcgactgtatcattgagggtacatgtgaacggcgacacccgaaaagtatctgtgttgaccatctgtcttgggacacaacgccaatttttagcgtccgtgcacaacctgcttacataccttttgaacaaatcttacacgtgatcacgtacccgcacggggcccttattactgtattccccaagcaattatgggcgtctccttgtacctaatcattgtgcgcccataacaaacagattcaatcattccgccacacgatgaccaacgccccggtctacaaatgt

SEQ ID NO: 626176 - DNA, 115 bp, Homo sapiens
tgccaccaaagccgacatacaccacacagcattaggggtagaatcaagattgccttcctgtctaatgagccaggaccttccccatccctggccctggggatcccccttttcccca

SEQ ID NO: 626177 - DNA, 255 bp, Homo sapiens
tgctggtggtgggagtgtaacaactatcgtcctccagcctgggcaacaaaagtgagaccctatatctactaaaaatacaaaaattagccaggcactaggtgtgccgcactgccgtctaataccagctactggagaggctgaagcgggagaatcgcttgagccagggagatggaggtagcagctgggccacagatcacaagcactgcactccggcctgggcgaccagacaagagaccccgtcttaaaacgaacaag

SEQ ID NO: 626178 - DNA, 395 bp, Homo sapiens
  misc_feature (372)..(372): n is a, c, g, or t
tgcataaataaaagtatgtcagcgggcatggtggctcacacctgtaattctagtactttgaaaggctgtggtgggaagatagcttgagcccaggagttcaggactagcctaggcaatgtagtgagacccagtttctacaaaaaatgtaaaaattagcagagcatggtggcgtgtgactgtagtctcagctactcaagaggctgaggcaggaggattgcttgagcctaggaggtcaaggatgcagtgagccgtgatcatgccactgtactccagcctgggatgacagagtgagaccctgccttttaaacaaacaaacaaaataataaatactcatttgctggcttacttggttagaaaataaaaaataaggantaaagagaaaaatttttattaaa

SEQ ID NO: 626179 - DNA, 146 bp, Homo sapiens
caattagagagagataagtacggaagagtatacgcgaccagagcacagaagcacaggaagatataagagcccaaagtaagggcgtactacataccgtaccggacgcagcgaggacatacaagaaaaggaacataagagggacagct

SEQ ID NO: 626180 - DNA, 532 bp, Homo sapiens
ataataccttggattctcttacagctattgaaaataggagaggaactctccctgggctctaggtcgaggttgagcctgtacgtactctgctggttggctgccctatgtccaccttcccatctcatcttacctgtaatcacgcccggatggacctgggtgagaccagacaacactgcaagggattgtatgacacatttactcagggcagaatatggaaccttcagcctggccaatatctgaaataggatccagttagtgtctgaaatactgcgtttctcaagtaacaaatatgaggaccgaactctcattcaacatccaagcccttgcagttcgtgcaagatatatgtttagcaagcaataggagcagacagaatccatcattacgtatggctttttactggaatgtggtgcattgattcattcgttctatggcttggagagcaacattctagatatttacaaaaccactatttcatgggtgtcggtggaaacggattctggactgcagagcaatgccagtcagtggccgttc

SEQ ID NO: 626181 - DNA, 269 bp, Homo sapiens
gtgacccagaggattcctcgaatcgacggtttctcagctacaacagccatgccctgtgtgctttgaagtaacagaggggaggctgcagagtggcagaagggaccctctgcgctcactctgcaacttttctgtaaacctaaaattatcccgacaatacgtttattttttaaacataaccattcattagccgtggcacgggtggctcactgcctagtagtcccagctacttgagacggctgaggcaggagaatggcatgaacccaggaggt

SEQ ID NO: 626182 - DNA, 499 bp, Homo sapiens
tccatagggtgtgccagcctctacaagcctccttaaatgtacccaattttagtgcaacttcaaaatttgaagtagaattatatccacatatgagaaagagctgagtgaaataagtcactaccagaaaaaaacaagcaaaaacaatggtcaagtacctatccctgtttcaatcacttctgctatgccgaacagataaatcatgtgcaagccatgctgccctgtctgccattgatctcagcttcaatctccaatgcccactcctactaggaaaagacacacaatattagttcaccatcagccctcaaaaatgcagcagatagtattctatcatacatttcttccgtcttctcccctcccctattctctcctttcctctcctcctctcccttcttctcattggtggtctccaaactcagttagcctatgcctgagagtgaaaaacctttgaatggcttgccaccactggcttgggtgacaaatatttgacatataatgcctt

SEQ ID NO: 626183 - DNA, 119 bp, Homo sapiens
  misc_feature (17)..(17): n is a, c, g, or t
  misc_feature (56)..(56): n is a, c, g, or t
  misc_feature (79)..(79): n is a, c, g, or t
cccctcccgcttgccgncttagcgcacccctgcagtccagcgtgcatccacccacnacacgccccgtgctgtggtcacntgcccctcccatggcctcaataaactctctgcttggtgtg

SEQ ID NO: 626184 - DNA, 125 bp, Homo sapiens
tggggacactgattattatgcgaactggtcagatgcacagcctccggattactatagtggtattactatgaagaagattattacaaatgcataggtagtgacgatatacgttagtagatattggt

SEQ ID NO: 626185 - DNA, 399 bp, Homo sapiens
aagcctgtattatgcgcgtgtacgcatcaggctctggcctttacttcataatcgcgagtcatgcagcagcaggctgttacctggacacacactagtccatggtcgcacaatgcttactgctatagtcgccgtatcatggcagtgtatgagtgagacatcgatgggatcaaatcgcgtctgtcaggccctggcgtcagaggggcacctgctggtaaggctgagatcctcccctctcaacctcccacccaaacccatccctcttttgggaacttggcaggcaatgaggatagggccttaattaagtggacgcccagtatgtgtatttcacgtgcgttattccactggggcctcacccattatcaggacaccagttctattttaacccagcgctgaggctct

SEQ ID NO: 626186 - DNA, 802 bp, Homo sapiens
  misc_feature (413)..(413): n is a, c, g, or t
tcccccccgggagggtttttttgtagggcagcacagcagagcaggacatggattgaaatactaggaatatgcacagtggggcagtgtgggggcttctcagtaatggagaacagcttggtgaaactttttttttttttaacctaaggcatttataattatatctgtgcattttttctccacttttacaaaaattgatttaggtctataaggcataattaggagttgtgatcccatttcaacacttatttctttggtacgcaggttaggagaatctttttggacgcttattttttctcctcattacgagatatactattaggctcccaggtttttacccaaaaagttcttctttataaagatcgctcctagaataaaactctttgaagatttgatttgggcgttataccttttanaacagggggtttttacgcaacaggggggatctcccctttttacacatttttctttttgcggacacaacttctgcaacacatcttagccgcgggtgttggaacaccacgtgcaaaatttaaacgagtttttccttaaatcctttaatcgttgtgttccccaacacgactagcataaacacaaagacacatactaacacaaacaacaatacaccacaaatcatctgtgtctgcgttgcgcgcgcgcgtctcttcttgtgcggcctcttgtgcgcgaaaaaagagcgctttttttttctagagcagcaccacctcttctttcgtgtgttgtgcgggcggcgcgcgcgcggggcgcccccccgtgtgttgtgtcgtcatcgggtgttcacacc

SEQ ID NO: 626187 - DNA, 384 bp, Homo sapiens
gagcccacctcaagtgaacttgaaagacattatatccataagcctatattacgcacacatgtgggccagcatctgggcatgacttagtcatcgcaagatgggcatgtacgggctgctctcagggcactcagaagatcgcgtctgaagacagctcactgatcacgtcgacctagcaagcgagcgcacgctggagaaaacgctgggatctacatgcatctgccaggcccagacggcagagtgagcaccgctgggaacttggcaggcaatgaggatagggccttaattaagtggacgcccagtatgtgtatttcacgtgcgttattccactggggcctcacccattatcaggacaccagttctattttaacccagcgctgaggctct

SEQ ID NO: 626188 - DNA, 117 bp, Homo sapiens
cccccaacgcagttatacagactcacggtgaaggctatgtaatgcccactgacgggtgctatcgtgaaggttgcacttgcaagtgtgtactacaacggacaatgctctttgaccagc

SEQ ID NO: 626189 - DNA, 1545 bp, Homo sapiens
ttgtagaatgtaatctctggtaacactgactttaagaggcaatgagtgtgtgtgtgtgtgtgtatgtgtgtgagtgtatatatattcccataggctagcaaatgaaaactgacagtgaacttttcctctagctctgatagagtgactggcattgggcatttcctcctggcatagacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtgatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtggtcccagctgctcgggaggctgaggcaggagaatgatgtgaacccgggaggccagagcttgcagtgggccgagatcacgccactgcactccagcctgggcgacagtgcaagactccatctcaaaaaaaaaagaaaagagtggcagaagaaatgctagccaaactgcaggcagatcaagagaattatttgacctgaaaagcagagatt

SEQ ID NO: 626190 - DNA, 317 bp, Homo sapiens
  misc_feature (233)..(233): n is a, c, g, or t
ctcgggaggctgaggcagaagaatgggttgaggccaggaggcggaggttgcagtgagccaagattgcgccattgtactccagcctgggccacaagattgaaacttcatctcggggaaaaaaaaaatgagctaaatacaagagatggtaatgcaggaaatgagagagaaagaagctatagaatgcaccatcagtctttgctgagaggagaagctaggacacttatgcgcatgtncctgtctgccttccttcccgtcccgcggatggttggagcaggtctttgtttgctgcagagcatgccatgtcatcctccttgtct

SEQ ID NO: 626191 - DNA, 443 bp, Homo sapiens
aaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgatacgttgataggtgcagcaaaccaccatgggacacgtttacctatgtaacaaacccgcacatcctgcacttgtatccagaacttaaaatattttaaaaatctttagagaatacaaaaaaaaaaagattcttcaatgcatacacaataaaattgcagttcagtc

SEQ ID NO: 626192 - DNA, 150 bp, Homo sapiens
ctacagcgggggacgggagccgggcgggtacggctattggaggttagtcttacttttgggaaaaacttcttgggaaaggggcttaaggttgtgtccttacccctctctccaaggtttctctaagcgcattggctctgaaaattcccgcgc

SEQ ID NO: 626193 - DNA, 376 bp, Homo sapiens
  misc_feature (360)..(360): n is a, c, g, or t
gctcgacggagtgtcagggacctccctgctctggaggctgacagtgaagcctagtggggaattctctggtctccctaaaaacattactgggccagatgtggtggctcatgcctgtaatcccggcactttgggaggctgaggtgggcggatcacctgaggtggggagttcgagacaaccctgggcaacatggcgaaaccctgtctctgctaaaaatacaaaaattagccgggcatagtggcacgcgcctatagtcccagctacccgggaggctgaggcgggagaatcgctggaacctaggaggtagaggttgcagtgagccgagatggcaccattgcactccagcctgggcaacagagtgnagactccgtctcaaag

SEQ ID NO: 626194 - DNA, 409 bp, Homo sapiens
  misc_feature (313)..(313): n is a, c, g, or t
cgtcgccgcagggtcccctcgccgcagaccccaccctttccctctcgggggcacgcgcctcctcgccaccctcgccgggcttttcccaggctcgcccttctccccacgccccctgcgtcgggctgcaggtcctataggaagggcattaccattcctttcccacaccttcccgactctacgctctttccccttccccttctgtgacttcctcttcttccccggttgggccctctggtcctctgcgactcttcttcccaggtcgcagatttccggccacactttcggcttggctagccgcgccacagctagcggngtgagctttccccccctctggtaggagttggtgaagatatctaccgcaaagagatcggtggactcttcccccttcgtgctggttctggacaccgcg

SEQ ID NO: 626195 - DNA, 116 bp, Homo sapiens
ggcaagaacaagcgccttacgacaggcggcataaagggagccaagaagacagtggttgatccattttctaagacagattagtatgatgtgaaagcacctgctatgttcaatataag

SEQ ID NO: 626196 - DNA, 538 bp, Homo sapiens
  misc_feature (34)..(34): n is a, c, g, or t
  misc_feature (68)..(69): n is a, c, g, or t
  misc_feature (73)..(73): n is a, c, g, or t
  misc_feature (97)..(97): n is a, c, g, or t
  misc_feature (102)..(102): n is a, c, g, or t
  misc_feature (145)..(145): n is a, c, g, or t
  misc_feature (150)..(150): n is a, c, g, or t
  misc_feature (163)..(163): n is a, c, g, or t
  misc_feature (167)..(167): n is a, c, g, or t
  misc_feature (173)..(173): n is a, c, g, or t
  misc_feature (183)..(183): n is a, c, g, or t
  misc_feature (222)..(222): n is a, c, g, or t
  misc_feature (294)..(294): n is a, c, g, or t
  misc_feature (303)..(303): n is a, c, g, or t
  misc_feature (305)..(305): n is a, c, g, or t
  misc_feature (313)..(313): n is a, c, g, or t
  misc_feature (373)..(373): n is a, c, g, or t
  misc_feature (379)..(379): n is a, c, g, or t
  misc_feature (386)..(386): n is a, c, g, or t
  misc_feature (389)..(389): n is a, c, g, or t
  misc_feature (412)..(414): n is a, c, g, or t
  misc_feature (416)..(416): n is a, c, g, or t
  misc_feature (419)..(419): n is a, c, g, or t
  misc_feature (453)..(453): n is a, c, g, or t
  misc_feature (468)..(468): n is a, c, g, or t
  misc_feature (521)..(521): n is a, c, g, or t
  misc_feature (526)..(526): n is a, c, g, or t
tgactagtgtctttataagaagagaagattaggncacaaacacactcagaggaaagatcatgtgaagnnacanggtggagacagccatctacaagcnaacangagaggccttagaagggaccaaccctgataacaccttgttctnagacntctaacatctganactntacganaataaagttntgtgtttatgtcactcggtttgtggtacattgctgtggnagccctagtaaccaatacactgagaggtaccatgttctctccaatcaaggttatggctttggacaattcctnacttgtgtntnttgttttntgagttctcagtgtcggtgacctttggttcctgaggttgcaccttgtggaagtgtagganagcgtngtggacnctnctgctcattttctgagatggggnnngnttnagctgggtggtctgatactatgcttgtttggtantggtgctgatgattnctggtgattgagataatgaaggggttaaaataataagtgttttgaaatggctnggctnctttcttccttc

SEQ ID NO: 626197 - DNA, 555 bp, Homo sapiens
tgagctcggtaccccccctctctatcatgcagctatgactccagtgtccatgcagcataccaagctcatctctttatcttgagatagggtcccgctattgtcgcccaggctggagtgcatgtgcgcgatcttggctcacctataatctccaactcccaggttcgagcaattctcctgcgctcagcctcctgtgtagctgggattacaggcatgcgccaccaaacccggctaatttggtatttttagtacagatggggtttctccatgtgggtcgggctcatctcaaactcctgacctcaggtgatccgcctgccttggcatcccaaagtgctgggattacaggcgtgagccacagcgctcagccttttaaaattttttgtagggatggggatctcactatgttacccaggcagacctgaaactccggggttcaagcactcctcctgcctcaacctaccacattgctggtattgcaggtgtgacccactgtgcccagtctggcctccatctttttggtgacaaatttactctcattggtgtgtcggtttctctgta

SEQ ID NO: 626198 - DNA, 242 bp, Homo sapiens
tgggggccttccccgccccccccccaatgccttcccagcttggaagccaaggcagcttatgaagggagctcaggaaacccgttttcagctgggctggggttggggctgctgtgaggaaaacccccccttgtggccctggagagtcccccccagctcttgggaaggacttgctgggaggctgaaaaaggctttgggcccagcctgctgttttttccctttcctaaagttttcttcattgtcca

SEQ ID NO: 626199 - DNA, 169 bp, Homo sapiens
gggaaacaaaaaagtgtttgatggggccaaaaaggggctgctttccagaaaggtaaaatttaattttttttttcctttgagttttggacttcaaccaccctacaaggtggcacttggtaacaaatcagaaatatgacaattaatgattaaagactgtgattgcccccca

SEQ ID NO: 626200 - DNA, 112 bp, Homo sapiens
taagtcaatgcagcatatacatgaacagttaggaatacaagtaagttcggcaaccagtgtagaccagtgaggacgagctactctacttctaaacaataggcagtgacgaaag

SEQ ID NO: 626201 - DNA, 137 bp, Homo sapiens
tgtatatgcgctgactggtcgtaggattggtcacccatcagtactgcggtcgagaactttgtcagtggcgaaggtattggtcaatgtacttgtgtcgagggcacatgggggccgcggcacagagtcttccatggcca

SEQ ID NO: 626202 - DNA, 402 bp, Homo sapiens
gaagactatgctcgtatcaagttaaagcaagacattattgcgttacaggaagcaattaacgctggcgatgcggcaactgctacaagcctagccaagattgtcgaagaagactataagcgtgtatgggcttaccaagcacaaaatatcgctctaggtatccagaacggaactatccaaaatatccaaaatgcggctaagttaattccgcaggatatgaacctaatcaatttaggaaacttaaagtctgctcttgattatattaacgaaatgcttgctaagttagctaaggttcctaattcacaggataacgcatccgcaaacgcgacaggtaaaaaccctgtagtcattccgccagtcgtcgtagtgccaccgcctgtatcagctaatcctaattgggatcct

SEQ ID NO: 626203 - DNA, 868 bp, Homo sapiens
agcggtgtatattttttttttttggcacagtctacttggtgacattaagtacctcttttccaaaaaaaaaaaaaaaggtgtttaatgtggcttacctgaggatcacagtccattatcaagaaagaattcgtgtcgctataattggaggcatctagggcagcatttggagaaatggcgtgtggataagatccacgtgtttcttttcatagaaacagtgatcggtgtttggtatgacgtcttcccaaagtgttaagttacagattctgtcaaatctcctggtacagtatcgggtttggcagttacaaaggtggatcttaagggaccattagtggtaatggcaaatggctggcatggccactggtttcccatcatgtcataaaaacaaggctcctaaaatccctaaattcctttaaaaactggcctggtggttctcatttataaacaaatgtgggctctggtggtaaatctacaccggagccaatacaacctaataaagggtggaaaatacgtgggaagatttcagggaccccttctgtgctcctaagtcacaatccattgtaaacacatgtggtaccccaggatggaacaaaaggtcccatggggctggacttggtcacaacttcaccatggtaataacatggactgggtactgaaatccctaatggtatccgtgtgcccatgttgggggcccaacgcagagcctgtcatatttccccaacattatataaatgtccaacatacaatttcgtgggttatgggcccatggacagaacctctatgggacagtgctgccctttggtcaaagcatagtgttcaacaaacgcccatttacaaaggggttattttgggcgtggcaaagcggaaacac

SEQ ID NO: 626204 - DNA, 236 bp, Homo sapiens
atctattggggtctgggaggggaagaggacactgggcggcctggggtctagcaggtgactcctcaagcccagggcaccatgtctgtgccaaactgtgccccaggcagcagtcctcctcctcttctgatgaggcaggtgaccccaatgaggcacccagccccgacaccctgctcggtgccctggcccgcagacagttgaacctgggccagctccttgaggacacagagtcttaccta

SEQ ID NO: 626205 - DNA, 599 bp, Homo sapiens
gaatgccttaatgtccccaaaacctataaacagccagcttattttcgttggactggatcccccaccaatagttgaataacggcgtttttgtgacacatccccacctcgggggctaaaaaatggttccgcccaccctttctacattggcgcaacacagcaccggcccaatccacgcatgctggtttcaaaggcgcaatttcccgagccacagttcaccgcgccaattgttccggccgcaaaggcctttcctggcaactggtaaacacgggcgaagggcactggacgcaggattggaggttcaccccgagggccgagagagcacaacacatgagatgaccctggtgtccgaggtatccacgcacgtatccacggatgccaccagccgaggaggagggcgagtttcgagcgaggaggctgagtgagcgaaggtggcctagagccttacagtcaactcggggaaaaccacgggaaaccacgtgtgaatctctttattcactcccacgcctgtcctgtggcctgtttcccctgtgtgcacttgctgttttcctggccacaaccatgctgtacagacaccacccattaaagcatttttatagtga

SEQ ID NO: 626206 - DNA, 191 bp, Homo sapiens
ggatagttaaccacacctgggtcctgcaacactcggcctctccagtttccctggcctatactctagatccgctctgactccaatgtcacgggacaccagccttgcttgaagccatgtcctgtagtgggcacgataatagcaactgagctgtcacagcctaccagcaggctggtaacaccaccaggaattct

SEQ ID NO: 626207 - DNA, 1001 bp, Homo sapiens
ggacgcgtgggattcataagttgaagccctccccagatccccattggggagcctctgccctcctccagcccggatggctctcctccattttgagtttgtttcctcttgtttgtcatcattatttttggcgtgcttgggagtggctgccagccctgtacccgggacctgctgtggaggtgacaatgaggacctcccccaggttagaagagcatgccctttgccgttgcagtgcaaccagcccatgtgattccactgtgcagatcccagcagcctgtaggggcaggggtgccaagagaggcattccagaaggactgagggggcgtagacggaatagtggcgtcgactggactgtggcccaggaggcggcgtcgcaggggccaactcacagaaggggactgacagatgggcaaccactcacatcccactggactgcctgtactgcaaaccatctgatatggctattctgagcgttcgcgctgggctggcggcactgctcatattggccacatctgccagcatatggactatgcccgagttacttgaagctgctctcgaagctagagctgacaatacctggtgctaacatcccaatggccgatccctacgtcacgattgcaccccaccgacactgaggcgcccggacctagagaactgcatacgtaggcgcactaggaccgcacaggacaatgcagcgggaccacataacaacaccactatcccaccacatgcgccccaacaaactaaaacaacagcgcacaaacccaagcaggcctagccacacagaatcgcgacacgggacacatgcacccacgaacaccactcgcgcacccgcgccctccaaacacaccgcccaggagagaagagcaccagaggacggaagtaccaacaaacgcatgagaccggaccgcaagacaacgccacacccggagacagggcgagctgccaccattcgagccaggacacacaacgacgagccagccacaaggcgcacacacccccag

SEQ ID NO: 626208 - DNA, 1273 bp, Homo sapiens
tggttttcccggtttaaaaaaggaccccaaatataaagggtagggaaggggacaagagggaacattacccctttaggtgtcgaaaaatgtgggaaggaaaaggagaagcctcaaaaggagagggtgggaggggaagtgtcattaaggcagcaaagttaatctcgtgttgaagaaaagatgggagggagggacctctcacaatagcctacaagaagataaagggcaaaagtattggcccttctacggtggtgccaaacggggaaatgggcaagtcttatttctatccttcacagggacagccattcacatggggtaaaaatccgggagaatataacctttaaattctctttattggtaaatataaaaaaagtggcgtgagaaagaagttcagaaagggggaaaaagatttcggctagagagaagggggggtaaaaaacagaggtaaaacaaatattaccacaaaaaagaaacgacgtggagaaatcccagcgaaaatactcctcacatattaaagagggcattaccacacgcgaatggagaccacgtgggagaccgagggggaccccctcgaggggggaggaaaaagaagggcacatcccacaacagagaggcagaacgacagcggggaaactaaccaaattactatacgaaaagaggaccaccaagagaacaaaactcccccttcggtgagagaggaggacacacgtaccccacgaaacacataacacagggggcacaaacacaaaagaaaaaacattctagtaagagggcgaccccaaaaaagccgggggggacaacggagaaattaatacaaagaaaagagttattctcgcacacatcgaagccaacaaaagttacaagacaggcagatgatttaactagaggaaaagaacaagaaacataagaaagctattacaatttacatgattggccagaaaaaatcacgaggataattacctcaaggcgacacaaaaaaacaaatattcttcgacaaacgatggatgtggtgtaccccacacagaaggcggagtgagattagcgagcaaacaataaccagtggcgctagcgaaaacacgcgggaagagagaaacacaaagacacaaaaataaataaggaggagagacaaacaaactacacagagaaaaaacacccaacaaacaaaaccaatgagacaccacaacaacaaaccaacacaaacggaggagagacaaaaaaaaaaaacagaaagacgcagccaccaaaccacgaggggagcacaaacagcatagaagaa

SEQ ID NO: 626209 - DNA, 194 bp, Homo sapiens
agtaaccagatgatcacagagatacaaccctagccttgcttgttaaaaatttttttttttaagaatatctgtaatggtactgactttgcttgctttgaagtagctttttttttttttttttttttttttttggcaaataccctgtgtttttaagtgtctctctccggttggtgtaaggtttattgggaaattcg

SEQ ID NO: 626210 - DNA, 219 bp, Homo sapiens
aaaacttttaaagggggggaggggggggggccccaacccctttcccccttttggttttgaaggggcaaaggtttttggtttttcccccccgccccttggaaccccgtttttccacccttcctctttttttttcggggttttccttgtttttttcccccaaacccctggggggaatttgaatcccgggttttttttttttatttttttgggaaaacccca

SEQ ID NO: 626211 - DNA, 227 bp, Homo sapiens
tgagtggccagtgcgtgtgcgtgtgcgcgtctgcgtgtgcatgttcgtgtgatgtgtgtctggtgtgtatgttcacacgtgtgcgtgtgagtctacatgtgggtgtgtgcgtgcaagtgtgccatgtatgtgtgtgcatgtgtgcagtgtgcgcgtcattcagttctcatgtgttcttcatcaccatggccactccaatcacgagggctcctctcatagtcgcactg

SEQ ID NO: 626212 - DNA, 701 bp, Homo sapiens
  misc_feature (199)..(199): n is a, c, g, or t
  misc_feature (207)..(207): n is a, c, g, or t
  misc_feature (522)..(522): n is a, c, g, or t
gaatagatctatcataaacttgagagccaattcatcttcactctgggagaataggcaaagggaaaatccaagtagtatgtccagcatgagtagataacttgctgacctacttgactatcctctcatgaatgcttcttggtaggtctccacctgattcccttcagttctgttctgaatagctctatactgagggaccccnaagctttnaatccctttgggatgggtgtagtgccatggtgtgcgggaggagttggtgatataatatgcattcttgctcagcaggtatcttgtcattttcccagtgatatttaatcagtgcctctgagcacatggagttattttacatcttctccagagtaactcagatcaatataatgggtatgtcatttggtactgctgttagtattaatagatgtgaagcaatgctaaatggaatttgacagaggtgatatattgccatattcattggagttcctcacaagaccagattccagagtagctggactgtggctgctgtggganctaggattgaaaagtgaaccaagccaacctttcagtgtgtccatttataagaaactattcttatttgggagtagaggatggtgccaggctggggtagggaagattttagcttgacttgcctgttaagaaaagttttccaatcagctctagagtgatgaaggaactgtgaccttcagcct

SEQ ID NO: 626213 - DNA, 164 bp, Homo sapiens
tgtcccgtggtttcctaatacagttatgttgcagagaaaagtagaggcctgcagaaaagactgaaggacgaggacttagtggagtcctaaatcatgagaggtggtgcgttgtactttctgggaaggaaactgtatcacagaagagacggtaacaccacagtagg

SEQ ID NO: 626214 - DNA, 110 bp, Homo sapiens
tctgcatgcatgcctgagtcgacgtgtattcaccactgcgggctgccttctgtcaagttccgtctacacgtgagcaccgggctgacctcaaatatcgttagctggagcct

SEQ ID NO: 626215 - DNA, 301 bp, Homo sapiens
ttacagagacctgggatacatacctctttctatctgggtgccttaggtcagttactccagttctcacctgtcaaatgaacaaattccaagcactttggtcatggagtgaggattacattcgagaacgcagattacgtgctcacttattagcacactgtctggtgcaaagaaaacggttgggacatgacagctgtcatttaacaatcccccagggtcccataagggcccagatcagatttctcagtttgtcacctttgactggcccttacagtcacctgtggagcttcacctggtctgacgt

SEQ ID NO: 626216 - DNA, 874 bp, Homo sapiens
  misc_feature (30)..(30): n is a, c, g, or t
  misc_feature (62)..(62): n is a, c, g, or t
  misc_feature (73)..(73): n is a, c, g, or t
  misc_feature (87)..(87): n is a, c, g, or t
  misc_feature (107)..(107): n is a, c, g, or t
  misc_feature (523)..(524): n is a, c, g, or t
  misc_feature (526)..(526): n is a, c, g, or t
  misc_feature (552)..(552): n is a, c, g, or t
  misc_feature (554)..(554): n is a, c, g, or t
tgctagactgagaattgtggtgaacttgancagatggtttctgaggacgtcccgctgaccancgcgttcacgnccgcatcattggtnccctcgcaaagccattcgcnaaatcatggacgaattcaaggtggacattcgcttcccacagagcggagccccagacccccaactgcgtcactgtgacggggctcccagagaatgtggaggaagccatcgaccacatcctcaatctggaggaggaatacctagctgacgtggtggacagtgaggcgctgcatggtatacatgaaacgcccgcagcacaacgaagaggccaatgggcactcttccagaggctttgtggtgcgggaccgcactcctggaatcgcagcagcagtgagaaggctcctgacatgagcagctctgaggaatttcccagctttggggctcaggtggctcccaagaccctcccttggggccccaaacgataatgatcaaaaagaacagaacccgtctccagcctgctgacccgaacccaaccacnncnatggttgtctcaatctgacccagcgntnggaccctccgtaaattgttgacgctcttcccgccttcccgaggtcccgcagggagcctagacgacctggctgtgtgtgcggcgctcctccaggcctgggcgtgcccgctcaggaactgttccacgtgtttaaacactagaacaaggtcatgagcattcgtgctaagataacagatccagtcctggtccaccctggcatgtcagtcagcactctggccttcatcacgagagctccgagccgtggctaggagttccacttccctgtgtcatgacctcaggaaataaaccgtccttgacttttataacaaaacaacagaaaag

SEQ ID NO: 626217 - DNA, 769 bp, Homo sapiens
  misc_feature (30)..(30): n is a, c, g, or t
  misc_feature (62)..(62): n is a, c, g, or t
  misc_feature (73)..(73): n is a, c, g, or t
  misc_feature (87)..(87): n is a, c, g, or t
  misc_feature (107)..(107): n is a, c, g, or t
  misc_feature (418)..(419): n is a, c, g, or t
  misc_feature (421)..(421): n is a, c, g, or t
  misc_feature (447)..(447): n is a, c, g, or t
  misc_feature (449)..(449): n is a, c, g, or t
tgctagactgagaattgtggtgaacttgancagatggtttctgaggacgtcccgctgaccancgcgttcacgnccgcatcattggtnccctcgcaaagccattcgcnaaatcatggacgaattcaaggtggacattcgcttcccacagagcggagccccagacccccaactgcgtcactgtgacggggctcccagagaatgtggaggaagccatcgaccacatcctcaatctggaggaggaatacctagctgacgtggtggacagcagcagtgagaaggctcctgacatgagcagctctgaggaatttcccagctttggggctcaggtggctcccaagaccctcccttggggccccaaacgataatgatcaaaaagaacagaacccgtctccagcctgctgacccgaacccaaccacnncnatggttgtctcaatctgacccagcgntnggaccctccgtaaattgttgacgctcttcccgccttcccgaggtcccgcagggagcctagacgacctggctgtgtgtgcggcgctcctccaggcctgggcgtgcccgctcaggaactgttccacgtgtttaaacactagaacaaggtcatgagcattcgtgctaagataacagatccagtcctggtccaccctggcatgtcagtcagcactctggccttcatcacgagagctccgagccgtggctaggagttccacttccctgtgtcatgacctcaggaaataaaccgtccttgacttttataacaaaacaacagaaaag

SEQ ID NO: 626218 - DNA, 253 bp, Homo sapiens
aactcagggcgagctgcagaaatggaggggcagagggaatgcacatcagtgtgggagggacagaggagctgcagaaatggacagcagagggaatgcacatcagatgtgggagggacagagatgctgcagaaatggattgacagagggaatgcacatcagtgtgggagggacacagatgctgcagaaatggaaagcagagggaatgcacatcagtagtgggagggacagaggagctgcagctcgcccctaagtt

SEQ ID NO: 626219 - DNA, 408 bp, Homo sapiens
tgggcaacagagcgagactccctctgtataaaaaaaaaaatttagtaacttatgaatttggaccatgtgaacctattgcttgttccaggtaaaactgaacagttgaaaagtatgctgggctaggcgtagtggctcaagcctgtaattccagcgctttgagaggccgaggtgggaggatcgcttgatttcgggagtttgagaccagcgtgggcaacatagacccctatctctatttttaaaatatactctaaaggccgggtgcggtggctcaagcctgtgagggccgggcaccgtggctcccagcacttcggagggctgaggcgggcggattgccagaggtcaggagtttcagaccagcctggctaacgtggtaaaccgcctctctactaaaaatacaaaaaaaaaaaa

SEQ ID NO: 626220 - DNA, 825 bp, Homo sapiens
gaatgagaatgggatttactgtactgtttgaaatgaggattggcttcagaatccattacagttaccttacatagcacttgatacgtgtttagatgaacaatatgaatgtaatttatatatttcctagtaattgtaatgttactttgtgagattgggggctgtccctcaaggccagtttaggatttctttgtgtctatatcttgaaatgattataaaatagagttttgatgggaattttaaaaatcgttattcaaaggattttgggagcgatttgaaagccccatactacggaagtatacgaaatgcacacaaaacaatccaagtttcagcagttttagtgctcactcattaacaccaactttgcttgtctcatgaaataatctttggtgatagttttgtactacaaggtacacataacacgttactttctgagatatataagagggctgtaagcgaattgtggggtcgtagtaagtagcagtaagtgagatgtgagtgatgtttggaagttggcgtgtgttgggtatgttgatctgggattcagcttcttactcatgggtctgtactcgaggtgtaatttcgtttatcaaatgcccttgtaattaccaattcgtgaagtctgtgactgtgtctcttgaatcatacttaggatattctggatcgttatggaaaaaaggtaattttaagaagtttcctggtctagtaacctgtagatatttatgacctcgtgggaagtatctatatttattaacaactgtggtacattgttcattttaattcacgatttcttatgaagtatggtaacagggaagggaagacacagag

SEQ ID NO: 626221 - DNA, 614 bp, Homo sapiens
  misc_feature (506)..(506): n is a, c, g, or t
ggctttcattgccattttaaaaaaaaaatagaaactccttttttacaaaattttttgggttttgatgtcacaatggaaattttacaaacccaaactttataaaagggggttaagccaattccagatgaagcaaagacttgaacccggaaagttctaaaaaaagtctaaataaaggttttcatattctatgggggaaaaagataattcaaaaggatttccgtaaggctgggcccagtagctcacccctgtaattccagcccttggggagggtgaaatggggggacctgcttaccccaagagtttgccccccccctgggcaacatggggggaccttgtttttccaaaaaaatcaaaaattattccggggggggagggcccccctaaagcccccaccttctgtggaaactggaacaaaagggttgttttgactcaaaagggtgaacctgtcagggagctgggaaattggacttccctccaccctgggcgggaaaaaggagaaccccttnctcaaaaaaaaattaatttccaagggccccatttttttaaatttggtgtaaactccctccaagggaattttttaagggttccacaaattttccctgtttttaagaccc

SEQ ID NO: 626222 - DNA, 197 bp, Homo sapiens
  misc_feature (176)..(177): n is a, c, g, or t
ttggataggaacgtcactgctagtgggaagtacaggtgcaaggagggtaacaagatatcaagtggctgggtgtggtggctcatgactgtaatcccagcactttgggagaccaaggtgggtggattacctgaggtcaggagttcgagaccagcctggccaacaaggtgaaatcctgnntctctactaaaactacaaaa

SEQ ID NO: 626223 - DNA, 873 bp, Homo sapiens
  misc_feature (28)..(28): n is a, c, g, or t
  misc_feature (66)..(68): n is a, c, g, or t
  misc_feature (98)..(98): n is a, c, g, or t
  misc_feature (106)..(108): n is a, c, g, or t
  misc_feature (113)..(113): n is a, c, g, or t
  misc_feature (124)..(124): n is a, c, g, or t
  misc_feature (126)..(126): n is a, c, g, or t
  misc_feature (138)..(138): n is a, c, g, or t
  misc_feature (144)..(144): n is a, c, g, or t
  misc_feature (146)..(146): n is a, c, g, or t
  misc_feature (160)..(160): n is a, c, g, or t
  misc_feature (163)..(163): n is a, c, g, or t
  misc_feature (171)..(171): n is a, c, g, or t
  misc_feature (183)..(183): n is a, c, g, or t
  misc_feature (205)..(205): n is a, c, g, or t
  misc_feature (212)..(213): n is a, c, g, or t
  misc_feature (217)..(217): n is a, c, g, or t
  misc_feature (240)..(240): n is a, c, g, or t
  misc_feature (260)..(260): n is a, c, g, or t
  misc_feature (267)..(267): n is a, c, g, or t
  misc_feature (302)..(302): n is a, c, g, or t
  misc_feature (305)..(305): n is a, c, g, or t
  misc_feature (320)..(320): n is a, c, g, or t
  misc_feature (331)..(331): n is a, c, g, or t
  misc_feature (337)..(337): n is a, c, g, or t
  misc_feature (343)..(343): n is a, c, g, or t
  misc_feature (411)..(411): n is a, c, g, or t
  misc_feature (446)..(446): n is a, c, g, or t
  misc_feature (539)..(539): n is a, c, g, or t
  misc_feature (685)..(685): n is a, c, g, or t
  misc_feature (717)..(717): n is a, c, g, or t
  misc_feature (853)..(853): n is a, c, g, or t
gtatgaacatgagggggttttctcgggngaatgagggttttatgttgttaatgtggtgggtgagtnnnccccattgtgttgtggtaaatatgtagggngagtatannnctgtnactagtatgtngnctcctgtaagtnggagantnatatttgatcaggngancgtggttnctagcacagagngttctcccagtaggttaatagnggggggnngggnggggttagcgaggcttgctagangtcatcaaaaagctattagngggagtngagtttgaagtccttgagagaggattatgatgcgnctntgagtgcgttcgtantttgagtttgntaggcngtttanttttgaggttgttagtccgtgggcgattatgagaatgactgcgccggtgaagcttcagggggtttggntgagaatggctgttactacgagggctttgtggctntttgtttgttttttgttttttgcgtttttaggtctgtttttcgtaggcagatggagcttgttataattatgcctcatagggatagtacaaggnaggggtaggctatgtgttttgtcagggggttgagaatgagtgtgaggcgtattataccatagccgcctagttttaagagtactgcgcgcaagtactattgacccagcgatgggggcttcgacatgggctttagggagtcataagtngagtccgtaaagaggtatctttactataaaanctattgtgtaagctagtcatattaagttgttggctcaggagtttgatagttcttgggcagtgagagtgagtagtagaatgtttagtgagcctagggtgttgtgagtgtaaataagtgcgatgagtaggggaagggngcctactagggtgtagaata

SEQ ID NO: 626224 - DNA, 158 bp, Homo sapiens
aggaaagactaaggctagagacagactacaaggatgtcgcagcagaactgcttgtataggaaaaacctgggcgctccatgagggcaatgggtaaataaatcatgctataatatactctttttttttttttttttttttttttttttttttgggggatc

SEQ ID NO: 626225 - DNA, 165 bp, Homo sapiens
tgtcagtgtgaggaccaggctgtactcgggggggggctagggtggcctactaccgcagctccacatagttggctgggaagagcccgtacctggccctatgcacaccccgtgccaccagcctgatgtcaatcatctcgatagtatggtgatgatgtcatcatgtgg

SEQ ID NO: 626226 - DNA, 230 bp, Homo sapiens
aaactactagcgactgtatcctttctgcagaaagtataaaaatggcctggctgaggaaattaaatatacgttcaagtgctatttctttacagcgtcagggaacaagcatttcaaacatagtcatgcaccaacacacccagctaatttttagtggagaagtgctctcactgtgttgcccagggtggtctcaaactcctggcttcagaatcatcctgccttgacctccttga

SEQ ID NO: 626227 - DNA, 1021 bp, Homo sapiens
  misc_feature (218)..(218): n is a, c, g, or t
gaactgccttcatttgttggctcgtgtatatgttcaggttgagttgacaaacccatttaagtatggaattgatttatatggggtcaggtgctccacgaaatagacctatgagaccaaaaatgacctaggctatgtagacgacagcatgaaacttccacgttaggttctcagtctatacaaggcacttaccgagtgctctgcgtgatgggtatgtaccncaagtacgacaacgaccgttagtacgtattgcattgtgtgacgctcacttatgggacaacaataatctgcctttctaattgttctgcactagcgttaaaatgataaatttgacattctttgaacctataccagattgtggtgtccgagtgacccggcacactgtctgacacacagtcagtgtgcacgtatttgtctgagtgaatgagcgagacctgagaaaccggtgacgtggcacagggaagccagctggtcccaggattccgtaacatggccgcaagcagactaacgcgtttgacgctaatttaagtgtattttacctcacactaaggtcatgcttgataaagacgttcaaagtcaacttgtgaaaatggtagcccagtgctatgcacagagtgggtgctcattagtgttggaatgaaccatttgtaatactacatgtagttccagtctgactgctttgttaaattttcagtttaacgtagcattctggttgaagtcccaacaccaattaatctgtcgcctggaagtttggctcaaaatactgttgaaaactgtccgactggttgaatgtcccatttcaagacatggattggggtgtagggccctggcgctgtaatcacggaaaggcgcggttcagaggtggagaccggagagaatcgggcgaatagccgggtaggggcgggtgttagcccaaacagtgtgttgttgaagaagcggctgcgagaggtgggttatgaacggcggcaaatgtgtggaagagtcactgtgcttgtactgtacggcgactacgtctgtcgtgggg

SEQ ID NO: 626228 - DNA, 933 bp, Homo sapiens
  misc_feature (933)..(933): n is a, c, g, or t
gccggagactcgcgcccccgccggatcccacctccggccgacgaggggtgagtggcgagcggggccgaccccggcgccacgatgtacgcctttgtgcggtcctggaggacgagtctgctacgcgctgccgtgtgtgcgtgcgcgattcagccccgctcgcggctggattttgacaaccagaaggtgtacgccgtgtaccggggcccggaggaattgggcgccgggccgagagccccccggcgccccccgcgactgggcgcgctgttgctccacaaggtccagatcccttggcgctggagaagacaaaatctgacttgaaaacagttgtgatgccgaagaaaataaaaatgcccaagcttttctcttaaattcatgtagaacgaacgaatggacgaggttaacagacttactggggacaacacacgaatttaacaagcttagaccccacttcaaagagaacctgacgggcggaaagtccgaagcagaaagtgtggcacaacagaaacattcgaagggcagtggtgtgactcggagtagaagaacgtaggaaacggcctgagcctgggggcatatacacgttgtccggaaagagagttccgcgggacagcctcgccaaggatcacgacgggccatggggcagggtctaaagatgcttgtgtgtgacccgggatcctgtattgacggcagctggtgtgcaacattatcaagagagcaaccggaagagatagtgacactccacgaaaagacatgaaggcaggatttgaggagggttgtttcaacaagggcccaacgtcacggagtcagggcgatgttgttgaataagagatcgggaacctaataggagggcccagacgtctggcctaggatgcaaaggctccattgtttaacagattatcaagtttatcaacaccagtagggaagttttagcgaagn

SEQ ID NO: 626229 - DNA, 253 bp, Homo sapiens
ggtggcccaggccagagtacaaggctgcaataatagctcacggtagcctcaaacttctgggtcaagcaattctctcacctcaccctctggtgaagcggggactagaggcagtgtgccatcagccgtgcgttactttactattttttttttcatagcaacagggccacactatgttccccaggcgggatctcaagacagtcctcccacgggcgaacccccataagagtgttcgaacatatgaggcagtgagcca

SEQ ID NO: 626230 - DNA, 832 bp, Homo sapiens
gggcgcccctccctcctcgcggacctggcgagtgccgtatgcccggagtggccctttaaaaggcacgcttattgtcctgtgatgtggggctgggcggggtggcgccgacctgcggcctgagggccctggcccctcccctctcactccctctgtacccgagtcagcatcgctggcatagctctgcatggcctcgcatcagcccagtaacggctacactgctccgacatccgtcagattgtgctccgcatgtcaaggtagcagcgagcagattggaagctggcagacctagagtctaggacagcacaggcacagtggatcttgacagagggcatagataaagcaggccggacatgaacgcccaaaagaatacatcccacaagcagccggacgaaagccgggcacccactatgacccacccaggagccaaaagagacaatagaggacccgagaaattgagcacaagaagaaattgaccccacagaacaacaagagggcgtgcacacgagacagacaaaaaaagcaaaccaaacaaaagcaaaaacagtaatgcaacaccacaacaacaggcgatcaaaacacacaaggaagaacagcccaacgacaaacaaaagagaggatcatacacaacagaaaaaaacctataaacaaagcaacaagaagacaaagaacaatcgcacacaaccaccacaacggaaaattaaaaacgacaccacaaaaacaagaaagcaaacaagaaatgccagatacaccaaagaaaaaatagaatcaacaaaaaaacagacacaaaaacaagccacaagcaaaaaaggaacaccccacaagacaacaaaga

SEQ ID NO: 626231 - DNA, 109 bp, Homo sapiens
atcgagctcttacccaattccattccagcgtactatgcactacctgaggagggaatgcaggaggaagagctgatatcagaagaaaaaaattatcttgatggcatagtgt

SEQ ID NO: 626232 - DNA, 344 bp, Homo sapiens
aagcttaatttcagtccataatctcgtttgacttagtttcatgacggctatcttttaaataatgaatgtgctgtacggaggactccattaatcacatgcaaatctccactctgaaagtgattcaccatttctgtcagcaagtcaggccatttctgttgaaaatcttctctgccattaatgctaattgcattatttaactgcttctgaatttgctctgggctgctcagcatcaagtgcactatgttggctttatagtggccactcgatcggcttcaccaattttgtttggttcatcttcaacaattctccagttccttttaatatcgtttttgaatgttactgaa

SEQ ID NO: 626233 - DNA, 414 bp, Homo sapiens
tctctatagcaatactttaatatcccaaaaaaaaatatgaactgaaaatggttttatctacccaaatggttttactgtgtaagggctacagataaacttattggacttggcaaaaatttagggaaattggtcccatgagtcttttttaagggaacacttattcaatatctattattattccagctggcacccaagagtattaatatggggatattgtttgagagttcccaaataactatttaacacttgtggacactaagaatatgtgaggtatgacacacagatatgtcaatattattattatgtcctccacagaggtagggaaattgattacacaccaaaaattgtgagaagaaacagggaaaagaaaagtgtggaaagttttccacgtgattaccaaattacattagtttg

SEQ ID NO: 626234 - DNA, 365 bp, Homo sapiens
  misc_feature (6)..(6): n is a, c, g, or t
  misc_feature (267)..(267): n is a, c, g, or t
cagggncaatctaagagttattggcataaagaggaggtagagaaaaagataggagtagaaagtttaaagagataataacagagaactttccaaacctaaagaaagatattcatatcccaggtaccgaatgttatagaacaccaagcagatttaacccaaagaagactacctctcgggcatttaattaattaaactccccagaggtccaaggattttggttgagggatttttggcattccattgtttatcaagggatattgggtcccnaagttttcttattttggttagttggttgttggtcttttcccaggttttggttatccaggataattgcttggccttcataagaattgagttaggacaag

SEQ ID NO: 626235 - DNA, 84 bp, Homo sapiens
cagccctgtacttctgtgccagcagcttagtagggggagccaaaaacattcagtacttcggcgccgggacccggctctcagtgc

SEQ ID NO: 626236 - DNA, 217 bp, Homo sapiens
tgtttatcgatgcacggtgtttatcgaagccaaccgtggactagtggtgtttatcgatacaccggtgtttatcgatgccaccgccgggcgcggtggcgcgtgcctgtagtcccagctactcgggaggctgaggctggaggatcgcttgagtccaggagttctgggctgtagtgcgctatgccgatcgggtgtccgcactaagtggcatcgataaaca

SEQ ID NO: 626237 - DNA, 157 bp, Homo sapiens
ttttaaaaaccccccccccccaagggggggggggccaatttttcccaaaggccgggcttttgggttttttcccggccctttaatttttttttttccccaaaaattttttttatgggggggggggccccctaaaatttttttttttggtgccccttta

SEQ ID NO: 626238 - DNA, 420 bp, Homo sapiens
ctaccactaaacagcatgtcgtataacatcactaagtcactaagcatgaagggggagcctttatgtactaatcaccttccaaatacctcacctcgctaatatcatcacacttagggatgggatgtcaagatatgaattttgatggaacacaagcataccattcacagcagtcatcctcatataaactttcaaagaaataaagatcattgggatgcgatatgaacagagtggctgcttctgcagggaagaaaaggtagttctcaaacagtaccattaagcataagagaaatccaggtaggaagcattcaaattctacctttggagacagttgaatgagaagtggggtgatagtgcgggaaatattttttaacctgaatttggatgctgggctgttcccatcagacaggtgcagcgtagaat

SEQ ID NO: 626239 - DNA, 345 bp, Homo sapiens
acagcagctggacactgccatatagattacaaatgggtctccccatccacagaattacatatacaacaagccctgtcggatatgtagctatttcctgaacaaatacattaatacactttttgtatcgacatttgtaaaaattcacggttactcataacattacttcgcaagacatttggtataaggtggtataatacatattaggaaacaaacactgtaccaaaatggatatgacttgtgaataaaccctaaataaagtggctttcggaagaactggattctgcagcaaccaactttatcacgaggtccatccgctctcaatggaaaacacccaagcataccatt

SEQ ID NO: 626240 - DNA, 114 bp, Homo sapiens
gctcgaccaatgaatcaaactggaaaccaatgacaagaaagataacagaaaaacatttcaacaaatacaaactagacttcctctttgatcatcagttgttttaaaggttctgtc

SEQ ID NO: 626241 - DNA, 350 bp, Homo sapiens
taagatgaatgtatcacggatggccgtttttgtatccggtgctgcaactaaactttcgaaattgtttcaaagtcgccaaatgggctactttgatgtagaaaacggcccctgagtcgcccacgaactcaacctcttttgcggcgaaaggagacgctatgctttttccagtactcgatggtctcaagctgcacaaggtgctggtacgcaccatcaaggaattcgtcgatgacgagatgcctacctacgcctcggcactggcctaccagatgctgttctctttgtttccgttcctgctgttcctcattgccctgatcggcttcctgcatttgcccgacttcttcagttggctg

SEQ ID NO: 626242 - DNA, 123 bp, Homo sapiens
tcgtctttatgaacatggataggacagatctgacacttcctttccattgctggcctgaacagactgacctgtttaacttaagcctggagtccatgcctcgtcttcctttgttcatgctgttac

SEQ ID NO: 626243 - DNA, 861 bp, Homo sapiens
  misc_feature (16)..(16): n is a, c, g, or t
  misc_feature (27)..(27): n is a, c, g, or t
  misc_feature (48)..(48): n is a, c, g, or t
  misc_feature (52)..(52): n is a, c, g, or t
  misc_feature (90)..(90): n is a, c, g, or t
  misc_feature (105)..(105): n is a, c, g, or t
  misc_feature (109)..(109): n is a, c, g, or t
  misc_feature (114)..(114): n is a, c, g, or t
  misc_feature (140)..(140): n is a, c, g, or t
  misc_feature (154)..(154): n is a, c, g, or t
  misc_feature (161)..(161): n is a, c, g, or t
  misc_feature (165)..(165): n is a, c, g, or t
  misc_feature (174)..(174): n is a, c, g, or t
  misc_feature (178)..(178): n is a, c, g, or t
  misc_feature (180)..(180): n is a, c, g, or t
  misc_feature (204)..(204): n is a, c, g, or t
  misc_feature (211)..(211): n is a, c, g, or t
  misc_feature (213)..(213): n is a, c, g, or t
  misc_feature (217)..(218): n is a, c, g, or t
  misc_feature (220)..(220): n is a, c, g, or t
  misc_feature (241)..(241): n is a, c, g, or t
  misc_feature (248)..(248): n is a, c, g, or t
  misc_feature (252)..(252): n is a, c, g, or t
  misc_feature (265)..(265): n is a, c, g, or t
  misc_feature (267)..(267): n is a, c, g, or t
  misc_feature (272)..(272): n is a, c, g, or t
  misc_feature (278)..(278): n is a, c, g, or t
  misc_feature (288)..(288): n is a, c, g, or t
  misc_feature (298)..(298): n is a, c, g, or t
  misc_feature (324)..(324): n is a, c, g, or t
  misc_feature (348)..(348): n is a, c, g, or t
  misc_feature (351)..(351): n is a, c, g, or t
  misc_feature (356)..(356): n is a, c, g, or t
  misc_feature (364)..(364): n is a, c, g, or t
  misc_feature (368)..(368): n is a, c, g, or t
  misc_feature (423)..(423): n is a, c, g, or t
  misc_feature (764)..(764): n is a, c, g, or t
  misc_feature (766)..(766): n is a, c, g, or t
  misc_feature (843)..(843): n is a, c, g, or t
caggagccagccccanccttagaaaanatgttttccatgaggatcgtntgcntggacctaagtgtggtgggcacagcatggactgcaganagtggtgaaggtgantttntagcngaaggaggaggcgtgcgtggcccaanggttgtggaaaaanatcaatntgcntgcaaaaantcanantggcccttctgctctgatgaagantggaacnanaaanncncttctggctgcaggatgaaanggttgantgangaagtcaatcaanantttanaaaaanaaaaaaaaanctcaaaaaancacaatttgaatatcagaagaacaanaaggattctcattcgttgaccacnaanataanggaaaaantganaggcgatttttcctcagccaataaccgtgataatacctacaaccgagtgtcagangatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtaccccngngtggaaggcattaacagacatgccgcagatgagaatggagttagagagacctggtggaaatgagattactcgaggangctccacctcttatggaa

SEQ ID NO: 626244 - DNA, 442 bp, Homo sapiens
  misc_feature (15)..(15): n is a, c, g, or t
  misc_feature (36)..(36): n is a, c, g, or t
ccaatcaaacgcctngcattcggaggcatcttggcnggattggtcatctcatataatattccaccaaccagcattccagtcctcacaataccatgatttttaaaaaccacagcccttaattatttcagtattaggattcctaatcgcactagaactaaacaacctaaccataaaactatcaataaataaagcaaatccatattcatccttctcaactttactggggtttttcccatctattattcaccgcattacacccataaaatctctcaacctaagcctaaaaacatccctaactctcctagacttgatctggttagaaaaaaccatcccaaaatccacctcaactcttcacacaaacataaccactttaacaaccaaccaaaaaggcttaattaaattgtactttatatcattcctaattaacatcatcttaattatt

SEQ ID NO: 626245 - DNA, 413 bp, Homo sapiens
  misc_feature (259)..(259): n is a, c, g, or t
ctgtaacaggggcagggcctgaagagttttccccaaatccttttccacctttacctttcccttttgattataaatttccatgtttaaagtcatttttcccttcctaaaagcttaatgcattccccaggcatagtggctcatgtttgtaatccctagcattttgggaggccaaggcaggagagcctcttgagctcaggagtttaagaccagcctgagcaacatagggagacctggtctggacaaaacatttaaaagttcncctggcatggtagcacatgcctgtagtcttagttacttgggaggctgaggtgggaggatcacttgagcccaagaggtcaaggtgccagtgagccatgattgcgccactgtactctagcctgaaagacagagagagaccttgtatttaaaaaaaa

SEQ ID NO: 626246 - DNA, 104 bp, Homo sapiens
  misc_feature (4)..(4): n is a, c, g, or t
cggntcgacggggattatgggaattgagtgtctatgaaaaccatattccagacaagaatatagtctaaggacacagcaagaggcaacattttggaagcagaggg

SEQ ID NO: 626247 - DNA, 126 bp, Homo sapiens
ccctcttctgatccgtcctaattacagcagtcctacttctcctatctctcccagtcctagctggtggcattactatactactaacagaccgtgaagctcaacaccaccttcttcgagcccgccgga

SEQ ID NO: 626248 - DNA, 158 bp, Homo sapiens
gtatgctatgtgttgtcaggggttgaaatgagtgtgaggcgtttataccatagccgcctacttttaagagtacatgcggcaagtactattgactcagcgatgggggcttcgacatgggctttagggagtcataagtggtgcccgtttagaggtatctt

SEQ ID NO: 626249 - DNA, 175 bp, Homo sapiens
gagaagttgatggcttggcaagaggactcaattgctgcatcacctattaagcatttttgaagcacatcatgtccagctaaacctcgtgcccaggaagcccagggaaggcctttccaggcacgtctaatttccaatgtgtaatgctgacaccagcgccttgagtcgtgggaaggag

SEQ ID NO: 626250 - DNA, 603 bp, Homo sapiens
aagcagtggtatcaacgcagaggggccattacggccgggggcggggcgcggtggtcacgcctgtaatcccagctctcagggaggctaagaggcgggaggatagctggagcccaggagttcgagacctgcctgggaaatatagcgagacccccgcttcctcccagacacaggaccaacacacaaacaacaaaaaacaccaaggggcacaaaaaaaaaacaaaaacaacaagaacacaaacactgtggtgtgggcgcggcccgggcccgagaagaaagttctaaaaacacacactgggtggggggggcgggggggcccccagagtgagggtagactggagacagagtgtgggtcaacaggaggggtgggtcccaacaggaagaagaaaccgtgggaaccatgaaacaagaggcgcggtggggacttccccccacccacaagaaaaaaaaacggcgcgggagggaaacacacaagagtggtttcgtggaacaacaacactccagaagaggagtccgggagggacaacaacgcggggcgatctctccacgagggagggatcacagggaggagccccaaaaagaaaataaccccccgcgaggggggcg

SEQ ID NO: 626251 - DNA, 196 bp, Homo sapiens
tgtggagcgggggtctcacaggccggcaggatggtctcaatctcatgacgtcatgattcgctcacccgggcctctcaaagggctgggattacaggcgtgagccactgtgcccagccaagagtttttctggttgaattatctgggcaccttggtggaaatgaatggccaccacacacacccggtctccacagggtac

SEQ ID NO: 626252 - DNA, 186 bp, Homo sapiens
ttttgaaaagggggggttttttttccccccctttttttctggggccttggtttcccccccattttttttggtcccggggggttttttttccaaacccccccccccctttttttctggggggtttttgggggttaaccccctcccccggggggtttttttttttaaaaaattccccttttcccccca

SEQ ID NO: 626253 - DNA, 462 bp, Homo sapiens
ctcaagtgatccacccaccttgactcccagagtgcctgggattacagggtgtgcagccaccgtggctggctgagatttcctttctaagaaaacttgaaaatgtctgatagatgatccttatagcattggaaagattatgcctttagatctgctaatactgaattctttatttatttttatttatttttattttttttgagatggagtctcgctctgtcacccaggctggagtgcaatggtgcaatctcggctcactgcaacgtccgcctcctgggttcacgccattcttctgcctcagcctcctgagtagctgggactacaggtgcccaccaccacgcctggctaattttttgtgttttttagtagagacggggtttcactgtgttagccaggacggtctccatctcctgacctcatgatctgcccgccttggcctcccaaagtgctgggattaccagtatc

SEQ ID NO: 626254 - DNA, 263 bp, Homo sapiens
tgcaagttttttgttctctctcaaccagtttttccatctggcgaatgggaataaagtatatgttctatgtagtttgtggtggtgattagccaatatcttgtgtgcaatactatctgcacttaggaagtaaatgcaagcttaatgatgatgattagatgacacaagcaacaactctacttggctcaacttgtttttggtaaacaaatgtaaaacacttaaagaaaacttctccgtttttgacaataaagtatttaaacatgttg

SEQ ID NO: 626255 - DNA, 167 bp, Homo sapiens
  misc_feature (75)..(75): n is a, c, g, or t
  misc_feature (94)..(94): n is a, c, g, or t
gggaagagaagagtgactactaaaagtctgtaaacaaatctgcattcggtttttaaagtatcttattaataccanaatcaatttttggccaaanttttaagagttctgtcaccttttcttatccaatttttacatagttacatttttatgcagctaggaaaatacac

SEQ ID NO: 626256 - DNA, 510 bp, Homo sapiens
agacgagaatctctgaaccgggaggcagaggttgcagtgagccaagatcgagccattgcgctccagcctgggcaacaagagtgaaacttcatctcaaaaaaaaaaagaaaaaaaagtattcgggtgttgtgccttgtacctttagtctttgctacttggaaggctaaggtgggaggatcatttgagcctcagcaggctgtggaaagccatgtatgcgccattgtactccagcctgcatggtagagaaagacccgttcttaaaataacaaaacaaaacaaacaaacaaacaaaattacccagatttaattgaggttacatagatgtttaagtttctgtaagcgggcaattttaaaaggtataagctgaaatgatacagtcattttatcatatgcttaagataggctattttcaacgaattttgcccttttggtatatttgggcatataataaagtcttaaaattttagtgtggatttagagtaaggcccgtgtatttaaaaaaaaactgaa

SEQ ID NO: 626257 - DNA, 245 bp, Homo sapiens
  misc_feature (232)..(232): n is a, c, g, or t
  misc_feature (238)..(238): n is a, c, g, or t
agaaaactaaagtccaacttgcccaaagccacatagctagtaaatgatagagcacatattctaacctaggtctgactacaaaatccttgttctttccactgtacctcaaaaaaaatgagaaagctggtatatactcacactgatccatctattatttctttaggtactaagttcattatccagaaagttctacagtcaggttacttattaaggtttgtgtgaaagataaccnaaaccnccctacg

SEQ ID NO: 626258 - DNA, 1229 bp, Homo sapiens
tcccttttgtcttgctgtgtcttttggggtactttgtgtctttattttcttgtctgctcagcctttctgtcgtctttgtagcattgtgtgggttgtccctcagcctctgtcagtcttgtgttttcgctgttttttattttgtttcggggttcgcctcccgtgcgctgcctctgtggggctcccttggatagtttttttttgctcctgataatgtcccttttttaaaatcggttttttttcccactaaatatggtttttctctgtggatattcatgccaagtttatatctcgtcgctagtgtcaggccctgtgagtgtgcttcctcccctgtctgggcttccagtcattggggctacttgggccacagtctattttcgtctccttggtagttcttcgctcgaaatttcttcgaggagtttggcggctcttggggggctttcccagctcagtgttctctgaccaagtctttcctgggtttaacccccctttgtcggtcctgggcccccttctttgggcttgcccccgtgtttccccagctctctttcctggtatgtccagcttcctgtatgggccgtcatgtgggtcttctccgatgtttcttgttgcctccggggtatgttttatcccgatagacctgtctcctgggctcccctatggtcctctattctgtggttgctctcccatggtgtcccctgcgggccccatctccgtggggattttccgcctgggccggtctttcttgctccattgctctttcctctgggtccaatccggacccacttttaccgctccttatactcctcggtatttaggccaccccgcccacgagtgatttccgggcacctttccgggagcccattcggactcctggtcttccttctggggatgcttcgccggttctgttatcgccgtcacggaggaaagaattggctcccaaaaatctgtcaccccgcgagtcgaaacacgctttgaaaagggatctgaggctcaccccacggtttccacgcacaaccggaggactgtatactggggagagtcacccctgagccagcccttccctggactgccggaatcccacgcacttagcttcctgctgaatgtagtatttggcatttctctgaatttatttcctctccttcccccactccccgctttctttttatggcccccgggggagggggagagacccaaggagatcggtatctttgtaataaaactgcaattttata

SEQ ID NO: 626259 - DNA, 859 bp, Homo sapiens
gatggtggtactaatctctgcaaggctacaagaatgcagtatggttttgggttggctggtttttctagatagaggcaggtaagtggcttccactttatagcgtaattgccctcactcttcaggtcaggaaaccagtgtagggattctggctaattgtggagtatgtctattccaattattctggcagctacagagataacaagacgacccactgcaagacagacctaaactaaaactccatgtgatcacctaacctccctaagcccctactctcacttgtgaaccagagtgatgcattagttttcctgggggtaccctgagtctggagttcagaaccaatgtccagtaattcccccaaagtctgattattcccttttccccaatgcacagtcaacttggtaaagtgctataggtcccttgggggaaggctgagagaacaacatgaacagtatacaatttgtggtaatgcagtggggaacacatgctcctcattgtatttaacgggagatatgggtctgcaaactgggccaagtctgggaattgattccaggagctgtgactccggatgaagcgagttagactttattcactgaggctctttaaaccggacacgataaaattgaaggttcccccttatacatgggagatggcggtatggcaaaatctgaacgctcacccaaggggtgcggctaaacaaccctgctgcggaaagaatgcgcccgggagactctatacacggtccttctctctcctctacgtcacactgcctacacggtcgtctgtcactccgcctaaaacaaaccacgaacgacagaagcagagggaaacgacaaacgaagcgcaggacagagagacgagc

SEQ ID NO: 626260 - DNA, 108 bp, Homo sapiens
gcggccgactactactactactgctcgaattcaagcttctaacgatgtacggggacatgccactgcactccagacctgggtgacagagtgagtctctgtctcaaaaaa

SEQ ID NO: 626261 - DNA, 485 bp, Homo sapiens
  misc_feature (1)..(2): n is a, c, g, or t
nncgacagatttcctatgttgagaacactgagaacatttttagtgacacaccaacagagtatgccgtatggggggggtacttgatcaggctatgccctctctgacacaactcattctcaccaataatagtctcgtggaactgggggatctggaccctctgccatctctcaaatcgctgacttacctaagtatcctaagaaatccggcaaccaataagaagcattacagattgcatgtgatttataaacgttccgcactgtcagagtacctggatttccccagaaacgctgaaacctaaaaagagccgtccacggaagcagtagacaaatgtttcatagggccaaaccggggttgcacaagccttgcaaaggatattgccaggagaagctctccagggcatgtagaagcaatcaagaatgccatagcaaatgcttcaacttctggctgaagtgcagaggcttaaggggttgctccaaactgatcac

SEQ ID NO: 626262 - DNA, 757 bp, Homo sapiens
tggtcgttcggtcctatgtcgcgccgggccctccgtaggctgagtgggggaacagtcgcgggcaggagcccctcgggacccgggccttgatacgatctccgatgatgacgatgacgcggacgaacaacgggcccaagcgggcatcttgggtgtccggcgtcccgggggcgcagtgaaggcccggcgtccgagtcaccaaccggttcgagctgataaacattgacgatcttgaggatgaccctgtggtgaacgggcagcaggtctggctgtgcgctcacagacgctgtggccccagggaacaaaggcacggggtcagcgtggaaacacagagagcaagacggatggagatgacaccgagacagtgccctcagagcatgtctcatgcaagtggcaaactccggaagaacgcaaaaacaaagcagaggaaacaagaaaagcagcacgggagaagcatcggaaaaccggactagaagatatcgatcgcatcctagagaggattgaggacagcactgggttgaagcgtcccggcccagatcccctgatctccaggaacgcacgtctctacgtggagcacagacacttgaatccagacacagaacttgaacaggtatttcggtgcccgggcaatccttgggggacgcaaaggccacggagaagacaaccgttgtgtaccccaagtgcacattgggtgaacacccttaaaagccgttggccccggtacagcaaaccaggtccggccctgcggtcgctggatcca

SEQ ID NO: 626263 - DNA, 139 bp, Homo sapiens
gggggcccggggggggttccccccccccctttcccccggttggttttaaaatttcccccccccccggggtttttttaaggccaaaaaggggttttttttttccccctttttgggttaaagtgtaaatttccggggccca

SEQ ID NO: 626264 - DNA, 131 bp, Homo sapiens
agccccgggcagtatgcatggcatcatctgccagcacattcggcttgtggtataatgctgcactggttccagcatacgtcactccaggcgccatccatctcaacccagccttcgggtttagtgagactctt

SEQ ID NO: 626265 - DNA, 466 bp, Homo sapiens
cacgccgcacggcggtcaaaactggcctgggcaacatggtgagaccctgactctacaaaaactcaaaaaattagtgaggtgtgacagtacatgcctgtagtcccagctactcaggaggctgaggcaggaggatccctttagtccacgagttcaatccatcagtgacctatcattatgccactacactccagcctcggtgacaaagcgagaccttgtctcaaaaaacaaaaataaggccaggcatggtggctcacacctgtaatcccagcaatttgggaggtcgaggcgggtggatcacctgaggtcaggagtttgagaccagcctggccaataggtgaaaccctgtctctaccggaaaaaaaaaacaaaaattagccgggtgtggtggcaggtgcctgtaatcccagctactggggaggctgaggctcaagaactgtttgaaccggcggtgcggcgtgcggtaccg

SEQ ID NO: 626266 - DNA, 119 bp, Homo sapiens
cccagaaaaggatctggtgatgtgttgggcccaggaacgataagctgatcaggtcactgctagtgacaatggccttcatcatccgaaagctgcatccggtccttttctgggtgagagag

SEQ ID NO: 626267 - DNA, 667 bp, Homo sapiens
  misc_feature (391)..(391): n is a, c, g, or t
  misc_feature (408)..(408): n is a, c, g, or t
  misc_feature (410)..(410): n is a, c, g, or t
  misc_feature (435)..(435): n is a, c, g, or t
  misc_feature (445)..(445): n is a, c, g, or t
  misc_feature (477)..(477): n is a, c, g, or t
  misc_feature (490)..(490): n is a, c, g, or t
  misc_feature (496)..(496): n is a, c, g, or t
  misc_feature (513)..(513): n is a, c, g, or t
  misc_feature (533)..(533): n is a, c, g, or t
  misc_feature (552)..(552): n is a, c, g, or t
  misc_feature (579)..(579): n is a, c, g, or t
  misc_feature (585)..(585): n is a, c, g, or t
  misc_feature (638)..(638): n is a, c, g, or t
  misc_feature (661)..(661): n is a, c, g, or t
ttaagccattttaagaattttttatcctaaagacatctggaagccaatgacattttaagcacaagatttgtaaacatgttcagatttgcatcttagaaagataactcttctacctaaaaaggcttccaggcagagattactttggactgagtattacaatgaaaaaaggtcagggtcatttatgggtaaataactctttcaaaggtacagagacataaaacaatcttaaagtatgctgaaagaaaaaaaacaaagtaaaccaatcagtaaataataatattttcagtgtctcaaaaaaaagtaggtcccttgatcacaatttcttcataaatggttttaaagaacattaacttccaaggtcatatattgctagtctaaaaattatttcttnctctgaattgctgctgncnttgcacagagaatctttaacttggnggcatggtancagaaacctgacctttttggggccaaacaagngacccaattgggncacggnaaacccgggcttgggcnttaccctaaaagggcttctnaaaagggtccccgaaattnacttaaagtttttcaatcccttttccngaaccnaattttttccttaatggcctttttggaaatcttattttccaggggaaaacccntttggaattaattggtggccccncccaaa

SEQ ID NO: 626268 - DNA, 266 bp, Homo sapiens
ctttccgtgagaactcactaagggtagtagggatatctagcctaggacgtaatatacaggagcatggtacatgaagacgtatcctcgaaggccctctaatgcccaggacactgagccatgtcgacttaatagggcagtatgataacagtagtcccagggtggcattctccagcagcccggagagaaggaggcatagtcatccagtggagtgcaccagaagagaaataccatcgtagcagcagcactcgacgcgggcatctagagtc

SEQ ID NO: 626269 - DNA, 188 bp, Homo sapiens
ggggcaaacccatttttttttcacgggttgggcggcattggttcagctgtttgggtcagaagaaaaaccccctcccgggccccctttgaattctgggccatgggcctgggggggcctttttgacaccggggggttcctccttttgggggccccccctttttttccccccctttttggcccccttccca

SEQ ID NO: 626270 - DNA, 234 bp, Homo sapiens
tttggagcccttttcagtcaagtttgccggaagtctttttttacccaccccccagttttcctttaaacgggccccccactttaaaaagggttaaaaaaaatgtttcttgggtaatgggttttttattgaggattgtttgggctaagccttgtgttaaattttaaaaaatagtgggttggcccccctttgttggggtgttttccttgttgaaaataaaaaaaactttggttttca

SEQ ID NO: 626271 - DNA, 513 bp, Homo sapiens
gaggatccgaaaatgaatagaggcggtttgaaatgaaaccaagtagaacttcttgggaaacaatatatcaaaatggaaaactcagtggatgagttacacgtcaagttaattagagttaaagatacatctacataagttatctagaatgcaaagagataagagatacgatggaaacattaagagagacaaagcaaaggaggagatggttcaaattctgtctcattggagttctaggaaaaatggagaaatcaggagtgaggcacttaaaaaagatggctaaaattttctggacttcatcaaagccacgaaacctcaggttcaaataattcaaacaaacaaaaaccttcaatcagcaaaaattaaaaagaaatccagagctatcaagccatgaaggaattttttttttttttttttttttgggggaaatagagttgggctttggtgcccaggggggggggcaaaggcattgtccccagcacagggattcctaaaacccgcgggtccaggggttcc

SEQ ID NO: 626272 - DNA, 343 bp, Homo sapiens
tcgcagacaacaggatctgtaggtgctggctgtcaaacaagagaacgagcacctgactggaggactacgagaagctggccagcgacctccatggagtggatccggcgcaacatccccatggactggaggaccgtgtgccacaaaagactatccaggagatgcagcaaaagctggaggacttccgcgactaacgagacgtgatgcacaagcacgcccaaggtgcaggagcagatgcacaactgaagatcaaacttcaacaagccgaagacaaagctgcgccatcagcaagccggaccgcctacatgccctccgagagaaagatggtctcggacatcaacaatgg

SEQ ID NO: 626273 - DNA, 914 bp, Homo sapiens
tccaaaccagtctgttttcaatttaagccaagttaaataagttgaggtggggtggagcggggatcatcaaaaggctgacttgggcccgctggatttggcaactcattaccagtgtgaggtttggcaaggaggaccaacccccttctcaagacaaggcacaaacttattgtggcaaggaaaagaattgagggggtgggcaccctcacttgctcaagtggacattgcctcaggaagcgccaggtgcgtttcacatgtgcacacaggcaggactcatttcagggacacacttctcgagccttagtagagcgctgtggcgcctctctgtgcatgacaggcgctagaagagctctcgaggcgtgtctctctcacagagcgccttgctggaatctccacccgtggggaaaagtgctctccaacgcctgtgtatgaagtttctattttcccacaactctctctctgtgtgccgaccggcgtagtcttaacaaatgtgttcccacgtatccctctctcccccacaaagtctccaccttgtgtgggctgtcggcccccccatgtgtggtttcccctattctgtgtcccgtgtgtggaactcaccctgcggtgttgtttgatctcttatatctgtgcggcttagaacaggtcatcaaaaggggggcatccccaacctgttgtaattcttctcttcgctcattctgtggcccccaactcttgtggagggcccaaggtatctctctctataacccacgctgttgttccccgggctgtgaaacgcaggccctctctttgtgcgtaataccacgctgtggaaaaacgggccctctctgtgccctattctgtgtggccccatctctttgtcttcgcacgccctcttcgtgaccactcgaggagctcttcggaggtggccccccctgtat

SEQ ID NO: 626274 - DNA, 943 bp, Homo sapiens
aagcagtggtatcaacgcagagtggccattacgggccgggggggggggacaaaaaaaaaaaaagaaaaaaaaaaaaacaaaatgtgttcgggcggcgccctgagccctctggaaagaagagttttccgtaaaccatgtccgttgggggcgagcggcggccccgacgagtggtcaagggaaacgggctcacacagtggtccccagaggaaaaccgcgggcccagaagacgggctggggctttctcacacaacataaaaaaaggcgcggggggacaaccgcgcgagggtttcgtgaaacaactcccgaagaggaggtccgaggaggacatcaaggggagtcttatcaaccgggggggtcccaggggaagcgcggcatattcaaatatgagcccccgccgcgcgtgggaacaagcaacaagacagcaaaaacaacaaactcgccaggcagtggcgagcacacaaaaggaaagcatagcggaaccgaagaaacaggtcgagagaaagcaatgggaagcgaccgagaccagcgcacgatgacaagaagcagccagagacagggcgaagcgcggcagcacacgcaggaaaacgacgcgacacgagccgacgagcggagacaagacagaagatgaacacagaacgaaggggaaacctgaagaaccacgaccggacaccacacgacaaaacgaacagagacaaggcagagagaacacacaaaaacaatgagaggaaacaggaaaaggaaaagagacaagagagaaacggacacacaaagcaaacctagggcgaggcaacagagaaaagaacgggaacaaaaaggaggagacaagagacagcacgggaagcacagaacagagaaaagacgaaacggaagaacatcagagagcaggaaaccacagcgaagaaaggagacaaagaaagagagaaaagaagcaacgcgagaagaa

SEQ ID NO: 626275 - DNA, 884 bp, Homo sapiens
ggccgctcgatggccagcagcagctctgcaaggaaatgctcagccctatcagcactgtcccgtggtatgcctgtgtactcttgcctttcgtgggcttgcgtttctctcctctagatgggtggggatgacatttcaaatgactgttcaagtacttcccacgtgaaggaatgaatgatagaaggagaaatgtcgtgtctgagggagatagggcttttgagattacgcgcagatactgaagaagttgtgtttgtgactgatggagaatttcaggaatgaatgagaaagacctttgcgaaagatatgacaaggagtttagatcagtcatgtgaacgtattgagtctaagaagcatgagcgaaactgaagaccaaattattctcactgttgatggtccgtggatgggagatttaaagggaagaaccacaaaggcttgcataagataggagaggcatccatctctacatgcagtgtagaagctccttacgggtgcccatcaagagcatagcttggaagccaccatgctgtgcggaactgcgtcagggcaaatgtcacaggcaggatttccccaatccagctccatcatcacagacacagagagctggagggggaggccgtgccacggtgttgtcgactctgtcctcctctgggcagccatagatccttaggtgctcaagtaaaggtgtggctgtactggaaagcacaaggagcacatcatgcccgctataacagggttacacggacgactcaaacttcagaggagacgatgcagcttaaaggaaagatccccagaagggggccaccagaggtgagacgcgtgtgccacaaatatccgggggccacaaaaggcgcccgcacttgatgagacaaagggtggcgatgggcacc

SEQ ID NO: 626276 - DNA, 911 bp, Homo sapiens
taaggtaaaaaaaaaatacaccttcagttcccgtggtttgattcctggttaaaatggatgatttttctttgaaagtttgtgctgattaaccaattaaaggtgggatgatatttgggcaaaatccatttatgaaagtagaagcaaaaatcagtgggtttgctcaccacataaagccatgctgttttgggtcaacactgtgtaacctggaaaaattcacatcatttctgagtttaatccactttaggatattattccactattgtttgggtgaatttgctcgaataggaattgtttttcttctctcaaatctgtgatctcttttcttaaatccgtgcttcccttgtgtcccttgtgcgttggcttctctaatttttctctttggtcccattctttctctatactttttccccctttccctttttgggggaggcttggctagttagttgtgtgcggaacaaagaattacgaccgtgaacctttgccttacgtggacctgttcccgggcaccatacccacgtctttttgaaggtagcttatacttagccccttttgaccatcttccgggccccacaaaattgttggtcccgcattttaacgggcgttataactttcctggcttaagcccatatttggtgcctagggtttcctacctattgtggaggcgattgccttttgtaacagtcctggataaagcagattctcctgttagatggacgctacagattggaaacttgccggcggttcacattcatgccagggttcatgaaggcgccccggcttgaaaaaagggatctcggtaacatacgtataggtaaggcacattagactcatgtatgaccgctgaagaggctactcacacattttcccgcagtacccaccaagagagcagtgttgtgctacagttatccaga

SEQ ID NO: 626277 - DNA, 627 bp, Homo sapiens
agcggaaagttattcaccatgtaatctagcacagcatgtttgaagcatcttggaatgaaaaaaaagaagaatcaggctgttatttcctgaaatgttatgagagataacatgttgaaaggtaagaactcaggttgatattaatcatgtttttatcaatcttcattttaaagttgttttgttctgtatattctaaattccttttattaattcctggcttgatcaagtgggcttggatccatatgatttttttttttttttttttttttggaaatgaaatctcgctctgtttggcccagggcgggatgtggcaatgggaccagatctgggctcactggcgaactctggttccccagggtgtcaaggtggattctccctggcgctccggcctcccaaggatacgctgggagatatcacagggtaccttggccaccatggcccgggctaattttatatatttttaatagaagaagggggtttcaccattgttgggccaggctgggctctcgaaactccgtgaccttcgaggggaatccacctgtgcctcagtctccttcccaaaagtgcggggatacggggtgtgagccacgcgtgccgggccaggtggtgttttttcccgttaaaatatat

SEQ ID NO: 626278 - DNA, 192 bp, Homo sapiens
cagttatctagtatactaacatcatcttatgcacctataatacaagcatagggaacttccaacaaatgcataaggtcaaatgagggtggtgccaaaaggctacaactttgcattagattttatacatttgaaggtccaataagtcccataaaatggctatgtcttagtattattcttttagtcagagcaggt

SEQ ID NO: 626279 - DNA, 775 bp, Homo sapiens
  misc_feature (405)..(405): n is a, c, g, or t
ggaggcagtgctgtgccggagctgcttgtgccgatttgcacaagccagttgtcaatcttcaggaattttgcaaacacgttgttaaacaactgttaactgttacttacaattaaattacataaacttataattaaatatattagactaaaagtgggtaacatatattcacaatgtataacttcctaattattacattttattgtatttgtgcttttttttgttttttttttttttgggagcacaggagttctcactctgttcgccccaggcttggagtctccaggggcgcgactctcggctcacgtgcagagcctccgcctccgtgggttctcacgccaattctccgtgcctcagcctctcccgagttacccgggacctccgggcacccgttcaccacaccgtggncctaatttttgtggtattttcttagtagcagagtggggtttcccaccatgtgtttagccaggaaggtggctctcaactctgaccctcgctgatcgtgcccgccgagccttcgctgattctgcccgccttcggcctcccaaatgtgctcggattaacaggcttgagccaccgcgcccagcctgttttggtcgccctggaggtatcttttggcctgttgtactccatcggggggaaatatgatatacggatgtgcttatgtgtcccggtggcatctcttcccatgaccagtaattgtacctgttggtacgctttgaaactccagaatttttctcaccctccgggaatgggccttccccccccatgttatgcg

SEQ ID NO: 626280 - DNA, 170 bp, Homo sapiens
gcacgagatacattctaccttaaatgtttattttgtttaagaaaacatagaggccaggcaccatggctcatgcctgtaatcccaaccctttgggaggccaaggtgggtgggtcgctggagcccaggagtttgagaccagcctaggcaacatgaggaaacccttctctcca

SEQ ID NO: 626281 - DNA, 387 bp, Homo sapiens
  misc_feature (22)..(22): n is a, c, g, or t
  misc_feature (52)..(52): n is a, c, g, or t
  misc_feature (60)..(60): n is a, c, g, or t
  misc_feature (82)..(82): n is a, c, g, or t
  misc_feature (111)..(111): n is a, c, g, or t
  misc_feature (220)..(220): n is a, c, g, or t
aggggggtgcccatcccctatnattaatggttacctttttcctttgggaaantgtagccntccaaagtctttaagcccagantctgaaattaaaatttccataggccccangcacctgcccataaagattgaagcacgtgaaagcacatggccatttgtctaacagaacctaggtcacatatgaaacccttttgctttgacaaaaaattagctgggcatngattgtcacgcctgtagtctcagctacttgggaggctaaagtgggaggatcacctgagccctggagattgaggctgcattgagccacgatgggccactgcactccagcctgggtgacaaagcaagaccctgtctcaaaataaataaataaaaaaatatttttgatga

SEQ ID NO: 626282 - DNA, 221 bp, Homo sapiens
ggcactgttaggacctacaaggacattgtatgccatgcacttacgaagatatatgttgactggccatacagaccaacactctgacacgcacatagacacagacacatacacacatgctccgttaactccttatagtaagattctgttttaaatgttccaagtaaatccttgcccaccccgttggaccttgaccttactttatgctgcaagctcttgaccag

SEQ ID NO: 626283 - DNA, 114 bp, Homo sapiens
  misc_feature (47)..(47): n is a, c, g, or t
actgtgtcgtggtaagggcagcatagtggggatctaatcccagttgngtctagctattgtgtgtcagatatgtaagcactttcgtagtctaatttgtgtccacctatgagtttt

SEQ ID NO: 626284 - DNA, 326 bp, Homo sapiens
tcccgtgatcagtgatcctcacaggagctctaaacatgaaaatgaaagaatgatactgtaccacaaaacacactttagtacatagcccaacaacacacctaaagtacatatggcacacagtagaaactaacaagcagctagctaataacttcatgataggatcaaaacctcacatatcttgcttgagcccaggtattttgttaccagcctagccaacatagagggatcccatctctataaaaaatacaaaattagctgggtatggtggcacacaccggtggtcccagccacttgggaggctgaggtaggaggatcacttgagccca

SEQ ID NO: 626285 - DNA, 1112 bp, Homo sapiens
gggctgcagcccgggtagtggccaggagagccggtccacgtttgcaaacgcagcgaacgcccagtgcctgacccgtgcctgcccgagcgccgctgctgcgtcctgctgccactcttctcgcctgcccctgatggcgttcctggggctggaggcccccgctgccaccagctgctcctgctgctgctctgggtgacctgggcatggcagctgccctgtgtgctgggcctgtggctccgacgctggagcttgcagactctgagctgtgccgcttctgtgccctgactgacgtgccctgcgccacctgtgctgcatgctggcgactttctgtgctgctacccatctactgtgtggcgacgttctcccgaccggcccagaagttcagacctccagcttatgaccacgacggactccaccttctcaccctgtcgtcctcgctgcgcgacaacaggacatgcgtgactccaccagggcattgtgaccccaccggcatctttggtccggcgacttgtcgcccgttcaaccacccgcacgcacgacgctctctccgtcgacgcgcattgtcgcaccgccacaaacatgcctctgccccctaaccgcgcacaccttgcacacggcacgttttccactggggttgcttgagtaccccccgccccatactctcaacggtgggcttccacttctctgcagtggtaccttatctgcactgcgcactaattcgcgggaaactttaccttcgaccaggtaccgaagggggcttccaaagaatttgccactcgactccctattactcacacagcgcacgccacgcgcacgttcatgcccccctaccggcgcaaccccaattccccccatggggtggctccttgcgactctctctgcgcagcgcaaccggttaaaccccaccgtctaccccacaccacgccgtggcacacccgctctctcgccgctgctgtaccccgcgtcaacccctctcttggctcccctgtgactagcctgtgacggcctttcacgccaaaccttcccgcgcacggttcctcacgccacgccacttgattgcaacccaccacgcctacacttgttggacggcggacaactcttggcgtcgcgtgcag

SEQ ID NO: 626286 - DNA, 430 bp, Homo sapiens
ccttgtacatcaggtttagagaagcatggtatattacatcacatccatttactatcagtccgtataaatattttaatcaccatattaaacacaacccatgtctaatgaagaaagttaacctcttttaaattatttgctaatattatagtctactttgaataattattttcagacaaagacaagccctgtggttgcactagctaagcaagcccagcttatagtccaggaatttcaatcagtgcattttttataggtatgctaattctgagttggtttattatgattaatcttggagatgatttctcagccatcaatgaatttctttaagacgagttataccgttgagatttgatattcggattctgttccctttctagttaacaagctttcttctaagtatttttcatgtgtgtgatctgtgatcataaga

SEQ ID NO: 626287 - DNA, 619 bp, Homo sapiens
  misc_feature (31)..(31): n is a, c, g, or t
  misc_feature (483)..(483): n is a, c, g, or t
  misc_feature (490)..(490): n is a, c, g, or t
  misc_feature (520)..(520): n is a, c, g, or t
  misc_feature (540)..(540): n is a, c, g, or t
  misc_feature (542)..(542): n is a, c, g, or t
  misc_feature (569)..(569): n is a, c, g, or t
atccaggcacccttccgggagcccggctttntggtgtgtttgccccggggggggccccacgctttcccggggggatttttgttttaccccccccccatgggcggggggaaccgagtttctcctttgggggtagggggactggcctccccacgccacccaagggaggtccccccagggggttttatggggtggaaggggctcggaaattttggggcggggggggccccatttcccgggaccccccagggggggtcagccctgtttggttttttcacaaagtccctaaaaagatttaaaaaaaagaccgggcggttgttgaaagggcggtgcccaggggggattttcggggggaaggggcggcccccccccctgggttccctgctaccccccccgggggtgcaaatgggtttaaggggggcggggcgcccctggggccttttaagaaatcccccattgaagaggggggggcccccccccccccgnaaaaatnggtttgcggcccccccggcccgggcccctnaaggggggggggcccccccngnggggttttaaggggttttggcaagggnttttaaccggcagggaaaaaggggggggggaaaaaaacccccggttttta

SEQ ID NO: 626288 - DNA, 607 bp, Homo sapiens
  misc_feature (11)..(11): n is a, c, g, or t
  misc_feature (75)..(75): n is a, c, g, or t
  misc_feature (105)..(105): n is a, c, g, or t
  misc_feature (134)..(134): n is a, c, g, or t
  misc_feature (143)..(143): n is a, c, g, or t
  misc_feature (176)..(176): n is a, c, g, or t
  misc_feature (180)..(180): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (294)..(294): n is a, c, g, or t
  misc_feature (312)..(312): n is a, c, g, or t
  misc_feature (340)..(340): n is a, c, g, or t
  misc_feature (343)..(343): n is a, c, g, or t
  misc_feature (353)..(353): n is a, c, g, or t
  misc_feature (591)..(591): n is a, c, g, or t
aattgatttanagattggggacggaggacgcgcatgagacgaacaggggaaatgaataaccccgcccccacccgnggggagaggaacattagtgcaaaacctagngccggccccggggaacctgcccctcctgngctgattgnccagctaaatggaggcaccggagtggatggggngagnctgcgggccctgaccggccgactcactgaggcctaccccagccagtgcattccaggtcctgtcattgggcgacgcgtaaaatagacaccgccccncngccancccggccgggtnaggagttaggtggcaagngtcaggactgagccctgccgcgcgtganggncggccccagnaacagacgccaggccccgccctcattgatcaggcactaccgcgcgggacgaacccattttttctttaaccgtgacgacgcgccaccttccagcatcacgtctggtcccatgaaagcgagcgcaatcctgagacggggccagggcccctgccaccacaactctagcagccaggccacaccccctagctcaggctccgcccattggaatgtaggcccgccccggcggtaccaagcttgtntagtttcagggctccg

SEQ ID NO: 626289 - DNA, 765 bp, Homo sapiens
acaagacaatcttctaatctgcacctgctctcaatacctgctctcaccatgagcctccgcctgcagagctcctctgccagctatggaggtggtattcgcggggtggcatcttgccagctgagagtgatgtgccgtggtgtctctacctgttcacctcggtttgtgtcttgggggactcagctggcgggctactggcgtgcggctgtgacgctgtggtctcctggttggacgcgggctgcgtacgtggctttggacgcgtggctactcgacggtggcctctggcacggtggctaatggaagcgctggccctctgccgcgtttggcctattgcgccggcgcggctctccgccctgcgctcgcctctcgatcgcacctccgcgacgccttgctgcacttgcgcgagcgctcgcatccacttgccccaacctgcggcccagactcacccactgcacgaaaccctcaaatcgaacccgcacctggcacttccgcataccccctgcggagcaacagggggctgccagcgagccccttgcccacggcgcagcgcgcaaaccagcctcgacacccccaggccacagtagttgcaaccaacatcccctggctgaccctcggagcgacccgtatgatccagccacgcacgccccccaagcgctaacggccccatagacagccagcgcgagcctacccgagaggtatccaccatcacgctcacacacaggaggcccagtctaagacaccgacgccgtacccagaggccgcaccggc

SEQ ID NO: 626290 - DNA, 982 bp, Homo sapiens
gcttctctgaccggcatcttgcctgttgtggcaggctcgcatgggaagcgtgagaatttctagagaaggaaacctatgtcctgcagggctgtggtccactgctgttttatgccatggctataaccggtgtctccgggaaccggagggagcacacagctcttcttaaaattgaaggtgttcaagcccgagatgaaacagaattctattagggcaagagatgcgcgttgatgtatatagagcaaagaacaggacagtcactcctggcgggaaccaaggaaaaccagagtcgatctggggaacagtaactcgggcccatggagacagtggcatggttcgtgccaaaattccgaagcaaatcttccgtgctaagggccatgtggacacaagaaatccggagtgatgctgtaccccctcaaggatttaaacctaggtgaaggagaatcaataaactaacattgtgggattttgtccaacacaaaaacatacaagacaacacaaaaaaaaaaattttttgggcgctttggccccgagaaaagcttttttaaagcaccaattgcttttgggggggcacgcggccccacagggtaggacaacactggggacaagccggggcccacgagaaacctgcgacacaatacgtggttgggtttccaaccccacaaaaaaacacccgggcggaagcgacggtttttcgaaaccaaatccaagaggcgatttccagcgacatgaggtgatttctaaccaagggggtcccagaagactgaatattaattaccccgagtggcgggagaagaacgagaaacagaaagaggaacagacagcaaaaaaaacagcggaaggacaaacgaagaaaaagctgaccgacaagaaccagatagcacgcaagcaagaaagagacaaacagcgaagacgacgagcacacaagccgagacaggacaacgacacagagcagacacaacgagaagacatcagagcaagacaa

SEQ ID NO: 626291 - DNA, 731 bp, Homo sapiens
gttcttagatagagatagtatttccaatttcttgttcatagtaacatttcaataaaactaaaaaatctattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaacccaaaatcacagaaaaaaaattgaaaataaaaaccataaaaaaaacaaaaaacaaaataaaaatctaaaaaaacccaagacaaaagcaaattaaaagaaaatggaaaccctctgcaaacaaatattcagaaacttaaaaaacagcaaataacaaaaatgtgaaaatctctaaattattctgaatagaaaaataccccagttggatataatattacagacaacatccaactctctagttcttgaagaaccacataacagatctcgagaagagtgcactgcaatacaatcccactttaacaaaagatatcacaataactaatctaccctacatcaactagacacactatataaacactttaagttttcacaaaatttatacagaaacaaacgaaagcgcgagctctatctgaatataaaaaatagcggacatctcctgatactataagaaaatatcaaaacaatatgccgtgctatcgaaatacgctagtcatccccacttagcgattaagccacacacaactgataagtcatttttgattaacacccctc

SEQ ID NO: 626292 - DNA, 343 bp, Homo sapiens
ctggtcataagaactcttcagttccctttctccgggggtcacagccaaggaaaaaaagagactcctgggcctctgggcaaacatacatcccctgacgcggggctgggtcccccttcagcttccctctctaaggaacaacttgaacatagaaactccaacctcaccggtaatcccagcactcggggaggccagggggggcaggtcattggaggccaggagtacaagaccagggtggtcaagagggcgaaagccgggctctactaaaaatggggggggggggcgcatgcctgtaatcccagttactggggaggctgaggcacgagaatcgcttgaaccagggagg

SEQ ID NO: 626293 - DNA, 480 bp, Homo sapiens
agtgcagtggacgaaccttgctcactgcagcctcgaactcctgggcttaggtgatcttatgtacctcagcctcccaagtagctgggaccacagatgtaccaccacaccttgctaattttattttttctttcttttttttttaaagtcgagacaaggtctcactatttttcccaggtagggctggaattcctgggctcacgccatccacccagctcagactcccagtgttaagattataggtgtgagccaccatgcccggtctcaaggactgtaataatttgctgtactctcatgcctgtataatggctcctccagatcttataacggctcactctttcgccgcattcaaagtctctctcacatttaacaccttagcagagagaccattcctggccaggattgttaaaagtagtgctcagtttgcaacctcataccccaaagtactgtttaacattctttaatggcacttatccctgaatg

SEQ ID NO: 626294 - DNA, 298 bp, Homo sapiens
aatacctcccaggaaggaaggaccggctcattcttccctatcccccgccaccgccacagccaccgccacagccacccggcttgacctccaggctcctctatttgcatgaagacaaaggagcaggtttgtacaacgtggccggcatctgtctcactttacaaaacaaatcgttgaaggcacagacctctctctaaccaacagaacaccccacccacccagaagcttcaagaaggaaggtgatgaatagcagttcttccaccgctggctaatgtgcacaggcagacgcgctcacctccac

SEQ ID NO: 626295 - DNA, 367 bp, Homo sapiens
  misc_feature (67)..(67): n is a, c, g, or t
gagggtgtttttggaagacactgagataaccatgacccaatgtggatgggcactgatatggtttggntgtgtccccacccagatctcatcttgaattgtagttcctgtaatacctacatgtcgtgggagggacccaatgggaggtgactgaatcatggtggtggttaccgccatgctgttctcatgacagtgagtgagttctcatgatctgatggttttataaggggcttttcccctttgggtcagcacttcttgttgctgccatgtgaagagggatagctttgcttccccttctgccatgattgtgaggcccctgcagccatgtggaactgtcagcccattaaacccctttgttctttataaatta

SEQ ID NO: 626296 - DNA, 353 bp, Homo sapiens
tgggcacatcaaggccagctgaacgacctccgggccgccataggtttcaagggtgagggctttcatcgcgggacaactccgtttgcggtgggaatgcaccatggtaaaaggcgctactctgtacgagaattccccaacacctcccaccctccgtgcgaaaataacccgatgttcgactggcaggatctgtatttcttcaccgtactggcgcgcacccagtcgctgtcggctgccgcccgcgagctgcaggtggaacacgccaccgttggccgccgcatcgatgccctggaaaaagccctcggcgtaaagttggtggatcgcctgccccgcagccgaccgttgaccgaggaagg

SEQ ID NO: 626297 - DNA, 174 bp, Homo sapiens
  misc_feature (35)..(35): n is a, c, g, or t
  misc_feature (122)..(122): n is a, c, g, or t
gtgaatggaacacaggagtagaaaagaggcgtttntgatagagaaattacagaaagcaccttttgaagaaatagcagcacagtgtgaatccaaagcaaatttgcttcatgatagacttgccnaatattggaactcaccttacgtcctcctcccagtccatcaggaacactgacc

SEQ ID NO: 626298 - DNA, 192 bp, Homo sapiens
gaccctggggcagaaccttgtcactgtctcgtagatcccgacatgccaatgtcttccgctgagcctctgagcatcctggctgggtgggaagttcttggctggtcacgcctgtccgctttcgctccaggtcacacttgagtggctccgttgggggaagaagccgctggaccatggcaggctgatgaccactgt

SEQ ID NO: 626299 - DNA, 898 bp, Homo sapiens
  misc_feature (748)..(748): n is a, c, g, or t
taggcgtgattatggatcctctaggtcaaggcgactatacgatgcaaatatttctcttattaggcggcgtggtagcaaattagaaaagcgtaaagggtacacaaagttttctgaggcataggttatgtaataggcaagacactgctatggcctggtgtgggagtagaagaaaaaacgagaagtggttgtggacgtataagcgggttgtggcctacgttatcaaagggtgacaggagtcatggaggcgatgatagatacgaacggatagacaggggcgggcatatttaccttgagagggtggtgagtaagcgtaagcgggtcaaggagttttgatgtagtggagcaggattgatcacttgataaggaacgtgagacagggcgtggaggcgaagggtgccggtgaggggctgtgtgccgtagggcttggtgatgtgcgagagaagggaaggaggagagaagacataggtagggctgatgcaggagttggagggcggtttgtttggggaagagagatgtgatgccgaggtgtagagatatcagtggagggggcgatgaaagagctggggaaagtgagaggcagttggccttagtggaggaaaagcatagtaccaggagagtaaggagcgaccgtatcgagatgcgacggtctgtgatatgtgagacccgtatgttatggtagcgggacggtcatgattgtgtgagcgtgggagcgaagggttatagcgatagaggtggagacgcggtgggngaatgggggaggagtaggagagaggggcggtgcgcggtgtagtaagcggatggaatgtcagggagggtgcgaggaggggtaggagataatggcgcgtggaaatggcagtgtgtgagatgcggtgtggaggcgtagaccaagtgagccgtg

SEQ ID NO: 626300 - DNA, 663 bp, Homo sapiens
aggaattcggcacgagctgctcagtgacctggaggccaagggcgagaaggggtctgagcttgtgttgtataagccaggcacgtgcgtgaaggggctgaccatcgagcccccacctgcagacccccgcctacgggaggacatggcgctgatggccgagtgagccctgaccccagagctccgaggggatctttgggagctgcccttcccttgtcctgacggcttcaacagctgccctgacatctgctttcgagaggctggctgcagcttcctctgacacaaggcctttttttgtggccgcagagactactttcgagccctgctggatgaccactttccggagagcgaggagccagcgaccctaaggggccccccagcccgcaacctgcatggcatctcacccggacgcttcactcacgcgctctaatacatgtacagggaccacacctgggtggtccccgagggaggccatgatgtgctgagcgctccgccaagtacccgctgccaggcctgagaggctgtgctggcgcaacctggctaaatgctcgaggaccctgtggcggagccggggacgcgcctacggcttcccctagcgcggcctgaggaccccccctgttcccgggccccggccctggccgccgtccgccctcctctcccctggccccg

SEQ ID NO: 626301 - DNA, 353 bp, Homo sapiens
aaacagcagccaggcgtgagtgttaaccacccatttcacttccatcatgcccgaattagtgaccttcaatgcaggaacatgcttatatcccgtctacagaaagatgaaggacccttcattccaggtcctagtcaacccctacagtcctagtgccacctcaaaccagccctctctgataggacttccattctccctgcctccccaagcccgcaatacctcatacaccttctctagcctctcagaagatgtgtcatacccttgatccagctcgtccctgaagccgccgctcctcttccagaagcttcaatcgctatgtgtcagctcgaagaacagactggactgctgtagtctgc

SEQ ID NO: 626302 - DNA, 633 bp, Homo sapiens
cccagtttaatgaaagcttaaatgtccctgcgaaccccccatctctgccagcagaactggttttgttctgaatagtacagattgatgtgaaccaccaagcattttgtgtaaggagaacccctttcttgttaaaagaagtgtgtctatttcgaggggagttacaacggcccagtttggtaaaagttaagctagtatcatagtcactttaaaattgtaatagattcttaagccacttttgccccctcacccctaagctgcttcttatttctgccggcccaccacatgccacaggcactatggtttgtaatgtgttttcgcttatttgcgctctttttggagaatgtatgtgattctgtattctaccgtatattctataatgtgtgtaatacatatatgaatataatacacccaccacgatacccagtggtaccacaccaccacccaccaccaacccaccaccaccacccccacactggcacgttctttgtggaattaggatgggggtgacataattttcttgagtttaacacggagtgctttacccaccagtcagtcatggatatgatatcactgctctttatttaaaagtaaactttgggcacaggaaccatatgggaacattcagcttgttta

SEQ ID NO: 626303 - DNA, 1426 bp, Homo sapiens
gcggagtgacgccacggtcagttgggtagtgagtgggtcttttgtctattttctattagtgatctagtccgggtctctgtcgcgtgagtacacaaattgtgtgtgtgtgctgtccttgctgtcgccgggggaaccgggtttgccacaccccacgtgtgggggtccccttgtgtcccacgtacatgttttccccgcgtgtgttattttgtgcgggggccgccccctgtgcgtttttgggtgtgacttttcttctccgggggacacctattgtgggctttccacgtggcccagggaatgtgttccgcgtccaaaggtgtgtttattttcgggggaactgttcgctgggtggccgcccccgcgataatgggcccctcccccgattggggaccccaccttggggttttcacctgtcgttccacggctggattgttttcccttgggggtcgtctttctccgcgcgcccataggttaggcctccccgcgcgtaatagggcccccctcgtaaattggggagtttggcgcacacccaccgggagttcaacacaactggggccaaacgcaccaggtgtgtgctcggagactctggatagcgaaacaaaggagttggaatttcgcccgctgtttcgtcgggttataagaagaccttgggagtaagtaatggggcccccgtaaaaatttctttggaaaaggtcttgtggtgaattcccctgcccaccacttggtgtgaatatatgggggtttccccaagggggcaaaagacccccacagttgtgtgttgtctctgagagaaaagcttttttgtccacagagacttatgtcccacccccctgtttggggggtgccccttttggtctggtttccgttggaattatttgagagacccacaacccacagttttgaccgggtggggtgggttcaatctccacagcgccacagtggggaccccacagaaaagggctggcctcgggagagtctctggccaaaagggtgccacacccacaagtgtcttggccccccacggaataaggtcccacgagaaggctataaaatggagataattttagtgcccctgatattgaccctggcccaccccccaccttgcttaaatgtcacggtgtggttggaaagagaccgggtgtcttcaaagagaactcgtgtttgttgttcacaattggcgccacatcttaaccgctttatgtagtgtaaagaactggtgtataatgattaccacatgcacttcgttaaacctcttcacgaaggaaaaggagaatgttttgtggagccacactcttggtttttcttttttgcgtgtggcacgttttaagttaattagatttttataaatccgatactttttcaactggaaaccacttgacccaaaaatttgtccccagaagtttgagaccccatttaaaaagtttaatga

SEQ ID NO: 626304 - DNA, 101 bp, Homo sapiens
aacgcaccctcgctgaagaactctttaacagcgtaggcaagaccctatggatcaccgaagaagcgttaatggacgccgtgactgccgtatcagggagcggt

SEQ ID NO: 626305 - DNA, 118 bp, Homo sapiens
cacaacgtcggctgctgggaagatctggattctcgttgtcagggcaccaatcagaaaagctaaggttgctgtatagtgaggatcaagagaatctgatcccgagtggcagaaccctccc

SEQ ID NO: 626306 - DNA, 518 bp, Homo sapiens
  misc_feature (31)..(31): n is a, c, g, or t
  misc_feature (99)..(100): n is a, c, g, or t
  misc_feature (128)..(128): n is a, c, g, or t
  misc_feature (159)..(161): n is a, c, g, or t
  misc_feature (213)..(213): n is a, c, g, or t
  misc_feature (219)..(219): n is a, c, g, or t
  misc_feature (224)..(224): n is a, c, g, or t
  misc_feature (231)..(232): n is a, c, g, or t
  misc_feature (234)..(234): n is a, c, g, or t
  misc_feature (247)..(247): n is a, c, g, or t
  misc_feature (260)..(260): n is a, c, g, or t
  misc_feature (264)..(264): n is a, c, g, or t
  misc_feature (274)..(274): n is a, c, g, or t
  misc_feature (289)..(289): n is a, c, g, or t
  misc_feature (297)..(297): n is a, c, g, or t
  misc_feature (313)..(313): n is a, c, g, or t
  misc_feature (341)..(341): n is a, c, g, or t
  misc_feature (347)..(347): n is a, c, g, or t
  misc_feature (351)..(351): n is a, c, g, or t
  misc_feature (499)..(499): n is a, c, g, or t
ttcctctgtgtaaacatatccgctaaggcgnacgccatccgggtccggggctgctgcgctgggctcggtgcctcctaatttctgccgattctcaggccnnaccatcccccctctgccagtccgcgtanttcccggcctcctgggccttttcctaacctnnngggttatcgggtttcacccgccgtgccgtcgttctgccaccccctgcccgtngcctcnctgtngcctcgnngncccctcccttgtntgggctgggtggnggtngcggtttcgnggcgcggcggcgggngccgcccnccggcgcccgcctgtncgccagcccgtggggggctgtggcgggncccggncggnggcctgggcctggccccggcctgtctggtgccgggcgccggggtgttcgggtccccctgcttcctcggggggtgggcgtggcaggcgggtcgctggtggcagggcggtgggcgtcgcttgggggggggtggcgggggagggctgggcnggcccccgctgcccaaaac

SEQ ID NO: 626307 - DNA, 299 bp, Homo sapiens
gtgtgtatgaaaagatacagaagatacatttcgagactgagaagaatgttgatatggtttggttgtgtccccatccaaatttcatcttgcatttatagctttcataatccccatgtgccatgggagggacctggtgggaggtaactgaatcatgggggtgagtctcttccatactgttctcgtgatagtgaataagtctcatgagatctgatggttttaaaaagaggagttcccctgccccctgtacacattctcttggctgccaccatgtaagatgtgccttctacggcttcgtcggt

SEQ ID NO: 626308 - DNA, 1653 bp, Homo sapiens
ggagcagagtcaatccagcatgaccgagcgccgcgatcccattctcgctcctgcggggccccagactgggaccccattccgtcgatctgggtatcccgtcataggcgcgtgcttcttgcgaactcgattggcactgtcagaggctgctcgccagggcgtgtctcggtgagggaggtgtgtcgtcgaggtgagattagcgtcgcgtgagggcaggcatgtggccagtgcataacggtgacagctcgcccatgtcgcgcctccagacctgttcgcactccgatgacgaccacgcggcagttgagcacaggcgaccacaggctctaatcatgtctctgggagtccgactacaagacctggacagatctacatggacagagcggcgtgttctacggcgagactaccggagcagcaacttgacgaggaaacccggatggggccgacgtttgttccccatgaggacatgcatcaagcacaacacttcaggcctccgggcacacgatggcatgatgcggtgtcaagtggaacccaaaaggacatgaggcgatggtgtggtaagagtcatgccgggcatacgtaacgagaggaagcagggcagtgaacggagcgcaatgggctaaacaattcctcacacgggtgggctattcaccgacggggacaaataacaccggccttggcacacgcgctcgagatggttggggaccacgcacaaccaacaaatgctcttccactcacgttcccccatgtgttcccatgaaaggtggaagtacatgtgagcccgttggagacgggaaccccaatttgtccgctaaaggcctagtgcccgaacgtcgaggttcactaaaacgaaggattcaagcacaattcccactgttcaaccctgtttcggaaggtcaggcacgggaggcccccaggtgcttagagggagggccccaagtaaataggccttgggaaaaaggtccagaattgaaagaagttgggccgggtcccaaaaggttagaaagggcggtgttaatgagcctccgggatgttggccccatgcacccccgttggcgttgggcctggccacctatgggggttatgattaggcctaatccacaccaggaggaacacctcatggagtgtgtgggttcctttactctctgagcgtaccacatttttgtactcactatcgccgtggatagaccacttaccaacgtgtcacaagcgccgtcacgggggaggaaatcgcaccgcaaaaaacaaacaaccacaatagactatcaagcaaaaaaaaactaactgtcagggagctctatcattactcgccgggggggaggcaacaaggggtgtgactgaaaaactgggcactaggggagataagaggtgtctactagcacacaaatattttagtaacagcgggggcaaacaatatcggagcacctaataataagacagatagcaaagaggaaacaaacggtctgagaatgtacacagataatactagtcaggatacagaagaaagataatagaggaaggatgtgaaaagtaggtaggagatatagccagcaagcgaatcagcatgatagtaagcacgcagctagaagagaaaagatacacaatagcaaatcgacgtaagctagctagtatagtaatagtcaagtggtagataagtaa

SEQ ID NO: 626309 - DNA, 550 bp, Homo sapiens
  misc_feature (10)..(10): n is a, c, g, or t
  misc_feature (103)..(103): n is a, c, g, or t
  misc_feature (114)..(114): n is a, c, g, or t
  misc_feature (138)..(138): n is a, c, g, or t
  misc_feature (184)..(184): n is a, c, g, or t
  misc_feature (197)..(197): n is a, c, g, or t
  misc_feature (216)..(217): n is a, c, g, or t
  misc_feature (231)..(231): n is a, c, g, or t
  misc_feature (279)..(279): n is a, c, g, or t
  misc_feature (372)..(372): n is a, c, g, or t
  misc_feature (388)..(388): n is a, c, g, or t
  misc_feature (390)..(391): n is a, c, g, or t
  misc_feature (403)..(404): n is a, c, g, or t
  misc_feature (475)..(475): n is a, c, g, or t
  misc_feature (550)..(550): n is a, c, g, or t
tgttgttggngttctatgtgtgtggcatttcactgttgctcaccgcgtggtagtgctcctagatatctttcttcttctagcttatgtgctttggttctgcccntgtctttccgntgtctgcctctgtcctgtcatgcnctgtggggtggctggcaggtcatggtctacgctttgtgttccctanacatatattatcnatatttacgttatattggnnattaatataacagnaaaagtcacaatccacctagcccctcaccagccaagcgcagccttgcncattcctgctttaccggtatgatctcgtctaaacaaacatttcatttcagaaaatctgcatcaatctacacggaccatacacagtgcacaaantgaaaagggctttaancnntttttttctagnnccaccatctctgcaacttgccaagatgcggcaagactatctgcaacaaagtaaaatatacaggttttttantccaccagtgcctcagataggaaaaagatatgattacggtttaaatccatacatagcagcttacaatacttaagn

SEQ ID NO: 626310 - DNA, 1001 bp, Homo sapiens
cgcagtggcacacgcctgtaatcccagcactttgggaggccgaggtgggtggatcacccgaggtcaggagttggagaccagcctgaccaacatggtgaaaccccaactctactaaacacaaaaaattagccagggtggtggtgcatgcctgtaatctcagctacttgggaggctgaggcaggagaatcacttgaacccaggagatagaggttgcagtgagccgagattgtgccattgcactccagcctgggcaacaagagtgaaactccatctcaaaacaaacaacaaaaaaaaaaaaaccaaaaaaaaaggattcaaaaggcaggattctttaaacccaaaacccccttgtgttcacaggaaggtctttatctccaaattccccatacgggtaaagggcaaccccaggtgtttccctgtgggttgcgtctaaattacaccaaaaccggtgtttattcaccctctggcattacttacgatttcttattaattcccagcggcgcaatttttattccaaggccttttaacaaggcgcaagaaatcttcggattctgtggtcgcccacaacccgttggccacgaacctctttgaggcaccctttagtggccacggtgtgaattaccccaagttcccacaaggggacccaaaatactctctatggaatttcctcctcttaacgcggtttcccttagaagtatactcacaactttttctttagaggaacccaacaagggtcttatcttacaaatgtgcttctgggcaacgcgccacggaatctcagggcgaagcggggggcacacgacatctcagagacagcagtcaactcggcgtcgcataacgtgggaacccgaagaagtgctttcccagggttgttgggcccacagatttctatcacacacacactcatcacacctcatccactacacaacactcttttcttctcgcgccgcctcctcctcgggcgccctccctgcgagaaaacagctttctttaaagacacc

SEQ ID NO: 626311 - DNA, 84 bp, Homo sapiens
ccccctgttggcccccctggggggccccccggggggtttttccttttttttccccccccggggattaattttctttccccccca

SEQ ID NO: 626312 - DNA, 385 bp, Homo sapiens
  misc_feature (352)..(352): n is a, c, g, or t
aactgccatgactatgattgcggagtcccggtccgctggatgacaccaatgaacatcttacatatattgatcgatgtctcgggtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctntcaagctgcttttacttattcctgggtttaagc

SEQ ID NO: 626313 - DNA, 292 bp, Homo sapiens
ctggagatggattgtagcagaagtaaagttgaaatcaagtagggtgagcccctaatccagtatgaccagtgtccttataagaaggggaaatttccagccggagtgcggtggctcacgcctgtaatcccagcactttgggagcacaaggcaggtggatcatgaggtcaggagttcaagatcagcctggccaacatggtgaaactccgtctctactaaaaatacaaaaattaaccaggcatggtggtgggcgcctgtaatcccagctactcgggaggctgaggcagaagaactg

SEQ ID NO: 626314 - DNA, 781 bp, Homo sapiens
  misc_feature (139)..(139): n is a, c, g, or t
  misc_feature (350)..(350): n is a, c, g, or t
  misc_feature (362)..(363): n is a, c, g, or t
  misc_feature (377)..(377): n is a, c, g, or t
  misc_feature (381)..(381): n is a, c, g, or t
  misc_feature (384)..(384): n is a, c, g, or t
  misc_feature (393)..(395): n is a, c, g, or t
  misc_feature (398)..(398): n is a, c, g, or t
  misc_feature (402)..(402): n is a, c, g, or t
  misc_feature (407)..(407): n is a, c, g, or t
  misc_feature (410)..(410): n is a, c, g, or t
  misc_feature (417)..(417): n is a, c, g, or t
  misc_feature (425)..(425): n is a, c, g, or t
  misc_feature (431)..(431): n is a, c, g, or t
  misc_feature (433)..(433): n is a, c, g, or t
  misc_feature (438)..(439): n is a, c, g, or t
  misc_feature (443)..(443): n is a, c, g, or t
  misc_feature (446)..(446): n is a, c, g, or t
  misc_feature (458)..(458): n is a, c, g, or t
  misc_feature (465)..(465): n is a, c, g, or t
  misc_feature (469)..(469): n is a, c, g, or t
  misc_feature (485)..(485): n is a, c, g, or t
  misc_feature (517)..(518): n is a, c, g, or t
  misc_feature (616)..(616): n is a, c, g, or t
ctgggcaaggccggggcgccgggcctgagccacctcttcccctcccccgcttccctgtcgcgctccgctggctggacgcgctggaggagtggagcagcacccggccggccctgggggctgacagtcggcaaagtttggnccgaagaggaagtggtctcaaaccccggcaggtggcgaccaggccagaccaggggcgctcgctgcctgcgggctgggctgtaggcgagggcgctgccccagtgccgagacccggggcttcaggagccgtgccccgggagagaagagtgcggcggcggacggagaaaacaactccaaagttggcgaaaggcaccgccctactcccgggctgncgccgactcccnngccccaggcctggnatcnagnagtacgggnnngancccnggtgnatngagcccnccttgggnaaggcngncacannggangcntgggtgccgggnctccgcnggancccatcgggtagacanagaagctccggaccttccggcactctggacannccaggatgctgttggcaccctcctcctcctcctccttggaggcgctctggcccatccagaccggattatttttccaaatcatgcttgtgaggaccccnccagcagtgctcttagaagtgcagggcaccttacagaggcccctggtccgggacagccgcacctcccctgcaactgcactggctcatcctgggcagcaaggaacagactgtcaccatcaggttccagaagctacacctggcctgtggctcagagcgcttaaccca

SEQ ID NO: 626315 - DNA, 928 bp, Homo sapiens
gagccgggacttgagtgcctcctggtccctgtctgccgtgcattcgcagtgacgtgcaggtcgccctggaggtgggactggcttccctgtgtgccagcgagggcgggtccggacagccttccccccagtcgcggctgcaccatctccctgccttgtggctggatggcgccgctggaccccaaagggatgggacaaatcccggtgaagcagccccgagagctgtgaatgtgcaagaattggcttcctcgagagatgtacagtgcagcctctaccagacactgggggccccagtgggcgtgggtgcgacagcttgcctgggctaagcgaaggaggttgggcggaaatgcacttgggaacctccttttaatacaggtgttcacgctgctgcacacctttttacctttgaatctgcaaaacatgacgttaagctggcccgaacaaggaacagcccaggtatacgacgcaagcgcgtacggcgcaggtcgccgcgcggttccatttcaatgggccgcgacgactcatatcctttgacttagacacgatattttgtagaaacgtcgtatttagagcgcagggaaaccattgagcctttaattgggccagaagccccaccttttaacttacctgaagttgggcgagaattacccacgaattaccccatgttgacagacatttttccaccccgtgtatgaacccaccaacttggaaccatttttacatctgtgcccatttttccctttgggactattgagcgcaaaagtacccccctaaacagttgtcaagtgttacacaacaagaccccttaacttggagggttggcattaatgaaacaaccgtggcaacttcagcttgtggcccatgtagacaccaccatgaccatttccacctaaattcacactccacggtgaaagcatcgctttgcctccag

SEQ ID NO: 626316 - DNA, 234 bp, Homo sapiens
gtcttggccgcccaaagtgctgggattacaggcatgagccgccacacctggcctatttttctttaggtatatacccagtagtgaggattggtgggttgaatggtagttctatttcaagttctttgggaaatctccaaactgctttccgtagtggctgaactaatttatatcgtactacacagttatatagcgacatcccctttctctacacaccctaaccaaacatctgtatat

SEQ ID NO: 626317 - DNA, 129 bp, Homo sapiens
ggtgatgctgaggtgatctagaggatcccgcaagttcagtcgggactggatgcgaccggcgatgcggcggcgttattcccatgacccaataccaaacgcccctcttcgtctgatccgtcctaatcacag

SEQ ID NO: 626318 - DNA, 287 bp, Homo sapiens
  misc_feature (17)..(17): n is a, c, g, or t
gtttttggggcctgaanccgggaaaaatgttttgtttttaccccggggcccccaccaatttttttttggggttttggggaaatggcccttgaaaaacccctgggggggttttggggtttgggtaatttttttgggggggcccctggccccccttttttttcccccaaaacgggggcccttttttgggaatttgtcccttgggaaaaaaaaaggcggggttttccccgggggggggttccccctttttaaaagggttttttttaaggcccccctcctttttgggccca

SEQ ID NO: 626319 - DNA, 177 bp, Homo sapiens
atacagtgcgcttgttggcatgtcagcagactttgtggtggaggctataggggacgacgtgagcacgctgggcttctcgtgtggaatgggccatcgcgtggctaatgatcgaactgtgactgacaatgggcgacggctcctagtgattgtgcgctacttggcctgcaggaggcttgg

SEQ ID NO: 626320 - DNA, 877 bp, Homo sapiens
caaaactgaagtcaaaaggaaataatataagaaacacaaacacatatatgacagcaaccttcaagatctgggttttcagctttctgcaaccttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaaaacaaattattacaaatggaaaaaaaaggaaagaaccccggttaacacacaggcgcaacacacacaacaaaatctggtccattggcggggagggacatggtttgtttgtaggtgggaggggtataaaaattcaggtttaatcccaaagatttaaacttagacttggatttaaaaacatttgtgggagccctggtgtgctggacaatctcgtagttctcggagggattggagtggcatgtgggcccggccacatcaaggggcgtacacgggataatatggaatgtgggggaatcctcgggatgacggttggggagggccctggaacccagtgtttaagggtggggctccagcacagggcctaaaatgaattaagaaagcccgaattggtggtccttctctaaggtagaagccagatgatgagacagcaaggagggtttagcatggcccacggtggcaggtcccccagggggctggcccaaggaaaagggaaaaaaaagacagcaggaggtaagatgagcgaaaaaaaaggggggcaaaaagcaggagaagatgacgcgagtaacacagtagcgagacccacgcttggtagcccccctcccgacgcgg

SEQ ID NO: 626321 - DNA, 1220 bp, Homo sapiens
gagcggagcgaggccctgcctgccagccgggaaggaggcgtggttataggagctaggcggctgcaaccccggggcccgcgccgctagcctagcgctatcccgggggctactttggtggactgcgctccccctgtctctgtcggctacggggaacccgtaagagcccggtcgctagtgcagcggttggccctatctacccgtgctccgttgttataccctacctgcttcctacctcattggcagctggtaatcaggtgcctggagcagggcctagaccaccgactggcagggccaccctgacagaccatccggaaacggcgtacataagatagacacgtaacctgaacgccgccctatgggacctacctgggggaggctgagggacggatactctggcccaagtaataacatgccagtggaccggatactaaacgcctattttcccaccgtacatggggttgataaacacccttaccccacctgacttggcactgtggcttcctccaactgtgtttagggccgttacattctaaacacatttgggtatcctcttatccctgggacaaagttgttagcaaccttagacactgacccaggtggctatgcagaaacttgtgggcataactcgcaaagcacttggactggtgcatgcacgacatttcccaggttattggccttctcccacggaatcgtgggtgatcgaaggtacaggacaacacacctaaggaactaactttacgccattgttcacgggccttgttgcaaagcaaacactgtgaagcccattgagactcgaccccgtggcttaatacacattaagcggtagtgaaacaccagaaatctgggccactccaacctacgcccccaagacacgcagttcatactgacatgaacacagactgctcttataaacgacgacaaagctaagcaacacactgggtgaccagttgcaagtccgtgagcgaaaattaacgttgaacaaaccacacctcaaggttttacccaccgataaactaccaacttacctcttgtgcaacacaacacgaaccccacacatggaggcaaagcacgaaccacaatcacaatagtaagcaaaccacattatcacacagaacctcccctcacagaacagctgatacatcgccgcgacgctactaactgtgatgcaagactacacaagaaaatatgggcccgtaaaaaccgatgaatcaccagtaagt

SEQ ID NO: 626322 - DNA, 193 bp, Homo sapiens
cttgcttactcctcaagtttgaattgattttaaatatatttcaaatacaacagtttaggttaaagatgaccaatgacaatgactacctttgcagataagtaaactgattgaaataaataaatctccgttttcttcaatttatttcaagtgtaattgaaaaaggttgcttagttatttaatgagggaaaattct

SEQ ID NO: 626323 - DNA, 156 bp, Homo sapiens
ctgagatcgagcctgtactccagtctgggtgacagagcaagactctgttcctaaaacaaaacaaaagagtgtggcatatcctcatggagctaacagacaattaaacaacgaggttcaccaacagctcggagagacgcataccagagcagcaggcat

SEQ ID NO: 626324 - DNA, 101 bp, Homo sapiens
cgttttacggttccagcaagccgacgcggccagcgcgatcgggcactactggccgccgcgaatgtggaagtgaaccggcctgccgtggaggctggcttgct

SEQ ID NO: 626325 - DNA, 861 bp, Homo sapiens
tgcctcgcagttagactgtcgttctgtggatgtggcaacaggatggctcggacaaggcactggagagttgcatgtggaatggcatatctggcaagtacttcgacaggaccagcataccggagtgttctgccatcatgagatgatggcgagtccatcagaaggctctgtctgggaggcaatggcctttgcttcctactacagatctggacaatcttgtggcaatctttgatgctgaaccgttctgggacacagatggtgcattgcccgccgaggcactgcatacacatctatcagaggacgcatgcgaagcactttgggtggaacacttatgtggatggacggacgaggacgtggaggcactgtgaccaggtattctggacagagaccttctcaggatgaagcacaagcccactgctgtggtggccaagaccttcaagggccggggcacccacaagtattgaggatgcagacaagttggacatgcaaagccaatgccgaacagaaagagcagatgcacattatcaaattaattgcagagaccaaatacaagaccaggcaggaatcttgagcccaagaaccccgcattgaggactcacctgagagtcaaaccattcagaggactgttaagggctaccccttctcgcaccttggatttcaccgacgtttggtgcacaagaataggatactccggaacaacatgcggtcatggattctagggctcagctgagatacgcgaacacaacagaagtcgtgagactgacatggtgacacgggaactctatactatgaaatatccagaggagtaccctgcgcccacgcagggattgggacacaatgttacgttctgagttctccggatga

SEQ ID NO: 626326 - DNA, 155 bp, Homo sapiens
tctgtggcacacatcatgatcatctcagagttagctgcacgcactgctcttgggcacttgctccatggtcacaattcccaagggtcattctaaacagtggtggccaccaccccttagaagcaagagaaaaagaaaaaaggcaaataaatgcagaa

SEQ ID NO: 626327 - DNA, 130 bp, Homo sapiens
gatagcgttggcgacaaggcgtgacttgagctttctccttctcatagacattctggatgggcatgagaaggagaaagctcaagtcacaactgaggagaagaatttcagagcctttgctagttgctgcatg

SEQ ID NO: 626328 - DNA, 493 bp, Homo sapiens
agcgggggtgggtcggaggcggggcccaggtggtgttgatacacaaagagaaggcgcccgggcggccgcggtcccgcccactgacgcgtccccggtggtgccgctataacccgccgctcgcagggctgctccacagccgcgcgacgccgccgccttagaacgcctttccagtactgctagcagcagcccgaccacgcgttacctgcacgctcgcgcctttcccttgacacaggcggacgccggaggattggggcggcaatttgtcttttcctttgtatcaaacattatttttcctgcctgctcgtacggatctggggaacatcttcacagctaccgtactcatcactgattcgtattctgactgagagaaacccactgaagacgtctgcgtgagaatagagaccaccgaggccagactcgcagggccgcttgcacccaaccggcaaggacaaaacggagacccagcgactactacgctgccccgattcctcca

SEQ ID NO: 626329 - DNA, 503 bp, Homo sapiens
agaaagaaatgtagtttggcttacttttgtagtgagggaggcaaatttataatattgtataaattatttaagtaccatgttttctgcaagtttaaaattaagtgcttttataaatgccagattaagactacaattcccttaatatgtaaaacctgtgaacatcgtggagcagttcacctgcagaatacaactaaagaaatcaaatgcttctaggtagcaaaagctattcacaagctaaattgtttatacatataaagctgtagcttataaactttatcatccttggctttacttagtaaattttttgctaagtggaatatgctttgcaactgagattctgctaataatggtttattaatttatcaggaagtatattccaactgatccaaagaacaaattcaaatattttaaaattttcaattaagcatggcataggttatcaaaatagcaataatcctttatctttacagaaacagaataatagatacctgttttttgagggg

SEQ ID NO: 626330 - DNA, 368 bp, Homo sapiens
gaggagctatccccaccctagtatgctttcactctgtatgtttgtcataattttctgtcttgttaggtaggctggattttacatgcaccacagatgttactgaatgcgcctatccatagacagacacctacttatttgcaactagaaggcactgcacctaggttctgggactataagaacaaataagacattggttctgccctcatgacatctcctggcctgctatgaagacagagagggaaacagacactccacactcgagagacgcagagctcagcacaactgacctactcgggaaagcaagagcgctgccgcagagcgaggggaggaccatggcgacgagcagctgctctcctgccccaacactg

SEQ ID NO: 626331 - DNA, 399 bp, Homo sapiens
ggacggggctcagcatattctgggaagatagaaaggggatgaagcatgataatgaaagagtgaagaacctttcagataaaaggtacgctggatctgaacaacataaccccaaagagacttgcgcaccgtgaaaagctggtctactggaagaattactccagtggtaagatcgagcccatctcctactctcccccaacttcttatgcacagaacacaggcagtctccactatggataccagttaaaaatttctggtgatggtggctgtggtggttggtataagggaatggaacaggctgctcgcagagagataagagtgggtgctccagaaaaaactttctcttctagtggaaatacgtgcccctacccccagccggtcagctaattctctacggacagc

SEQ ID NO: 626332 - DNA, 418 bp, Homo sapiens
atgacgggtattgcttggagctaacagggagacggaggttagggagaagtggtgaaacgtgcattatgatagataagtgtagtcggtcgtatacaggtctgtcgcgagttttgcttacgtatattgaagcgatgttggttaggtgtgtaactatttgaaatgtcatcttgttggtgattgaccattttattattctgaactttttctatctctgactcacttttttttatttgtttcgagatggagtctcgctctgtcgcccaggctagagtgcagtggtgcagtctcggctcactgcaacctgtgtctccgggtttcaagcaattctctgtctcagcctcccgagtagttgggattacaggcgcccgccaccataccctgctcatttttgtatttttagtagagacaaagggaaaca

SEQ ID NO: 626333 - DNA, 480 bp, Homo sapiens
gccggttgacgcatgccagaggatctcatcccctcagcatacctggttgccttgtcttgcgcattggattctcctccagagagctgaaatggcgggacctgggtctaggtcagtgctggtgaacctcaatagtcacccagcctttgctgcctcctctgtaaagcaggggtagaaacccaagctctctaggctggagaaaaactgaatcacacctagaccaacacctctcctcatatttcctagccacctccctgccagaataagctgaatccctttgctcattcataagcaaccaaaagtactcccagctcaacatttcttgagcgaggcaatcgaaaggtggggcttctccttaccttttccacttgcatgcaaaattctcttatcctactccttagtacagccctcactttaccttatagcctgcccaagtcatggaaatagtgattcttagctatacttaataattttctattctca

SEQ ID NO: 626334 - DNA, 353 bp, Homo sapiens
cgacacaggaccaaatattggtttggtgttgtctttgtactagtatacaccatgaattcttagacatacaagtcaataaagtaacagtcttttgcactgtgggaaaggttgtgacttggaaaacccctggggatagttgttgggattttattatgctgttgacggtttggtttgtgtggttttgtttgctgttgattttttctctcttgctaccagcatggctatgccagacaaaccccccagtcccgggagctaggaagtgtttaggacgggtctggaatacacaccttggtagtacgccggctccagggctgagggctcgatggggctcctggtggtcaccgaggcgctgc

SEQ ID NO: 626335 - DNA, 409 bp, Homo sapiens
ccccccccccaaaatttcccaaaaaacccccctttccctttttcccaaatttttttttggggccccccttttgggtcccaaacattcccccaaaaaggggggtccccagggaaaaaaacccttcccttttttttccccttccccttaaaaaaaaaggccccccccctaaaaaaaatccccggcggggggcgcccctgtgggtttaaaatcctttcccccccggggggttttttgggggggaaaaaatttttccttcccttttttggaaggggttttttttttgggcggggtaaagggccaaaaaaagggcccccccccctttggtaaaaaaaaaaaggggagggccctaaacaaaacccaactgggggttttttttggattttttttaaaaaaaacccccttcccttta

SEQ ID NO: 626336 - DNA, 924 bp, Homo sapiens
ggctgggatgaagacttggcagcctatgcagtacctatgtactcatttgattctcttactgtgagtcagcatgtcttcgactgtttcatgagtggccaagttctagctggtcttcctagaacctctaggcaagttcacagttctacagaatcttactacaaccatatgagagtgtgctctggcagccggtaacaggtgaccttatcgtgaagaaaaaacaagtccattttactgtaaatgcatctgatgtcgacaatgtgaaagtcccattgtacatgtgagcggaattccatgcagtgtcttgcgtggcagatgtggatagatcttattgcgaacagcagatttcgcaaggagacagtcagcccacgagcctccggcatcgtactatgaacagtatcactcactaaatgagaatctattctctggatagaatgtatagactgagaggcatcctgatatgctgtacaaataatccatattggatcctcatttgagaagtacccactctatgtattacaggtttctggacataagaactgagctagcaaaaatgccatatggattgactgtggaatccatgccagagaatggatctctcctgcttactgctgtggttcataggccatagcatctgttgccaacttggccctggaaatcgaacattaaggcagaaatattacagaggttgaaacagaatatgttttctcatatgtcataatagggaaattgatccggacgaagggggtatgggatacaagggacaggcataatatcagaacaaatggtgatgtgggaattgtaaaagatataaggattattgggttcctggatgaatggacaaagtacaagtatggtatagattcagaataaaaagagaaagaagtaaaagaacggggggacgaaagtacgaaagagtttagcaga

SEQ ID NO: 626337 - DNA, 202 bp, Homo sapiens
gcagtctgtctagggcggccgaagtggcttggctcatttaagatgaggcttcttctgcttctcctagtggcggcgtcttcgaattggtcccgagccgagggccttggccaaatcttgggcggcggttccccagcaaagggattaaaagttccagatacggcaacgggggccccttcttcaaagttccaaatttttgttttcc

SEQ ID NO: 626338 - DNA, 317 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctccttaatgacattaacactattctcaccagacctcctaggcgacccatacaaggtaga

SEQ ID NO: 626339 - DNA, 336 bp, Homo sapiens
  misc_feature (289)..(290): n is a, c, g, or t
  misc_feature (294)..(294): n is a, c, g, or t
  misc_feature (296)..(296): n is a, c, g, or t
  misc_feature (305)..(306): n is a, c, g, or t
  misc_feature (314)..(314): n is a, c, g, or t
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctctttaaagctagtggcatacctcacagtcnnatancnagtggtcanntctcgacnatgtgcaaacagtaacctatag

SEQ ID NO: 626340 - DNA, 425 bp, Homo sapiens
  misc_feature (413)..(413): n is a, c, g, or t
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctcgaatattttgtcttgcatgggcatagtgctcatgcctgtaattccagcacttcgggaagctgaggtgggaggatcagtgagcccggaggcagagnttcagtgagcaa

SEQ ID NO: 626341 - DNA, 126 bp, Homo sapiens
gatcccctggtgcatgctgtggacatctcagacacatacacttactactacagctcaactacgtgaatgtacacatcgtccagtaactcaggtgacacaagactccctgtaccaagagctctgcaa

SEQ ID NO: 626342 - DNA, 387 bp, Homo sapiens
  misc_feature (376)..(376): n is a, c, g, or t
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctctcttcttgccttccctctaccattctctcctcacctccaccccctcctgtcaccgntacttgtacag

SEQ ID NO: 626343 - DNA, 372 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctcggccgggtttgaagtgctcggatcgctctgtggaatatgtcgtcgtatgaaatttggggctggtgctagtttctggtgtggtggtggtagcggaggaggaagaagagccaaa

SEQ ID NO: 626344 - DNA, 242 bp, Homo sapiens
ggatcctgcccgcctcagcctcccaaagtgctgggattactggcttgagccaccgcacccagctatttatttttaattttttttttgagacagagtctccactttctgggttctaacaattctcatgcctcagtctctgagtagctgggactacagctgcgcacagcatgctagctaattttttgtattttagtaggacgaggtttgcatgttggcaggctgggggggggggggggggaatc

SEQ ID NO: 626345 - DNA, 380 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctcttcacacgcctgtagacaagatagagccgagaaaggtagagccgagacaaggtagagccgag

SEQ ID NO: 626346 - DNA, 117 bp, Homo sapiens
ttacaaccccacgatcactaattttgacattttcctatcttggcaatgtctagtaatcgctgctgtttgaatttatatactgacagacggcttgacacgcggaattttagaacatct

SEQ ID NO: 626347 - DNA, 510 bp, Homo sapiens
  misc_feature (294)..(294): n is a, c, g, or t
tgtggtggctcacgcctgtaattccaacactttgggaggccaagtctgacagattgcttgagtccaggaattccaagaccagcctgggcaacatggtgaaaccccatctctactaaaacacaaaagaaattagctgggagtggtggatcgcgccactgtactccagcactccagcctgggtgacagagcaagactccatctctccaaaaaataaataaataaataaataaataaataaaatttaaaaacatacaaacaaacaaaaaaaacagctacttaagaggctgaggtggngggatcacctgagactggaaggtagaggctgcagtgagccaagaccgcaccactgcactacagcctgggtgaccaagtgagaccctgtctcaatgcatagcatcagccatatcccagtacagacattatgatctaacgggcttttcttttcttgagacgggctttccctctgtggcccagactggagtgcaatggtgcgatgtgggcccctgctct

SEQ ID NO: 626348 - DNA, 231 bp, Homo sapiens
tactaccagcaacctatagccaaaccatttacccaaataaagtataaaaaaaaaaaaaaaaaaaaaaaaaaaaaaaaaaaaaaaaccaaattttttaaagggggcgggggggggggggggtgggacacacggggggccccggggccgggggaaaggggggggggggggcccggcccccaaaggggccgcgacacaaagacaacaagggggggaaaaaccccctaagggggt

SEQ ID NO: 626349 - DNA, 463 bp, Homo sapiens
actgtcaataaacagttaagcaagggcacaggacacaagatcaatgcagaaaaataaattgcatttctataacttaacaatgagcaatcaaaataaaaaattaaacatatgataatattaaaaatgccccaatggaaataaaatatttaggtataaatctaacaaaacatatataggacttacatgctgaaaaaagaaaatgctgatgaaagaaatacaaaggaatctaaataattagagaagcgtactgtgtagatggattgtaagactcaacacagtaaaaatattcctgtgaaattcatctacatgtttaaggccaaccagcacaaagatagagcattaaacaaccaaaactaaggatgaccctcacagagtccatttcaccccctgccacctccactggatggaggaataaggatgaggaatagaaggaaacttctatgaaaaacacacacctaacatc

SEQ ID NO: 626350 - DNA, 338 bp, Homo sapiens
cccttgtgatagtgtgaagtggctgtgtccccacacaaatctcatcttgaattctcacactgttgtgggagggacccagtgggaggtaattgaatcatgagggcaagtctttcccgtgctgttctcataatagtgaataagtctcacaagatctgatggttttataaagaggaggttccctgcacaagttctctccttttgcctgccgccatccatgacttgctcccccttgccttctgccatggttgtgaggcctcctcagccatgcagaactgtaaatccattaaacctctttttcatcccagtctcggttatgtatttatcagcaacatgaaaat

SEQ ID NO: 626351 - DNA, 107 bp, Homo sapiens
gaggttttgaacggaaagagtgtttccacactgtgaggagaggactggagggctacaatagtaatgtttaatcttgatatgcaccagaaggtccagtgtggagagag

SEQ ID NO: 626352 - DNA, 368 bp, Homo sapiens
  misc_feature (28)..(28): n is a, c, g, or t
tcggcacgagaagagagagagatttccnccccttctctcttttttctcttctttgggtcttttttatccttattcctcttctaccccccttgtttttcctttccttctatctactctatcattttatcatcacctctctcaccttttaacatacttcacatttgcctcttatgattatataatttttctcttttactactctcccttatattactcaaaccatatatatttcttttttttttacatttccataccatatttcatccatctactttcatcttcttttaacttctctctaatacatctcttataatcttttctatcttcttcctcccacattatcacaatttttctttcccttcttttcg

SEQ ID NO: 626353 - DNA, 601 bp, Homo sapiens
taggagtgctgagcccgggaaaccgagccatgactgaggctgatgtgaatccaaaggctacccccttgcgatgcccacctcaccaagaagctaatggacctcgtcagcagtcatgtacctataagcagcttcggaaaggagccaatgaggccaccaaaaccctcaagaggggcatctctgagtccatcgtgattggctgcagacgccgagcccattggagatcattctgcacctgccggttgctgtgtgacgaccaagaatgtgccctacgtgttagtgcgctccaagcagggccctggggagagcctgagtggggtctccaggccttgtcatcgcctgttctggtcaccatcaaagaaggctcgcagcttgaaacagcagatccaatccaattcagcagtccatttgaaagggctctaagtctaaacctgtttgcctcttgcaacgggtgctccctgccagtttcccccccctgtgagggtggggtggcctcatatccactcgtgtgttgaagcccatggatagattactttcccagccctaacctcctctaattgttactaacactcgtaggttcttacccagacacaaaacgcacaaa

SEQ ID NO: 626354 - DNA, 337 bp, Homo sapiens
  misc_feature (152)..(152): n is a, c, g, or t
cgaaaccaataacggatcaaagtgtctcagctaatttgaagagtacagaattaaaaagtgggagttgtaaaggggttaaacatccttagaaagtgaccatcccaatgattcacttgtagtactaaaaaataataaagaacaacagccatgcnaattctacataacaatagaataacaagcctagagttcccactatggtgccgtgagttaagaatccaactgcagagtctgaggtcactgtggaggcacatgttcaatctccagcctggcagagtgggtcaaaaggatctggtgtgttgtggcaactgcgtaattaggtgtgcgggatcctcaatgt

SEQ ID NO: 626355 - DNA, 888 bp, Homo sapiens
catgcgcttgccgccttgccacgtagtctatcgtcctaggcccagggcgctgccgacacagctcccgctcccccggcccctctttgactctccgccacgggcctccgggactcaggctcccgcctcccgattagaggccgaggaggagagattcccacgccaccgaagggtcctccgggctgccccccggcttcctgagggtccgaaggtgagctccagcccctcgggcccggtgtggatcctccccgcccccgtgccccgaacctcggcctcccccgggccccgtgccccggctggagcgccacccctttggtccgccgcgcccgagacccctgggagtcccccacctggcatctcccttcctgagtttctgaagctgatttgtcgcttgcgaaatttctcggttcttcctctgagcctccgaggtcccccctgcacaccccggggtgtgctctggtctcctgtccggccccgactcttctgtgtggcgccgcccgggagccccccttatgcgcgaggctgctccgcgttgccctgcccccggcctgcgtggctggggccgagtccccggggccccaccgcgagggcacccatctcctgtcaacaggctcgcgagaggtcacggagagccgagccccccccctgactttggagagaaaagtgggtttgctttttttaagggatcctatatttagtcctatatatccaacctctaactgacctttcttttcgaggaaatggcttggtgggttgccgcccccccccgttcccttgacgctggcaccctctgttgattttttaaacccccagctatgatggataaactgaattattttctacccatactgaaccttaggaccacaccaaattaaaaaccaaaaccccgac

SEQ ID NO: 626356 - DNA, 120 bp, Homo sapiens
ggacaactctaccttcttgtccaatgtacaaggagtagtctaaaaaaaatgcatattaatttctgccccaaagccggattctaaatctctgtacaacaacaatttcaggacccaaagggg

SEQ ID NO: 626357 - DNA, 574 bp, Homo sapiens
aggcggatacgatattttggattttgtgggcacaaggcctgacacaatgtgttatgatggtgcagctctggatcctgaaaaattcatgatgctctggactgacgctgcttcttatggtcaggacccgggttgaaatgtccagagactattcatcactgataatggattgtgtgcgacctttccatctggaaagctttcactgtttttctagagcttactcctgctaaaagcatgcaggtcatcccagaactaccactggcaataaagttattcgtgtcctgcaggtaggtgcagatggatgtttaattaacacaactataccagagcgccccatgggagttaacttgccaaatggccctatatggagaagtacaacaattcaacgtccgtggctttaaagttgcagaatggaaaactccttagttcacaaaataatttgcttgcaagaaaccgctttctcctagcttgagaacagctgaactgcccacacccattcgcgctttccataacaaaggctcaacttggttgccgaagggaaattggttggtttaatatattctatagaaaacaggtt

SEQ ID NO: 626358 - DNA, 350 bp, Homo sapiens
gagcagagtattgctctgtcacacaggctggggtgcagtggtgtagtctctgctaactgcaacctccaccttctgggttcaagtgattctcctgcctcggcctcccaagtagctgggattacaggtgcataccaccatgacgggctaatttttgtattttcagtagagacagtttcatcatgttggcgaggctggtcttgaactcctgatccgcccacctcaacctccaaaagtgctgggattacaggtgtgagcgactgtgcctggccccaacatgtcttttctcccatcacgcttcttcttcctttagcctagaagcttgccaccttacacccttctgtcgtcttctc

SEQ ID NO: 626359 - DNA, 898 bp, Homo sapiens
  misc_feature (44)..(44): n is a, c, g, or t
  misc_feature (85)..(85): n is a, c, g, or t
  misc_feature (101)..(101): n is a, c, g, or t
  misc_feature (324)..(325): n is a, c, g, or t
  misc_feature (333)..(335): n is a, c, g, or t
  misc_feature (338)..(338): n is a, c, g, or t
  misc_feature (340)..(342): n is a, c, g, or t
  misc_feature (385)..(385): n is a, c, g, or t
  misc_feature (388)..(388): n is a, c, g, or t
  misc_feature (398)..(398): n is a, c, g, or t
  misc_feature (400)..(400): n is a, c, g, or t
  misc_feature (466)..(466): n is a, c, g, or t
  misc_feature (469)..(470): n is a, c, g, or t
  misc_feature (511)..(511): n is a, c, g, or t
  misc_feature (528)..(528): n is a, c, g, or t
  misc_feature (589)..(589): n is a, c, g, or t
  misc_feature (601)..(601): n is a, c, g, or t
ttttttacaacccatccttcttttacctttccttcattcccttnctcccgcctccgctcttcagcatcttttctctttttaaacnattccatgctccttcnaaccctttccctttttttacttctccctccattatctccccccactcccagtccatcccaccccttcttacctttcccctctctcccattctattcctacttttattattttcaccttatttatatcttttcccacttcctctctcacctttccaaccactactacctcatctccaattccttccacttcattcattttctttcctacctcttcaactcagtnntgaacgtnnnctncnnnccagcctattatctttttcttcttaccttcctccattctttcnccnacatccactncnagaacttcaataccacttttttctttaaatattaacattccttttatatcagccagaattacaaanagnntaattacatcatttaactcaaccacattatcaaatacaacntcttttacttacccccnctccccctactcatttttctccatcccttcctttcctccatttatctccactttcttcccnccaccctaatantctctttaccctcatatccccttcatattacttatctatctcctttatatatattttatttcattcacttttaccttttttttataacataatttttactactccccctcacctccttcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataata

SEQ ID NO: 626360 - DNA, 204 bp, Homo sapiens
cttagacgtagcgccaccaccgcatgcgtctcagtgtacttctcttctcttttcttctcacaggcgcagaggagggctctcgggtgcaggagctcaggcatggcgtctcagagtctgctctggggctctcagatgtcgtcttttcaggggctcaggcttgggaggtggtgctggggccttagggggtgggtggagagcgggggt

SEQ ID NO: 626361 - DNA, 1109 bp, Homo sapiens
tatccggttcagtctaattcgcttttgtgggtagtcacttcataggccagaacttagggctaggagtgatgattaaataagagggagtgacattaactatttaggggacaggttagtggttggatagggcctcagggataggggataaagggggggacaattctctatagaactcaaatataattaagaagaggataatatagccctacataagaaagaaatttttagggggaaaagagggaccgcggggcggggagaaataatggggtccgtaagcgcgccaactgcatagaggggggggcatttttctcatagtgttagccgcggtggaaaggtggggggggtagttcgaaagaggtggtaaataactataatatagcatagttagagggcataggagaggggtggtgggatatattttaagagagggggattcatagtgactcggggtgtggagagagaaacagaagagcgacaacgctgcaagagggggccaccaaggggggctcaaattagcgcgtgggttatcccgggggagcccacaaagcttttatccgtgtgtccccaaagaggggggcaaaaaaactcgtggcgcgagagttcgctccccaataaataggtgaaagacgcggatattctacatttccccgaaaatagagcctccaagggtggtcacacccgtggctctctaaggaacccccgcggaacaaaaagggacacaaacggaaagagaaccgcccccagccacgcgacaaccccaccaacgaaggaaacaacaggcagccaacagagcaggggaccacaacgacagcaacaaaagaggacgacgccacaccacagtacgcggcacacaacaaaaaaagagacgaaatcaaacaccaagaccccccgggaaaaaaagaaagaagggaacacaaaacgcacaagcaccacgaagcacacccaagccacacgcacaatgaaaaacagagacagaacacagcgacagaaacgaccaacaaataggagaccacaagagaggccaaccaacggcaaccagacaacacagcgagaagcgaccaaccatactagtggcaccccaccagaagcacaggctcacctgaacacaa

SEQ ID NO: 626362 - DNA, 108 bp, Homo sapiens
gcgaacagacgagctactagacagctaaagagcacaccgtctatttagcaaatagtggagatttataggtagaggcgacacacctaccgagcctggtgatagctggtt

SEQ ID NO: 626363 - DNA, 110 bp, Homo sapiens
ctagaggatccgtactgttatcccaacactgacatttagacaattttgcatggactctgaattcctgcagggctatatttggatactgtaaaaaaaaacaaaagtaatag

SEQ ID NO: 626364 - DNA, 834 bp, Homo sapiens
  misc_feature (11)..(11): n is a, c, g, or t
  misc_feature (121)..(121): n is a, c, g, or t
  misc_feature (130)..(130): n is a, c, g, or t
  misc_feature (161)..(162): n is a, c, g, or t
  misc_feature (200)..(200): n is a, c, g, or t
  misc_feature (207)..(207): n is a, c, g, or t
  misc_feature (222)..(222): n is a, c, g, or t
  misc_feature (247)..(247): n is a, c, g, or t
  misc_feature (256)..(256): n is a, c, g, or t
  misc_feature (269)..(269): n is a, c, g, or t
  misc_feature (284)..(284): n is a, c, g, or t
  misc_feature (287)..(287): n is a, c, g, or t
  misc_feature (296)..(296): n is a, c, g, or t
  misc_feature (300)..(300): n is a, c, g, or t
  misc_feature (302)..(302): n is a, c, g, or t
  misc_feature (311)..(311): n is a, c, g, or t
  misc_feature (314)..(314): n is a, c, g, or t
  misc_feature (327)..(327): n is a, c, g, or t
  misc_feature (357)..(358): n is a, c, g, or t
  misc_feature (372)..(372): n is a, c, g, or t
  misc_feature (397)..(397): n is a, c, g, or t
  misc_feature (436)..(436): n is a, c, g, or t
  misc_feature (443)..(443): n is a, c, g, or t
  misc_feature (451)..(451): n is a, c, g, or t
  misc_feature (478)..(478): n is a, c, g, or t
  misc_feature (487)..(487): n is a, c, g, or t
  misc_feature (490)..(490): n is a, c, g, or t
  misc_feature (495)..(495): n is a, c, g, or t
  misc_feature (544)..(545): n is a, c, g, or t
  misc_feature (554)..(554): n is a, c, g, or t
  misc_feature (564)..(564): n is a, c, g, or t
  misc_feature (568)..(568): n is a, c, g, or t
  misc_feature (570)..(570): n is a, c, g, or t
  misc_feature (587)..(587): n is a, c, g, or t
  misc_feature (591)..(591): n is a, c, g, or t
  misc_feature (596)..(596): n is a, c, g, or t
  misc_feature (618)..(618): n is a, c, g, or t
  misc_feature (644)..(644): n is a, c, g, or t
  misc_feature (707)..(707): n is a, c, g, or t
  misc_feature (780)..(780): n is a, c, g, or t
  misc_feature (793)..(793): n is a, c, g, or t
  misc_feature (826)..(826): n is a, c, g, or t
gcagcaagagntgcagcatattgattacaggtttaggtgcatcctgcagaacggccggtctttattggcaccttcaaggcttttaacaagaacatgaatttgatcctctgtaactttgatnagttcaganagttcaagccaaagaactccaaacaagcagnnagggaaaaaaagcgagtcctcgttctggggctgctgcnagggganaatctgttctcaatnacagaagagggacctcctcccaaanaaactgttnttgctcgagttcnacttgctggagctgncgngggcccagngatngncagcgctgntgncagaggaatcccngctgggttcccatgccccaggctcctgcannacttgctgggccantccgtggggttggcgggccatcccnacaggtgatgaccccacaaggaagaggtactgttgcagncgctgcngctgctgncacagccagtattgccggggctccaanccagtaccnccntggcngtgggggtcctcccccacctttgggccgaggagcaccccctccaggctnnatgggcccncctcctggtntgangnctcctatgggtcccccnatgnggatnccccctggaagagggactccantgggcatgcccctccgggaatgcggnctcctccccctgggatgcgaggccttctttgacccttggccacagagtatggaagtagtccgnagaggcgtgggctcgattcctcagggccacgttaccacagacctgtttgtttcttatgctgttgttcgtggantctcatgggattntctggtttcccttacagggcccctcccccgggnatgcgccc

SEQ ID NO: 626365 - DNA, 278 bp, Homo sapiens
gaaattttaggccaggccctttttaaagccccaaccgggggaaaccgggggccttttttaaaaatgccggaaattaaatcctttgaaaatttttttttggggggagacccccaggtgtgggggggggccgccctcccaacctaccttttgttggaagccccttcctttttttttactggtttcccccccctatggttttttcccaaaaggaagggttttgggcccccgggtttaccttttttttttttttttttttaaaattaacctttcggggggga

SEQ ID NO: 626366 - DNA, 101 bp, Homo sapiens
ctcgacaagctggctgccgccgtacagcagaaaggctatgcctgcgtctgcctgttctggtactggagcaagcacctggtcaagtgcgagatcgccctggg

SEQ ID NO: 626367 - DNA, 157 bp, Homo sapiens
ggttatccgcaaagtaatgccgtcggaagatggtgaaggagactcgaagtactctgaggcttgtaggagggtagaatagagacccagtaaaattgtaatgagcagtgcttgaaattatttggtttcggttgtcttctattagacttggccttatgag

SEQ ID NO: 626368 - DNA, 280 bp, Homo sapiens
gcggggccccatacatggcctgcgtgcgtgcgtggctcgtggccctctacgcgtcccggcggcggctgtgaggaggaagcgctagggcggtcgtggcggaggagtgagagacggagcgacggccgagaccgtagacgccgctcggccgctgtacttacttccccggttcagcatgggcaaaggtttcctagcaaggtgcagcgtcgagacggtatgccatatacgcttgatgaactcctagctgggctgtacagttgccgcggactgaccgctcttctag

SEQ ID NO: 626369 - DNA, 1464 bp, Homo sapiens
  misc_feature (58)..(58): n is a, c, g, or t
  misc_feature (260)..(260): n is a, c, g, or t
  misc_feature (267)..(267): n is a, c, g, or t
  misc_feature (610)..(610): n is a, c, g, or t
gctcaaggacaggtgccggggagcccctgtacaagctcttctaaggccagtccaaacnatccaggtgtgcaataagggcccggtgggatgcgggtacagacagagaggcccaagatacaacatctctaacagacgacggggtctgctgagcgggagtgatgtggaatacgcaccctctgaacggctgagcggtgatcgctgcagagtacgatgggagctgggacagccaatcccggtgaaagggtccatctaactggtgnacaccantgctcctgcagagtccaaggaggaagactcgagttgaccgagggtggtaccgtggggcagtgccctggctcctgtctggccacatggactcacatcatgcgttaggctccctgggatgctgtgcgttcccgaggcgtgcccacacggcaggcatggagtcctggtcagggcagcgctaggaaaccgtggagccgtcagcaaggccgtgggaagggcggccggtgtgaaagccgtcggtcagaccaccgctatgatagcgacttgacaaatcgtaccgggtgatagcgatgcccaacgcgtacgatcgctggtgacgagagggttggtgaggtcgtgcacctangcgatgcgcggagaaggggacgagagccaaaggcaaggacccttgccctagggcgaagcgccaattgcccttccttagggaagggcacggatgaacaccgggtggtggcaacctgagtgccggccagaaccgacagagagttggaacgagggcaaagtccaagacgaggccacgcgtgaacagagaaggaagcggaccgaaaggccatcaccgaggatctaacctgaacgcggctgctctcagtgcaaggggcaacactagcgagacagattggtggaacaacgttcttaccagaagcgtggctggtgcttgggccacgccggtgcaccctgcaagtacaagtacttcttcgacttcccttggacgaccaggccaaagaatgcgcaacatcacgggatgaagacacccattcacaattttgggaagaacgacacaggggttaccgggaccgggtccgggggggaaacattcccaaagaaaaccccagttacactatgtacagatgcattcccccagggggggacagccccgggcaagaaatgcgcgagcgcaagggtgcatacaagcgccagagcaaaacagcagcagatcccaacaaacgggtgcgcaggaagccccccaccaataggtcaataataaagaaccaccaacagaggaacagcaacacaacagtacaacaagaagcaaagtagccggccacaagacaaaaaagagtaggagcaacatcagccgcgtagattctgcacgtagcgtcggtgactgtctacgtgttgagagaatacatagcacaaacgaaaacaaacacagagcaaccaacaagacaacacacagcaacaccgaagcaacgacaccat

SEQ ID NO: 626370 - DNA, 165 bp, Homo sapiens
tatgcatttagactaggtccccactaaatactgaaatatcagaggctctgtgctcattaccctattaataaacagcccttatctatctctcaattgttattcttttcttttttcaagcgttcttttctttctttttctttttgctttttcctttctcttttttct

SEQ ID NO: 626371 - DNA, 439 bp, Homo sapiens
ttggcttggcccgtttgctgagctggctgtcgtggtcacatgcatggaagacaagaacagctgccccaactgctcaacttccaaacaagttccaccagctcagctgaagccaacaaaaaaccatctgcccaacaaagaggcaaggagcctatggacatccctggcaccctcagtccctgcccccaaccccctcacagaaagcatgtggtaaggactgctgacgtgaactcagttctccagacaccaagcttcagacaaatcctggggaatggcctcagggctaggagcagtcaggcttaagaggcagggccacctaaacgtctgctgagaacacagggtgccccctgctgccctgctcctgagagtgtctagaagtgcccatgacgtgagcccaggagtttgtggccagcctggacaacatagtgacacccctgtatcc

SEQ ID NO: 626372 - DNA, 770 bp, Homo sapiens
caatgtttagaacattttattaaagtacaaaattgttggaatgtagtctaatagaccggctagtggtcattctgcaccacgtactgtcaagtcccccctctcctccccccccatcgccccccccccccagccggcccccccgctcccgtccctccctcgtgtccatcgatcgcacacaaccaacacccatccctctcctgatcatctgcagccatccacctgtcccaacaccaacctcctatcaaagcatatgcacatcccccgcgcgcaacccatcgacacctctcaaccccctcctcctccatccgctcaccccatccaaccatacacccaacactccccaccccctcaccgccttcaccggctaatcactcacaaccccaccactctacccacccgcgtccccccctcacaaccccctcctcacttacctatcacatgactatccatccccatccttccacccctactccccgatttccacctccccctccctcaacctcaaacctcacctactccatcacttaacccacagaacacctccctccctccccattccaatccaccctcaacccaccacacccaccaaccagacaaccaaccccccaaacaataaaaaaatctgatccgtacttatcctcctccttcatgctctgataccgttcaccgtccactgctcatcaactccctgtctcctccacacgtgtagttgcctagcttccaactcacatcattgtcctctccccatacccacctcaaatacgccgtgc

SEQ ID NO: 626373 - DNA, 446 bp, Homo sapiens
aaaaattagctgagtggggccaggcacagtggctcacgtctgtggtcccgacactttgggaggctgaggcgggcggatcatgaggtcaggagttcaagaccagcctggccggcgtggcgaagccccatctctactaaaaatacaaaaattagcggggcatggtggtgcgtgcctgtggtcccggctactcggggggctgaggcgggagaattgcttggacccaggaggtggaggttgcagtgagccaagaccgcaccactgcactccagcctggggacagagcgagactccgtctaaaaaaaaaaaaaaagctgagtttggtggcgtgggcctctggtcccagctacttgggaggatctcttgaggccggaaggtcgaggctgccatgagctgtgatggagccactgtattccagtctgagcaacagggcaagatcctgtttccaa

SEQ ID NO: 626374 - DNA, 178 bp, Homo sapiens
atcacgctcggcccattctcggcccccaaatagctagcaccacaggtgtgtccaccatgcctggccaatttgggaggccgaggcatgagaattgcttgagccctgcagctggaggttgtggtgagtcgagattgtatcactacattccagcctgggctgcacagtgagactctgtctc

SEQ ID NO: 626375 - DNA, 763 bp, Homo sapiens
cgaccaagggcctccttgaggatggaaggcaatggtggagggaagaggatcagaaaaaataaccattgtgtactaggcctagctacctggtgtgataaaataatctgtacaacaaagctcccgctgaaatgatttgaattatataacaaaacttggcgacatgtacccctggaacctagaaataagaaggtgtacaattaccagaaagtaaccacaacttaatattagttaaaagtgattaaatataacttgcttcttctctttcgcaagattcttaatgcatcacactcaatttagggaagcctggcaggcatcttagaatggcagacaataaggccttttacttgttgcaatgtaagatatacttatgttaaggtgttagatgaccccatagatataactaatctaatagatgacagatattacatcacgagtatgagtttaatagagacattgattaccaattatgatgctagtctagccaagaaaccttcagagatatacacaattataatgcacacgtaaacagtaataatggagtgggcaagagatagtatcatgtataacacttaagtacaacaacgcaaatgcaggcagtgactatgctagctatcaggaatatagaaacagcgagtactgtcaggagaaaataaacacaattaccagagtacttagaacatttccagagctcaaaaatgttctgtacataagggccacatcttagccaagaaagatattagcagatcctacacgtacatgtacc

SEQ ID NO: 626376 - DNA, 318 bp, Homo sapiens
gaaaaagaagtttgacattcagaaacttatcaagaggttctactctttggatagagaccaaaatcatactttgaaaaaatgagaagagatggaagccaaggaagggtgtgtggaatcaagtagcagttctcaaaacagcatatatcaagacctcagcacatatcaagacctcagcacatatcaagacagtggcacaaaagcatcgtagtgttgtcattcaccactatgcaggagggaaagccaatttcatttcagaatgtcctcaattaatctgtagaaattattaattttattaaatcccaacccttgaaaaaaaaa

SEQ ID NO: 626377 - DNA, 165 bp, Homo sapiens
agcgctgagcattcacatggaggtgatgggggttcttagagagaagatcactgaagaaacttctggctttaatgggctttacaaagctgggcaatattacaatcctgtgacctcagtggaaagcagtcatcttcgagcattttccaagccctaatagccacccca

SEQ ID NO: 626378 - DNA, 370 bp, Homo sapiens
cagatatcactgatcactcgtgattccgaccgtcatcgacccataggcagagtgcatgtaagctggacttcatgttccctcaaagactctcccgttgcttacggctgaggactctgggctgctggaatcggactctcatgacttttgactgccattttgtttgttcagtggagactcctatttgtttactcagtatccagtatctacttcttccttactagcagaacgctaggcaatatgcattggataaactatacatagaattaaatacaactgcatataacagtaatccccaataacaattccttatatagtatataagttaataattattaaaaaatcagcttcgtttcacattttttacagaatt

SEQ ID NO: 626379 - DNA, 151 bp, Homo sapiens
gacacacaggtgaggtgatacgcattgcttcgtacttatgtaatgaaaaatttttttaatcttcgccttaatacttttttatttgtggtattttgaatgatgagccttcgtgcccccccttcccccttttttgtccctcaccttgtctctt

SEQ ID NO: 626380 - DNA, 1057 bp, Homo sapiens
ttaaccaggcggtcccctagctgcgcagtcgctggcgtgccttcgtgctgggtggaacctgggtttccacgcgccggatgaactgcccgcgtgcgtcaacgtggagggcgagacgcaccaccagtgtggtgcaaatggatcaaggctgtggaggggcagactctggctgctggtggtggaccaggagacagatgatggagctccgccgtgcggcaagctgacctgttacctgatggagatgtgcccagcgagggctcctcacctcggtccacgacccctgggatgccgaatgccagactggggcacacaccggtagctcacagctccaaagctggcaagataggatgtcagtgggcccctgagggagctgcgccctcggctctggcaactgcgaaagggacctcagggcttatgggttcaacctgcatagtgacaagtcccggcccggccagtacattcgctctgtggacccgggctctagctgccgcccgctctggcctccgggcccaggacctggctcattgaggtgaacgggtcagaatgtgggagggactgcgccatgctgaggtggtggccagcatcaaggcacgggaggacgagtgcccggctgctggtcgtggagccctgagacagatgaacacttcaagcggcttcagggtacagaccaccgaggagcacgttggaaggtctctgacgtcaccgtcaccaaatggaaccagcctgcccagttcagtggtggtcatggtgtcgtccgaagtgacatgctggtacgacaggacctgagatggaggtactggtaagaaggatccttcaggagagggctcaattgaccaatgagcgatgcatggtgaagttagcagtgagttaaaggtggcaaaatgataatgaagattgagatgaaaattgagaatatgtgaaaattgggtgttgagaagtgggataaactgagggatgggaaattgaagaaactaagataatagagagagaaaagaaaagaaaaagtagataagtaatatagaggaaaaaaagagaaaaaaatggaggaaaagattgtgat

SEQ ID NO: 626381 - DNA, 330 bp, Homo sapiens
caggcacataccagggagacccaactaattagttgtatataaaggaaagactagggtcatatatccatgtagcccagactgatctcgaactacctggagctacaagtagatctgcctgacctcagcactcccaaagatgctagagattacagagcataagccaccgaagcccagactgagttacatactctacacatactttcatgtatactaattaagtgttcttgtatttcacgcttgacagaactccctattagtatttctagaaaaggcaggtctagtcgttgatgagcctcctcagctttagttcatcaagaatatctttatatt

SEQ ID NO: 626382 - DNA, 124 bp, Homo sapiens
ggggggggggggggggggggggggttttttttaactttttcctttttttttgggggggggggggcccccccctttttacaagggggtggggttttttttttaaaaaaaaaaattttttttttta

SEQ ID NO: 626383 - DNA, 138 bp, Homo sapiens
tttcaaattacctgagacttctgatcataattgacagccagttcttctatggcctgtaaaacttctttcagttcttctttagaggcctcattggctgacttcaaggcgattccgctcagcttgcatattgtcttgatc

SEQ ID NO: 626384 - DNA, 179 bp, Homo sapiens
agcattgaagagaaaatcttagatatgcaaaaaaataaagccgaacttgctcaatctatcctaagcgccgaccacgaaggcgatatcaagctgagtgaagatgagctgctagggttgtttgacaagtttttatgatattaacactattatcattcagttttaaaacagtattacattag

SEQ ID NO: 626385 - DNA, 241 bp, Homo sapiens
gcccgagcaaaaagccaaacaggagcgggagaaagaactggcaaaagtccctatcaaaaaggaagatttggagctaataatgactgagatggagatatttcgagcagcagcagaacgcagtttgcgggaacacatgggcaacgtggtaaaggcgcttattgccctaaccaactgatgggtgctttttcaaaataaacctactgggattaatttatggccaataaaatttttttttgtttta

SEQ ID NO: 626386 - DNA, 109 bp, Homo sapiens
  misc_feature (29)..(29): n is a, c, g, or t
cgctgggaatatttatttatttatttggnctattaacaccaagatctgcaaaaaacaacctctaaacactcgataagaaaactcgtacattaacattcttcaattttgt

SEQ ID NO: 626387 - DNA, 111 bp, Homo sapiens
cgggtgatccacgctttgtctagtgattgttcatatagagcagttggaccactattgtgtgttgctcaatcattgactgtagtcccaaacacagccttgtgacccgacgtt

SEQ ID NO: 626388 - DNA, 318 bp, Homo sapiens
ggtaacccatgttttcctagaaacagggaagagtcatgaccaactttcacattgtctgctttgttcttggggtatcatccattgtgattaccattcccaagaagtttctctcccaaaacaggattacttcttttcctacccttgattcaagtgacctttcattacaggtatatctgtgtgtttatatgggacatctatgtatgggtctggcactcacgctgtatatggagacacatgcacattgggttcagtgatttgtccaccactgtcacacagctctctagagtagcgcgtgctcatatactcagtagagtatat

SEQ ID NO: 626389 - DNA, 81 bp, Homo sapiens
attcacttttgaaagaacatgttaccttaccttttgttttagaagttttcaagtattaaaatattttttagaaaaaaaaaa

SEQ ID NO: 626390 - DNA, 397 bp, Homo sapiens
  misc_feature (45)..(45): n is a, c, g, or t
  misc_feature (165)..(165): n is a, c, g, or t
  misc_feature (183)..(183): n is a, c, g, or t
  misc_feature (186)..(187): n is a, c, g, or t
  misc_feature (206)..(207): n is a, c, g, or t
  misc_feature (221)..(221): n is a, c, g, or t
  misc_feature (223)..(223): n is a, c, g, or t
  misc_feature (240)..(240): n is a, c, g, or t
  misc_feature (247)..(247): n is a, c, g, or t
  misc_feature (257)..(257): n is a, c, g, or t
  misc_feature (263)..(263): n is a, c, g, or t
  misc_feature (265)..(266): n is a, c, g, or t
  misc_feature (301)..(301): n is a, c, g, or t
  misc_feature (329)..(329): n is a, c, g, or t
  misc_feature (339)..(339): n is a, c, g, or t
  misc_feature (355)..(355): n is a, c, g, or t
  misc_feature (372)..(372): n is a, c, g, or t
  misc_feature (377)..(378): n is a, c, g, or t
agtgcattcgctgtgataatgggtccagttgtatgcttataattngtgtagttttcagcatgttttacttctctagagatgtttatagtaaaaaaaattaacatcttactattcacttcttgtgttcattgtagtttagaaagaataagaaacaatggttctgcngtgttgttgatgttatgnggnnaactgtttttaacgtttanngggagaaataaatntncagctgctaaaactaanttctganatcatttggncctctngnngggaggtcaacaccggcatcatgtagcactagcgncggggtgtcactactcagcaccaatcanccggaaatcncattttcttcctaccngtgtttctgtctgttgntcctnncttctttaattacactagg

SEQ ID NO: 626391 - DNA, 921 bp, Homo sapiens
  misc_feature (46)..(46): n is a, c, g, or t
  misc_feature (74)..(74): n is a, c, g, or t
ccctgctcaccctccgctaattcttactaaaaatgatataatatgnatgtgtattctattatgcacatgcgggnaaatggcaaggagaaaaaaaaacaatgctaaaaagcctagagatgaccacatatgaaacgaccatgtgtgtaaaggattgctggaaaataaatcacagatggcctggattctgccatgttaatcaaagaagagagggcctacctcagctgcctagcctggatcacctggaccccattacgatacaggatcataaacacctctattttcccttctaagagacaccagaaccacttggacttattccacctgcatcatacatgcgtgcgatcagcctgcactcattctttccctgtctatcccctttgataacacttctccttcccatctaccaccattaaagctattcactctgtctattgccactcatgttacacacctacccctctcctcccttacttttactcccctccccttcccattccttccattaccccatacatattagtctaacttcctaactctccccccactcttccccaactacattcggcactcgcacctacatctgccctcccgccctccgccggcttcactcgacactctcctctccctccccatctcccactcttcctcaatcgcccctttccctcccattcttttctccttcttgttatcttcgacaccctcgtcacctttctccgcatccttgcacctcgttctgtgtcccctctcctcactccctcctcctcatcatctttatatctctcgcctatcattcgcacttctcatatttatacttactctttccttatctctgaggtctatatcctttatcaacgcatttccccactccctcatgtcaccttccatgcacatctattcacctctatccgcacacctctcctg

SEQ ID NO: 626392 - DNA, 150 bp, Homo sapiens
tgctgctgatgactttagcagtgaggatgagacagagctggcatgcgccagtctgaggagaacgacatccatgggctccgcaaggtcatatgatagacaccaatatcacacgacagcagcaggaggaatagcagcaggaggaatgccgcg

SEQ ID NO: 626393 - DNA, 1060 bp, Homo sapiens
agcggggcgtggcggtggcccgggttgtagccgccgcgctgccgccgcccccgccgccgccacctcagaagcaggaaccgaagtcgtctgcctgcctgccgccactgcctggtgtcttctggtctggggccctgcagccatggaggatttcatctgtgatctcggacgacagcggctctgagagctccgggggctgcccgccctgtgggcccggtcgctggagtgccgcgcctgggcccttgtctgcgaacctccggcgctgcttgcccccgccggaaccgtggactttcattgactttaacctaggaagagaccaggaccaagggacataaagatcgccagttggactgatatgtcgattgacccttgaccaaggagccttgagggggagaacaatacgaacctaattggccaactctatgcaactttaaacttttagaaagcacgtagtcaacatccctttcccaggagacggaaggccagagccaatgttcttttcaagacacaatttgttgccaagcgctttcttacttgagccaaagcgcgggctggacttgggcaacagggtgcccaccggatttgtcaccaagtgacaggcattcatcaaggctctatatctatgccctacgtgggaagatcaaaattcctatttatatgccatgttgaattccgcttgagttacgaaatttcgtcgaggaacacctacggtttgggcacgagaacaagacacacccgttatcggctaacggtgttacccccacacaaggacccggcgagtcgttagaaacaattttccacaaatttccaaaggcttcgaggaaagggtgccactccatgggtagcattaacagttcaccatagaacgctacgtagagaccacatcaaagttattggtttccggcctttcatagagacgccacacaagaattttacagcagacaggtggttaacaagctcgcatttctaatggagctattacaatatcggggggtcaacaccgggttctctaacagtacagggacagtatggatcctatatccgcagggcaacgttaggaata

SEQ ID NO: 626394 - DNA, 987 bp, Homo sapiens
  misc_feature (63)..(63): n is a, c, g, or t
  misc_feature (363)..(363): n is a, c, g, or t
  misc_feature (645)..(645): n is a, c, g, or t
  misc_feature (667)..(667): n is a, c, g, or t
  misc_feature (736)..(736): n is a, c, g, or t
  misc_feature (825)..(825): n is a, c, g, or t
  misc_feature (927)..(927): n is a, c, g, or t
cccggcccgccgcgccccccggggagaggagacgcgaagaaggagaaacaagaaccatatatngagcacagggaaggagaacaaatgcgcgtgacacgcggcgcgagcgtggcagggggcagcgagctacgcgagcggacagaggagacgagctacagtagatgggaggatatggcgtgtactaaagtaactcatagggggcgaggtaagtgaatcgatccgaccaccgtgccgccgcgccgtgacacgccggcacgcacaacacgacgcactaacagcacacgtctgctcagcccccggaggaacgactcgccggcggcggacgaacgaactcaagaacctcaaacacacaatcatacacanaaacgagagaggagtagacagaggaacgcgaaacgacgagcgcgcgacactatatctctcacaccaattgtctaccccggcgcctccccacccaattatacttattccaagcgcacattgagcagtgtttgtcttattatatgaccaactgtcacatctagtcgcatcagaacccgatcacctagcctacgtatacatacttaatctagctacatacttttctacttactacagactctccactagcgctcataacgaacggtgcatacacatacacatacntacatctcctccacgttcgttntgtatgctatattatctttgttgttgtaatcgcaagtatcaatatacttaattagtattcaactaaatnatattattaagattagaaaggatagagaaatgagatgaattgaagatttagtagtataagtgacatagaagagtggcgaagaaagtgtnatatatgatagattagaataagtgttagattatttttataactgttagtcctaatcttattttctgtatacacaaccatctctgtgcggcactctgtctatncaatcacaacgaataacaatatcaatcattgcaatactcactacctatagatgtgagtat

SEQ ID NO: 626395 - DNA, 761 bp, Homo sapiens
  misc_feature (28)..(28): n is a, c, g, or t
  misc_feature (30)..(30): n is a, c, g, or t
  misc_feature (67)..(67): n is a, c, g, or t
  misc_feature (91)..(91): n is a, c, g, or t
  misc_feature (166)..(166): n is a, c, g, or t
  misc_feature (170)..(170): n is a, c, g, or t
  misc_feature (189)..(189): n is a, c, g, or t
aagctcaaaccattaataaaggcagtgnanaatgaggactttgacgaccagctggaaatggtgtgtntgatagatccaggctgtttcgggnatattgatgagctcatccgctgtgagaccaaaggaaagggaactcttgatgtgctcagtctcaaagatgtggagnaagnggatgagaaactcgaatanacacttcatttattttcacctgctttctttaacacattaaactactgctgatttattttatatgggctgctcgactgttggagtttgaatgtggccaaactattagcagctactgcatcagtatttcaatacattgttaataatagactctaaaatagtaataaaatccacattttattttctgtgaaaatggaatacatatttattttgattaataacagaagtcaaaatatgatattctgcaagagtgcatctttattattaatattattattttgctttcttttaaatctgaggtgccgaattcccattttcaagcagggttttgttaatctacgaagaaagtagaaaataatttaaaagttttaattgtctaatctgatgccagagaaactttatcttgtcacagttaagactccctttacattcactatttgtagtatttaaataaataagcatcaacctctatataaacctctataaactgtgattctgcttagactgaaggtgaaattcgttgttctttggtttaacactaaaataaataacattgttctgcgttctaaaaaaaa

SEQ ID NO: 626396 - DNA, 393 bp, Homo sapiens
tgcattgcaacacggaggatgagagggagagtctggctgtggtgcagaatgctcagcagccctcccagcaggcacatggaagactgggacaggaagaggggagaagcattcaagttcaggccaaaggaccaacgcagcacagcacactgaggtcacaccatgtgagatgtggaagagaattcctgagcgtggagcgatggggttaggtgcccggatgatagcccattcagcttctgtcaaactcttgactaaggatttctggttgccttttattccattaacagccagggaggttctatcacggtgagcacgcttccctgacgccgcctcctgtagcgcagccccgcgagactgtggaggttcccatatgactgtaggcctctggggccagga

SEQ ID NO: 626397 - DNA, 348 bp, Homo sapiens
  misc_feature (319)..(319): n is a, c, g, or t
  misc_feature (342)..(342): n is a, c, g, or t
gaggaacaggctggtcttgaactcctgtccataagccatctaccctctttggccttccaaagatctaggattacagtcatgagccaccatgcgcaggctgcctgcgtgtacaacgttaaacatgcaacataagaatcagcgcgtcctctaggacaagcatcgtaactgagggtcgtaaattggacgtatgggtgaggagaccacatcctgtttttgcaagtttgtgaattgatttgcaaacgtggttcttcctggagcctcatcacatcttaaccacccatgtgtatgtttctgaattcactgtcttctatgcagctgngtccagacatatgagagggacanaccagt

SEQ ID NO: 626398 - DNA, 361 bp, Homo sapiens
tgcttgcctcttagtagatctagaggatcccgcgcgttgtaagagctacttcaccaccaggacttatgggcgagccgagtctgacggtccgtccaggtgtgttccgggatacacgtgacttcattcccagcatgctgacgctcactcatcaccaggtgcatgatgacgatcttttgtcttcttctgaagaggagtgcaaggatagggaacgccccatgtacggccgggacagtgcctaccagagcatcacgcactagcgccctgttgcagcctccaggagctccctggacctgtcctattatcctacttcctcctccacctcttttatgtcctcctcatcatcttcctcttcaccggccat

SEQ ID NO: 626399 - DNA, 1904 bp, Homo sapiens
tgaatcggcacacggatccgtatctggggtcacgaatgaacggagaccagaattcatatgtctctgcccaacaaaagcaggatttcgttgcagcacttctcccagatcgctaacgcggtgactgcacatgatgggactgacgatggtggtcacccagagcactaggagatgctattgcccggcctcacaggagcgtccatggaagatacaaaatgccacttgacaggccaagtataatccggggattatgcacgagcatagagcatagatagacacttccagagtaagacatagaatgcgacaacccaagcacacaacagaggattgctgaaatagatctcacaggaagaagaccatgagaacatgaaaagaacctgacatgctgatgaaatactatgcatagcacacaagatattaatccttatcaccttgtgcacggacaaagaactagatcaagtacagatgccaagtccccaaatcccagcatattacacacccggtccagctgaaagacacatagaaatctttgccccttgcgggtcagtaacatgaaataaagccacctggtagccaagacatgcggaacataatccggacaatatagaccacaatacacaaagctagtacatatgacaatataaaatcacacttcaacacatgtggataacattcgtcataatgcataaactttcagttcagacaaccacagatacccagttcggtacatttggacaacaaattcccgttacattaacataatagcatccagagtgaggtaaagaccaaatgaacacgccgattacattatataacacccattgagatcaaccccactttggaaaatcacacagcaaaaacctatcgttaatcacaaatagtcagagagcaaaaatgtcacgcacaatatatttacacatcaacaaccatagcaacgaaaaaattctagggatagcaacagataacaccccccattagtgcgacacaccgtatacgccattcccaagctaacagcacaccaccacacactacaaagcgtgacaacacattcgtgattgtcgccaaatcaattataggagaccacagacaaagatatccacacacgtgacataagctcaataacatgcgactagcaatacaccaataaatctttatcactattagggaatcatatacacggataaccttcagtaggcacacacaaggacaatatattaccataaagctatacacaacctttgatcataagcaccatatcacagataaataagacacaagagcacagatcaccccacatgcgctacaaacagttggatgcaaaagagcgaacgaacttaatgcactttgctgacccatacagtcgatcaagcgacatcaacaaacgccgcagacacatggatccaccaacaaatacgcatacaattcacctgagcccttggacaacacactaccagcgcgaacagatcatcatgaaaacaagacttgacacacgagatcgaaacttacgaccctctgtaaaacccacacgttatggacattagaaacgcccaccagatgatgtgtaaacacgtaaacacacaaatatggaacactttgaaacacacttaccatagatacaaccaacaactaccatcacagttgcttcgtatgtgactacatacagatctagccacacagcagcaacacctacacgataacaatacatcaatgcatcatggacaggtcaaaacataaccgacgacacacacactgagacgaaacacaaaagtccaacggctagaaagtcacaactatttccagaatgaatatcatacagacaaaagaatgataatcaatcgatacgagcacagtatacgtcaatcattagctcacttatactaacaccacactcacgcccccacacagcg

SEQ ID NO: 626400 - DNA, 208 bp, Homo sapiens
  misc_feature (16)..(16): n is a, c, g, or t
  misc_feature (93)..(93): n is a, c, g, or t
ggtctcaatcaaacantagagcttctaagaagttaagggggctgggcacagtggctcacgcctgcgtctcgaactcctgacctcagatgatcnaccctccttggcctcccaaagtgctgggattgcaggcgtgcacacgcctggccaccattttactctcgtcatgtacagtaatctaatatccaaagtcttggactcagctaaagag

SEQ ID NO: 626401 - DNA, 438 bp, Homo sapiens
cgaccttgccctggagacacatggggacaggcatcctgtgaaaatgagttactctaaatatacttacatacggacatctattgaggagatctagactagggaaactggtgtttaaggtggaatagctcagctagaaatttccagatttcacctcggtgatgacgtggcacaccttgcccaaaagccgagtgcatcttttccatgtcaaacttcatcttggatcttcctggagtgctacgcatcttttcccacactgtagttacttctttaagaccgggagtactttcttcataatcgagcttcaggcgcttgttccgccaatcatattcagaggcttggagcttctgattttccttctccattctaagcagccgtatctgttgaagaatagccttttgacacagctctcggagctcacgagatgtccttttcttttcc

SEQ ID NO: 626402 - DNA, 489 bp, Homo sapiens
  misc_feature (50)..(50): n is a, c, g, or t
  misc_feature (93)..(93): n is a, c, g, or t
  misc_feature (111)..(111): n is a, c, g, or t
  misc_feature (113)..(113): n is a, c, g, or t
  misc_feature (144)..(144): n is a, c, g, or t
  misc_feature (160)..(160): n is a, c, g, or t
  misc_feature (172)..(172): n is a, c, g, or t
  misc_feature (182)..(182): n is a, c, g, or t
  misc_feature (212)..(212): n is a, c, g, or t
  misc_feature (248)..(248): n is a, c, g, or t
  misc_feature (258)..(258): n is a, c, g, or t
  misc_feature (266)..(266): n is a, c, g, or t
  misc_feature (292)..(292): n is a, c, g, or t
  misc_feature (344)..(344): n is a, c, g, or t
  misc_feature (351)..(351): n is a, c, g, or t
  misc_feature (359)..(359): n is a, c, g, or t
  misc_feature (472)..(472): n is a, c, g, or t
ccatgtagaaaaaaaaaaatacacaaaactaatagaatacaggatgatanaacacagcctaagagcaataaacaaaagatagaatagggaatnaaagagaaatagaagaananaaagcccgagaaaaaatccattctctttctntttctttctttctctntctctcttttcnttcttttttntgagacagggtctcactctgttgcccaggntggagtgaagtgacgcaatcatggctcactgaagcntccacctgcnaggatcangtaagtctcctaccttagcctcctgngtagtgaggactacaggcatgtgccaccacacctggatttttgttttgtaanttttttnttttaganatgagttctctctatgttgtccaggctggtcttgaactccggggctcaagtgatgtgcccaccttggcctccacaaagtgctgggattatacaccctctttttctaattggcnaatttcaacttattttt

SEQ ID NO: 626403 - DNA, 1095 bp, Homo sapiens
  misc_feature (379)..(379): n is a, c, g, or t
ggagacccggaggaccgaagcttccggacgatgaggaaccgtccaacatggtctcggagagtgggaatgctctggtgagtggcgcggatttgtgtggtgcatgtggatgcgccatcatgtgagaagttcaaagtcgttccatttgcactacggatctcggtcatcctttgtggagtgtggatgttcagggctagctaaagcctacagcaggggcctggacgaagggcaagggcttcgctcatcacaagggtcctgaaggatgtgatcgcatggagtatcatccagtggacctatgaccaatggatggctgaaggagtgaggcccaagggcaagcttcaaattgaactccaatgatgaggacattccagcagatgacaantgatgcgccgcgctgaacggagctcagttggtgcaacggcagggaaggtgtacacggtgacggatgccggaattgaccaggtggtcacagacctcaggctgtggatgcggcagacctgctccacgtctctcgtgggcatcctctgggagctcattaggaccatggtggatcgggcagaggcggaactgtgatgtactcgttcccggggtacacccatttggagagggcccagcccatccgcatggagccactggattctgaagacatgccgagggcacttgacccgagactctgagcggatgctggaggtgcggaagcggatcaatgtcctgcccctggggagtggggccaatgcagggctatcacagggtgtggggcgaagagctgcacgaccgaactcaacttggggccataaatctcaacagatgggggcccacacgagagcgaccatcgggtgccaactatcgggcagggggtgcccgtgaagtaccaaattcaacagagggggcagaaaaacatacctcggggcccgcgacactacctcggacgaccaaaggtcaaaacaggagagactgtgccccaaaaacccgaacaagaggcagaccacaggggactgtcgtgccgagcgccacaagtcacaagagacagcctacaacgtaccacgaacgacttgacgaagagcaagccgaaggggaaaaagataagccacacaatca

SEQ ID NO: 626404 - DNA, 333 bp, Homo sapiens
actacatacttccgactgaaactcttatcactataaaggattttacaggctgggcatggtggctaatgcctgtgatcccagcattttgggaggccaaggagggtggatcacctatggtcaggagtttgagaccatcctggccaacatggcaaaaccctatctctactgaaaaaaaaaaattccaaaatttagcagggcgttggggggcgcccttgtagccccagttactagggaggctgaggcaggaaaatcgtttgaccccaggaggcggaggttgcagtgagccgagatcatgccaccacactcaagcctgggcgacagagcgagactcct

SEQ ID NO: 626405 - DNA, 691 bp, Homo sapiens
acttcctcaacgacctgtgcgctgtcatgtggttcacctacctgctgctctacctgcactcgtgtgcgcgcctacatgctcccgctgtgcgctggtggctgctgctgctgctgggccaggtggcctgactgggctagtgcacacctgctctgtggtgctactgatgtgcctgacctgctgcctgccatgcttgctgcgccctgctactggccctgctgcaatggcctggcacctggtctggcacctgtctgctgtcctgctgtccttccccttcatcttcagcccctgccttgggctagtgtgtggtgctggccactgccctgagtgggcttgccctcctctactactgtgccctgttcatctgtgatcttccagtttgtgctgggcctccacacatgatctcccacctcagcctcatccctggagctctgtcaccaactgaccatgatgaatggtggatgctcactggcactcagtgtatgctgtcaccgtgagttggccaacaatcacctgtctacggctgccgcctggctcctgcttgcaccttgcagggggctcgtcgcgggtggatgcccacccaagacatcagcatcagcgaccagctggggggccagtgacgtgccctgtgttcctggaacctgtccctgctggtggtgggtgtcggcgccgtgtctcaactgtattcaccttg

SEQ ID NO: 626406 - DNA, 301 bp, Homo sapiens
gaacggtataggacatggtgggaatggggatgttgttacaaacaaatacagtgctcccctacaactggggtcctggggtgaacttggtctgcttcagcccaagaggaatcaaacagatcaaaagcagtttgggaaggccagaaccgtcaagcgatggagggagaaggaaaatccaggggggtggggggtctgtttggcaacctggggtggagggattgccctcccgcgtgctgtgatccccctctagtaccctcccgggtctggcaggaacggggggcaagccgtgaaagccccaatggga

SEQ ID NO: 626407 - DNA, 211 bp, Homo sapiens
ccatagaggatcccgtgatgttatcgcccaacacaacaaatgtgaaagtttcaggatctcggggactggcctggatagaaaactcatctctccagctatctagggtttttgcatgtgttgggggataacatcacggggtacccgagcctcgacattcgtaaatccattggtcataagcctgtatccctgtgttgaaaattgttatcccgct

SEQ ID NO: 626408 - DNA, 188 bp, Homo sapiens
ttggaacgatctctagcaggatccccaacacggcatcgcctgtttcctagtattaggctgatcaaattatcagtggaattcttggtttgatgattaccttattaattgaacattttttactgatgtgggcttctaaaagaaggtttcattttgtatactctttcagaactctctgtattttgatagaa

SEQ ID NO: 626409 - DNA, 448 bp, Homo sapiens
  misc_feature (312)..(312): n is a, c, g, or t
agttcgacggagactctctctggcggcaacagagcgagtctctgtctcaaaaaaaaaaaaaagaaagaaaaccagtaacatatttactggttggcggtatccagcaatatatttttaaagatatcaaattgggcggggattacaggcgtgagccaccactccgggccattagtgggagtcttcttatacgggggtgagacggaatcagccacagtggcacaacagaagggatgaagcttagaagtacggtggggtttaaagggccagtcccaggcggttacttttcccattggcaataccaataggacctanggtacctgaagattctaacaaaaactatgcaagaccggtatagaaaatttataaacctggatggaaagacttttaaaaattctaaataagagagataatacataatctactcttgggggatggagagtctccgtcg

SEQ ID NO: 626410 - DNA, 125 bp, Homo sapiens
agcggcttttagagttcccttctgaaaacatctgcctttggggtgaggttcatttaagaatgtccttgatgaagcagtaacaagttattaactgttattaaagcctcatatacagtcttttcaat

SEQ ID NO: 626411 - DNA, 261 bp, Homo sapiens
ttactcatgcgctctggggtcagggaaccagccgcactgttctccatttctagcgtgtgttgtagaccattcaaagtagggcatgcctgcgaagccggccaggtctttaaaacgtcttcgactctggacccacccgcagcaccatcttttgcagaggcccattcctacagccacccccggaaccctcccgcccctgcaggtgacagctcaggactgtgggcgcgggccattcaacgcctccgggcctattcaacgcctccg

SEQ ID NO: 626412 - DNA, 362 bp, Homo sapiens
aatgggtagtgaagatggttgtaggtcctaggtgattcctaatgcccaagacagagaggtcttgatcctcagaactgcatctcactgaggagagagactatagacaatataaccgagcttgaaagatacaaaatactggggctgggcatggtggctcatgcctgtaatcccagcactttgggaggccgaggcaggcagatcacttgaggtcaagggttcgagaccatcctgaccaacatggtaaaaccctgtctctactaaaaaatacaaaaataagctggtcatgatggtgcgtgcctattatcccagctactcgggaggctgaggcaggagaataacttgaacccagaaggcagaggttg

SEQ ID NO: 626413 - DNA, 389 bp, Homo sapiens
  misc_feature (1)..(1): n is a, c, g, or t
  misc_feature (40)..(40): n is a, c, g, or t
ntcgggcttgtgcttctccagtctcagccatttcacagcnccgcagagcacttggaactcaatgcctatgagtttcacagccagagagaagcccttgaccacgtaggcggtcacacaggttctgggtgcccgtttcacgaagcccgcaaagccagagctgggttgtctagagcacagctgctgggtgtaccccttcttgatgagctccaaggccccctgccgcttctctaggccgaccttctcccactgctccgtttcatccaggtaatgcacagctatgcccgtgggcgtcatcccgatcatgttctgttccccacagcccgagggggtcacaatgaggtgcctcacccgttccgcgtcggcggcatcctctgtcatctgggccactg

SEQ ID NO: 626414 - DNA, 217 bp, Homo sapiens
  misc_feature (203)..(203): n is a, c, g, or t
  misc_feature (209)..(209): n is a, c, g, or t
tctttcttgccttccttccctttcccttttttcctgactagccccaagtcccttcatttgcatttgctatgcaatagtccctctcctttcctttttcttccctcagatttagctgatccttcctccccccctggccttcctttcctctttcctcctccctctccccgtcataataccatctacacccgccctcaaaaaaaagnttaagnggaaaaaa

SEQ ID NO: 626415 - DNA, 228 bp, Homo sapiens
ccaaaaaaggggtaaacatgcccgggtgtcccccaggaggggggcaggggccctgcctttaaaccccggccccctccaggggacagttttttaaaagaggggccgggagcatttcccccctgttggggaggcaaagaccctgcaatggccccctttttaaaagggcagctggacaggggtaggttttttcaataaagtttttgtattaaaaaaggggccctgggttta

SEQ ID NO: 626416 - DNA, 224 bp, Homo sapiens
ccccatcaatgcacgtcacacacacactgtgatccgtattgcgcacattgaaccgcgcccgagccgcactcaaccaccctccaccggcctgaacctggagcggcatcgccgcattggcaaccacctcaacctccccctccaccaactcaatccccccctcacgccgactgatccgcgtccgggtattgagctccagccgaaccccctcacccaactccacccga

SEQ ID NO: 626417 - DNA, 1307 bp, Homo sapiens
cgtggctccacctgtgcgagctgtctgtccgtccagtgtggccgaactcagtgcacagaccccagtccagccactccaccccttcttcatgcacagctgcctttctataatccagtgcttgactcccttcttaccactgtatatctggacctactcccatgcactcaggctctggtattgagatcgtgctggggaggaacatggccactagcccttatcccatcggccatgtgggaggtatgaccatggtgcctggaaggttctccctctgaccctccactgggccacagtggctcagggacctgtgggcaactggagatggagctagctcttggtgatccttatgggtggaaaacgtgagtgccattctgtgtccccttggataaaacactcaccagatcacagaggctctctgtgtcctttgaataccactgccaccttcacaggactgtaccagcaggaataacacgtcgtacacaatcacgaaccattgtaccccatgtgcggagcacagaggtggccaaccaagatttgagacccattgaccccatacatcttggaatcatgaaagacttgatactacgcactaatcctcacagcgtgatagatcatatagaccacaaacagaccacacctatcaccattggtgtcacactctatcacgtggcaaaccccctatggataacacccaacgaagacacaataaacaacccgcattaatatgagaatatgatgttgggacacttagcacatatcactcgtcacaagaagtaggtatgaccacatatagatgattaggtagcagcacctgcaatatacccatagaagcactcacaaatacacaccgatggtggtcacttagcacacgcgtcatccaacattccacgcacccacgcctagcactattcagtagattatgactctctgctctattcgctactactagcatcgaccgaacattgagacatactagagaggcgaaggttctagtcgtctcacttgtcggtaacattgagctgatcatacgtacacgctgtgactatgcaaaccgatgccacctggcggcaactacacccctatcagccgatacacaacatcgatctcaggaaacacaatatcgactgtcctacgtcattccctaggtatcacgccatactattggctttcctaagtgcccaaagtactcccacagcgccgtgtatgagctccccctaatatgaactgtagtcatcgttctagaatactcctgcggagcaagacgaatggaaccacacctctcccaacccgctatccctaaatatacaaag

SEQ ID NO: 626418 - DNA, 490 bp, Homo sapiens
aagtgcttatttagtaccttttaccatttcaaatacttagactatctgaggccaagtgggagagattaagctttatgctgtaaacagttaaggattcaatttatcagcatttaacagttccacattattttccacctccaacatacatgattataccaatattaacacatcagcaataaaataaccataaaatgggaggcatgggtgaagaaggaattgtggtgaaaatatcttcatataaattataactataatctgtattatctattttgacagaaataattctcccactactatgccagaagttacgtatgatggtgctggatatttacagttatcagaagagtatctacttctatcttaactatagttgatggtagttttataattttgcatactttgtgcatgttccagtgaaaactccaaaaaaccataaagaatgtatctagaccatgggctttagtcatactttaaataaacctttaattta

SEQ ID NO: 626419 - DNA, 301 bp, Homo sapiens
agatacgaatcgagccggtaccggaagtacagacttctaggggataagaaacatcttaaggcaggcatggtggctcatgcctgtaatcccagcatttgggaggctgaggctggtagattccttgagctcaggaggtcaagaccagcctgggtaacatggaaaaccccatctctacaaaaattagctgggtgtggtggtgcatgcctatggtgtcagctagtcaggaggctgaggtgggaggattgcttgagcccatgaggtcgagactgcagtgagacatgatcatgccactgtactccaa

SEQ ID NO: 626420 - DNA, 236 bp, Homo sapiens
caggatcttattgctttgggacggcggatgacatactccgtcctgactcggtgagtggcacgggctcaggcgaggacttgaagaggggcccaagaccgcggaactctgtgcactgctgccaactgctcctggaagatctcctgcctggtagctgccactttctcaggctgtttgactgctgtgaggggggtactttctgttctctgctctgccatgggcgccgtcccaaagcacag

SEQ ID NO: 626421 - DNA, 375 bp, Homo sapiens
agctgggtgtggtggtacgcatctgtagtcccagctactagggaggctgaggtgggaggatcgcttgagcccagaaggtagaggctgcagtgagctgtgatcacactgctacaccccagcttgggaaatagcgcgagactgtctcgaaaaaaaaaaggaaaacactggacatggtaaaactaagcacagacatacacagaaacacacatcctgggtcattatgaacaacatagctctcggcgggatgtgtttaaaatcaggtaaagcgagtactttccacctatgaccatgtacccagagtctcccggtgctgcttgatcattctctatctcagccacctgccctttgcccgtggctccataaggctttaacttg

SEQ ID NO: 626422 - DNA, 179 bp, Homo sapiens
cggcacgaggcctatttgccaggctggtctcgaactcgtgaccttacgatccgcccgcctcggcctcacgcctgtaatcccagctctcagggaggctaagaggcgggaggatagcttgagcccaggagttcgagacctgcctgggcaatatagcgagaccccgttctccagaaaaagga

SEQ ID NO: 626423 - DNA, 402 bp, Homo sapiens
agaggatcccgctgatccgttagaaaaattgggtgatataattatacacataactgtacataaagctgattatcaaattaaaccataatgaagtctcacttcacacctgttagaatggtttttatcacaaagatgaaagataagtcttggccaagataaagaaagaaggagactcttgatacactgttgatgggaatgtaaattagtatagccattatggaaaatggtatggggaggttccttaaaaaactgaaaacaaaacaccacagaatccagcaatcccactactgtgtatatatgaaaaggcattgaaatcagtatgtcaaaggtatctctgtactctcacattcactacagcattattcacaataagccaagacatggcatccatgttaagtgtcc

SEQ ID NO: 626424 - DNA, 135 bp, Homo sapiens
tcactcatctgcagtgcagtatcaggcggcggctcaaagcttaagtgatgtttggatgtaaagtgaaatattagttggcggatgaagcagatcgtgaggaaagttgatgccacattatgacgctgaagtctcgtg

SEQ ID NO: 626425 - DNA, 1801 bp, Homo sapiens
cacggtctttattttggtctggtattacctctgggctgctaaccacccacgtgttaggacacttaccctgtagggcaccctcttactcgggaactgtcacctcgtcacttgcactagcaatatcgaacgtttgcttgtaactactatagcctggcttaactacggtctgtacaagcccaattctctactctgacacgttgtgacaacactgctacatctacgcggtttgccacgcacttacccacctttgctagcctattttactactacgcacgaacggtttcgtaacactcatattagactacacgaaaagtcggtatacacagcatctaacagacgggcactccgcttgtccaccctatattaacctactcctacaccctcatctgaacacgcaacacacttcacggttacacatcattttaacacacaacgcagacaacatagccttctatctccacgttggacatcggacaggtgtgcgcctactctggagcatacacttttccccccgactggcggagacgcttcgtacaaaacgcttgtacacttacgacctctggtggtatacagcaccccttcttaaccttgggactccgtacacaccataacaccttacacacggtatacacgcattctatgaccacgtatttgtaccttttaaacctatcactcaccggcattcaaaccgtgcattcttggtttcaacattctatctcccatagcataccgggtgacgccttaacttgggacctgagggggaccgacaagagcttacagcttcttgcgtccggcgagcatctcacacggcaaccttcatccaatcacatacatttcggtctcaccacgccctaacagccatgggcactcaacacccttgggacgtgtcacacagcaccgatggacaccaagctctacacacacactgcgtttataatcaccgcattcactccaccacagtcttccggggccaacaacacaactatgggggagctcagcacaacccccataccacactcacatttcacacagactcacacgaagcgtcaaacgagttcacacaacatctggccgcacacgacacacaccacagacaccatcaccccatcacagaacacagacactgaagccaaccagcaagaacacaacagcgaagccgaagaaccgaccaactagccgcaccaccatcgccagcacaaccgagttctcactacacacagcaccacccaacagagccagagcacaagcgcagcgaggaccccacacaccacgcgcctaccaacccaagcacacagcggcgcacacaccaaaccgtggcacacccccagagccagccgccgcctcggagagccacgtcaaaccaagcagacatgagagcaaactccacaccaccaccagacaaacaaccccccagggcgcgaccaacccacagaccagacctacatggcacacaaccacagacaacacgagcgacacaaacagagccgacaaacaacgagcggaaccaacacaccatcagcacgacccaccagaaccaccacgcacaacacacaaaccacgacacctcagaagagcacaaaagaaaaacacactgaccaagacgagacagaacacgacgcacccaagcagcagacaagacacgaacggacaagatcacacacaacgaacaaccacacacaagcatcaaccaagtaccagacgaagacgccagaacaccgacgaactagaccaagagacgaccaagaacacaccgaaccgaaaaacacgcaacgacagagcgaccccagccaagacccaccaa

SEQ ID NO: 626426 - DNA, 109 bp, Homo sapiens
gaagcgcacgatggcgcgccctagctgtaagttctccttgttttccaagcagctgtttggctttccagaagcccactttctgtctttaagaggtttaaagaaactacca

SEQ ID NO: 626427 - DNA, 616 bp, Homo sapiens
  misc_feature (346)..(346): n is a, c, g, or t
aggtcttagctccaaatgtttccttttataatgattagtagatatgtgtgttttcttattatctcctatttttccaacatcaaaagatagcgatattgtctgtgtaatgcacgtttggcacttaactgtgttcactggaaaatataccctggaaattattccatatcagttcatagaagtcgtcatcattcttttgtgtgtatgtacaccagttcattcatcttcttttctatgtttgtgtatccagatagtttctagcattttatagttatacagttctgcaattaataaccttgtgtcttttcatactgctggaggtgtatcttcaggataaatgtaggagtgnaattactaggtcgaagtggtaaatgcctatgtagttttgctagatgttaccaaattcccttccatagggtttgtactgttttgcattcccatcagcaatgtatgagagtgcctgttttcccacagccttaccaagtgagtctattgtcaagcttttgaatttttgccaatctgaagggcaaagaaatggtattttggctatagttagaatgtgcatttttcttattatgagtgaggtttaacatcctttcccgtctatcagtggccatct

SEQ ID NO: 626428 - DNA, 264 bp, Homo sapiens
gtgaactgctgaaaagaaccctgtctcgctatctcccatttcttccataagagaggctccatattctctctctcacactaatgtaacatatcccaaatggaaggacagaacatgctcattccccccacccaattctacaagtatctctctcttcttcagggagaagccagacagggaaagggagactagggaaggtcctttaaggcaaaaatgtggagtcctagaggtgtgtgtgtcagggcaggtgtctagcagcagtggcca

SEQ ID NO: 626429 - DNA, 742 bp, Homo sapiens
cgggtttcaccagtcgggccaggctggtctccaacaccggaccttgcgatctccgtccgccttggcctcccacaagtgcttggattacaggcgtgagccaaccgcgcctggccctgaaccacatttctaagtagcagatccaggttttagtgcagcttctgccgttaatctaggctaataaatcacatatccttggggccacacgttgccttataagtaaatgaagtagtttagtataaaatagataaatttccttatttttcccctggtggctgccctgtggaaatcagtttaggatacttgttttgtgagtaggaacctaggtgtgttacgtattacctgggtgttccacagctgatagcgaacttgccatgagataaagtcaagggcaaattacatcattctttactagggagatagaccgttacagcaatcaagatcatctttgtccatatccaggttagcatggtaagaggatttttttggagaaaaaaaatgattgatttagaaagttaatttgtaatgtccggaatggaataaaagactatatgagtagtgtaatcgtggtaggaaaagaggtgtgataatgttgtagaatttctcattctgtggacaacccaggggtaaactattattctcagtagtcagtacacttgttctagataaatcttgagtgaaaatccagcaatttctttttgccttgtggtctgattccgtgttctgaatccagataacccacccc

SEQ ID NO: 626430 - DNA, 396 bp, Homo sapiens
taataaaagggctaaaaaggaaaatcatgcttttcttccatcttcttactctgtacaaataaagaagttgcttgccgtctgagaagtttacccccgttgcttgttgttgtgcaggcctgtctacttgggcacccccaccgcctgttagctgtggttgtgcactgtcttttgtacctctggactggaggggtagatggggagtcaatcacccatcgcatggatatgaggcatttatcaggagtgttgccattttaatcagatgattttcttctggtcatcattaaaatacctgtctttagagagagtaaaatgggcccgcagccataggaatatctgtatgttggaggcctttaatgctacatttaaaaaaaagaaaataaagtaataatataactc

SEQ ID NO: 626431 - DNA, 125 bp, Homo sapiens
gcacgtctacaattcccaaaagacctcttactttgggaggccaaggtgggtgggtcacttgaacccaggagtttgacatcaacctgggcaacatggggacctcccgtttttctcggaataattat

SEQ ID NO: 626432 - DNA, 218 bp, Homo sapiens
aaaatttcaaagtggtagtacagaaaaacatttcccagtgtgattagtattatatataatagacagcctgggcaaaaagaacgaaactccgtttcaaaatgtatgtgtgtgtgtgtgtgtgtgtgtatatatatatatatgtgctcacacacacacattgcagttatatgagagtgtatgctatcctgggcatttttcccctcatccagcataacgcg

SEQ ID NO: 626433 - DNA, 881 bp, Homo sapiens
  misc_feature (690)..(690): n is a, c, g, or t
agcgggctcccggagatgccccgggggaggcgggcgcggggctcgaagagaaaaaggagttggaatagcggaatgccgcagtcctttccagcgtagaaagaccgactggaggtccagaagacgcaggtcgtcaggactagcaggggctagcatgctcgtctcgtctcatgaagcataggctcaggtggtgtaggtctgcagggtgttttctatgaacagctgtctgggcatttccggtcgtttagcgacgctggatagaggagctagcgatgggtattgagaatgcttgatgtgcgttgaacatatgggcctgatggaaccatggtctgaaaatgctttctcgtacatggatgcttcctggatgcgaatcgatagatggcatattagcggctttgatgtatatgtaaatgagctataagggccaaacttacatgtaggcattaacaggtaagatcatgaagaaatttaacatagggcaactgaatgagaggagcagggaacgatggtcaaatgtcgagagacgaaatgatgcactgatgtggtgtgaccgaaaataacaacaatggacgcacaaagcaatcattaatggtcgatggaatcaacaaaagactgatgaaatgaaagactagtgcttgtcatcccaaggtctatcaacaaatatgaactgtggaacgaaaacaacgcttaaanagacgggattgattatgtatattggtaaatggttttaatggcagtattcaactggggaaatccctgcatgggaagatggagcttagcgaaatcgactttcttaaagactttatcggaaatggatggatggaaatgaatgtatggtccaggattttcttaagggagaataagattgcggcatggggtagggc

SEQ ID NO: 626434 - DNA, 604 bp, Homo sapiens
cacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcaccatatggcgcgcacacacacacacacacacacaggctgagagacaaggtggagatccagggagaccccagggagcagtgcaggtgtccgtggattctgctttcagttaaacccctgatcacttcacctccctgagcctcagttaccttatctgaatatcgggatcatgacggataattgtatgtcatctattctaccgacggcagccagaggacgcctgtgagcacctgagtcagggcccatccctgctctgcctacagccctccatggctcccaccttcctatgcgtcaaagcccaagtcctccctgcagtccac

SEQ ID NO: 626435 - DNA, 143 bp, Homo sapiens
tggtcatgtggttggcaggggttttatatggataatggtggtgatgaaatggatggccccttaagatagaggagacacctgctaggtgtaaggagaagatggttaggtctacggaggctccagtgttggaatgtagttcccgt

SEQ ID NO: 626436 - DNA, 1060 bp, Homo sapiens
gctgcgcccgccgccggccccacccatccgggtcgaggaggccgaggccatggctgagagggaggagcggagcctggacaacttctttgccaagagggacaagaagaagaagaatggagcgggagcaacctgggcggctgagtgccgctgggcgcagcgggcagcgccggcggaaagcagtggagccgcgggtgcggctgggctggggggcgggcgcggggacccgggcgggggtgccgggcgggacctgccagcgcgggggggcttggcgggcccaggggggccgccaccaaaggcttgtgacgaaagggacggaagattgaatgggaaaggatttggagcaaaaaaggagggttgatttaccggcgggaccttcaaggggattccaggggccaatgtgcatatttaaggcaaggtggacaagagggcaaagaaacgacgaatagattggaaagaggaagacgaaggtattccaggggttgattaagctgggggaaaggaaaagtgtgggacggtgtgacgtggggcgagaggaggcgattattgggacacaaaacttcttttcaggggtgtccccggtgggcaatattaaaggaacatgcttcccaggttaccaaagacaaccttcccgtgggccgtcccaggataacttttggttacacaggaaaagcccgcagaagaaacgcgaggcgtgatttaaacatacagggtggggggggttgtaatatagggggccactcgctgggggggcgccaaggggtttaacccaaaaaatcaggagggagaaaagcagacaaagagaggggaaccacccagaggaaaactccttaccgcgttgattaacccgaagttctaccaatttcccctgtgcatgtacaagtttggcaagggcatttgtaagaaagaggccgagaaagaggggtacatttaaaaagtgaagtgctaaccctggggaataaattgaacaacatttttgggccactctaacattttaaactttgagggggacgtgaacttttttaaacatataattacagggggggaagacagtgttacaaaa

SEQ ID NO: 626437 - DNA, 853 bp, Homo sapiens
  misc_feature (347)..(347): n is a, c, g, or t
  misc_feature (384)..(384): n is a, c, g, or t
  misc_feature (386)..(387): n is a, c, g, or t
  misc_feature (411)..(411): n is a, c, g, or t
  misc_feature (425)..(425): n is a, c, g, or t
  misc_feature (430)..(430): n is a, c, g, or t
  misc_feature (437)..(437): n is a, c, g, or t
  misc_feature (451)..(451): n is a, c, g, or t
  misc_feature (468)..(468): n is a, c, g, or t
  misc_feature (480)..(480): n is a, c, g, or t
  misc_feature (485)..(485): n is a, c, g, or t
  misc_feature (488)..(488): n is a, c, g, or t
  misc_feature (494)..(495): n is a, c, g, or t
  misc_feature (497)..(497): n is a, c, g, or t
  misc_feature (504)..(504): n is a, c, g, or t
  misc_feature (507)..(507): n is a, c, g, or t
  misc_feature (516)..(516): n is a, c, g, or t
  misc_feature (523)..(523): n is a, c, g, or t
  misc_feature (533)..(533): n is a, c, g, or t
  misc_feature (535)..(536): n is a, c, g, or t
  misc_feature (538)..(538): n is a, c, g, or t
  misc_feature (540)..(540): n is a, c, g, or t
  misc_feature (547)..(547): n is a, c, g, or t
  misc_feature (554)..(554): n is a, c, g, or t
  misc_feature (572)..(572): n is a, c, g, or t
  misc_feature (597)..(597): n is a, c, g, or t
  misc_feature (669)..(669): n is a, c, g, or t
  misc_feature (674)..(674): n is a, c, g, or t
  misc_feature (681)..(681): n is a, c, g, or t
gtgctggcccagtcttatctgtgcctttactgcttgcgcatctcagatgctaacttggtctttttccagaagccttgtattggttaaaaattattttccattgcagaagcagctggactatgcaaaaagtatttctctgtcagttccccactctataccaaggatattattaaaactagaaatgactgcatgagagggagtgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttntttttttttttttttttttttggggtaccttctcatncnngtcaagtttggggtccattcttanaaccaggggaaatntgggnccccccnttggctgacgtagngctctcaggggctcacnggggcccaaggncacanccngggccnntntaggccnggntgttggccnggtccgngaaatgccgngnntncngttcctnacggggngatccagggcggggggtncaggagcattcctttccggggagtnatgaccgcgaagttgtcatgtgccggcccttttcggtccgggtatccaatggggggggactcggggtgacgngcctngggaaanatcagaaggggcgaggggggcccgggaccgtaacgggagatgtgtgctggcttaagcctggagaggtctccgctgactgccaggggggggggtctgcatagcaggatgacggctcatgcccagaaaccggggggggaatccgtcccgggtgccaaggggcttccatggtggg

SEQ ID NO: 626438 - DNA, 265 bp, Homo sapiens
ctgtctgtaagaattccatcgttgccagggagcagtggtgtatgcctgtaagtcccactcgcgcagtgaggcagaggcaggatcggattgagcgtgggagttccagtccatccgggggaatatagcgagaccttagtctcttgatcaaactgaaaagagaattccagtgtctactatcgagctcttgatttcccccttcaatcggttttgcccaggtgagttaaggatggaatcagagctaaacagctctttggtcgtgccgggg

SEQ ID NO: 626439 - DNA, 279 bp, Homo sapiens
ttgctgcctgtccaagacgacggtccatgaaagtccttgtagacggtcagatggcacattctcttatggagcgatgttgagtttgaggcattacagggatgtccagagacagacgtcttgaataggtagttcaaaacgtgcggctggagttgcagtgaaaggaagggaatggctggaaacacagttccttactttaccaggagccctgtgctgcgcgatgcatgggaggacatcaaggaacagtcctcaagttttcgtgagtcacacgggtaccgagct

SEQ ID NO: 626440 - DNA, 133 bp, Homo sapiens
tcaggtacacctagaccaaacctacgccacaatccatttcactatcatattcatcggagtaaatctaactttacttcccacaacactttctcgagctatccggaatgccccgacgttactcggacacaatccg

SEQ ID NO: 626441 - DNA, 410 bp, Homo sapiens
ctcgagtggagggccggtcgataactctctctctgtgtggcggccacactctggctcgaaaggaacctctcttgggctccatctggcaacttcacacctctctctaagagcgcattctctgtcaccgcgctccgcgcctgctggcggaaattcactgaggaagaacacaagatatgagacaaagactctccgagatgcgtgttagtggtcagcgctccctgtttttctctgttttctccaatcgtccgcgtgtgtgagaaagagcgcgcccgcccctccctctgtgtgtgagacaaacccatgggtctttctcttgaatccacctcttgcctccagtttgttctcctgaggcttccaagggaatatgcaaatggagaaaaacttttaaaaaaaatacaatagatccacaa

SEQ ID NO: 626442 - DNA, 110 bp, Homo sapiens
atcgtaatattagcagctctccacattgttcattctaatgcactaaatagaaaattaactacatactccaaataagaagcaagagatgatcacagtaggattcatgaaat

SEQ ID NO: 626443 - DNA, 1004 bp, Homo sapiens
gtccaggacccaaagcgggaggaaaggaaagcgtaaaggcaagaaaagctccatatcaggaagcgaacagggaaatattccagagtagaagttagaatcttcaaaagtccgttgcctgaatcagtgaagggattgatagagagagtatagtgacgtgcacaagggtttacgtgccaccgtccgagagaaagcgtcagctgcgcgaggtccgtaggatatcgagttctgcacttggtgcatgactgggcaactgtggttaacaagaccagagtagtgttctgtaacttccgtatgtcgctgagaggcacgagagcaagttgcttccgccggaagtagcatagaaacgcaggaaaggcacggtcagttggtggccagtggtcctgaggaggtggagttacagtagttcgcaacaaggatggattgagtgtagcagtgtggataatggagagagaaagaacgttggggaaggaggaggttggcgtgggccatgtacgttcgagagaactccagtctgctttctatagcataatgaagaagaaatgaaatttctggccagccatttgtaccttcctcatggattggtgtgtgtcgtaacagcagtcatcatccatgggtgacaataaatggttgggtttcaaacataagataacaagactcagataatgctgaacttaactgtgcagtgctacaaggtaaagtcgacttagatcaggccagtgtggatcttcaatgatatatcatgtaagcataagctttagaagtaaagcatttgggtttacagggcatcagatacatttgatagttcttaaaatagaaatttatgatgggttaaatctggcatgagtaggtataggtctaatacaaagtttaattaatattggaattggatggcaaaatataacgtaagaaatcttagaatggtgggacaatgggtaacagggattggggaaaaagactataaatagagtaagggaacataggagaagaaaaggaacgtggaaata

SEQ ID NO: 626444 - DNA, 390 bp, Homo sapiens
tagtatgcagtatagcgtagataaggtaaataatacaatacctagcggtcaaataccatacaaataatatctagtaataatcctataaagataaggatagactcattaagtagctagatagacgaacacctagctatagaagcatatcctgcacaaataatacatatttctatacaagggagacctacgacccccccatataaataatacaggatagccaccatactactaaccatacatagggataataataatactaactaaagtagtaaggatatactaatactagtacttaaataccaggactacctggcgaaaccggctaactaagtagaaaataactaaataggacaggcaacatacctaggccaaggcggaaaagagggcagg

SEQ ID NO: 626445 - DNA, 181 bp, Homo sapiens
ttgacgtacaggcatgcacctcagccctgctaatttttatatttttagtagggatggctttcaccatgctggccttaagtgatccgtccgccttggcctccaaagtgctgggatttcaggcaagcgtcaccacacccgacccctcactagtatttcagcatttgggtactacgctttggca

SEQ ID NO: 626446 - DNA, 552 bp, Homo sapiens
tgtaattcatgcctgcctgccttgccattggggcaggcagagagggaacctgctcactggccctggcagcagagcagggcgcaaacccacggacatcatgtgccatggcttcccagtgcgcctcccctcgaacgagtcgcctcatcgcttcagcccatgctgtgggcgttccatgtgctcatgccttgatgtcccacttcgccgctagggccttccagtgtccactacgcagctgccccactggagtgggccttcacgacatgcctcctggtggcgacgaatgcaagtatgccacttctcttctggtacaatctgcccgtttagaggcgagacacacggtcccttgtgcctgagagtttccatcattgcccccgtatcattgcttgggtcctcgccgaacacgggctgcatctcgcttcgccgtgtcccgtgctcacgttgcgccttgattctcggcgagtgaatgctcgctgccatcttgttgcatccgaccctttgcccacctgtctcttgacttgattgagatctgcgtcgtttcgtggactcgtgacc

SEQ ID NO: 626447 - DNA, 316 bp, Homo sapiens
tcgacgttgcgttaaaaaaaaatcgctggcgagtcatggttgctcagacgtggagtcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggagactgcagtgggccaagatcctactccagcctaggtgacagagtgagatcctatctcaaaaaaaagaagaaaa

SEQ ID NO: 626448 - DNA, 163 bp, Homo sapiens
ttagatcatgctactgccctccagcctgggcgacagagtgagattacgtctcaaaaacaaataaaaataactaaaaataaaaagattttttacacaaggctgaagtttgggttactttggctcatacaccttggccttcactgtagaaaggtggttagtaaag

SEQ ID NO: 626449 - DNA, 1006 bp, Homo sapiens
  misc_feature (24)..(24): n is a, c, g, or t
  misc_feature (26)..(26): n is a, c, g, or t
  misc_feature (29)..(29): n is a, c, g, or t
  misc_feature (31)..(33): n is a, c, g, or t
  misc_feature (698)..(698): n is a, c, g, or t
  misc_feature (730)..(730): n is a, c, g, or t
  misc_feature (918)..(918): n is a, c, g, or t
  misc_feature (993)..(993): n is a, c, g, or t
aatgctagaggaggctcggttatncngcncnnntgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttgggatccaccaccactcagctgtacacggaccgccacggagaagctgaggcctgagatggaggggcccggcagcttcaccatcttcgcccctagcaacgaggcctgggcctccttgccagctgaagtgctggactccctggtcagcaattgtcaacattgagctgctcaatgccctccggtaccatatggtgggcaggcgagtcctgactgatgagctgaaacacggcatgaccctcacctctatgtaccagaattccaacatccagatccaccactaatcntaatgggattgtaactgtgaactgtgcccggntgcttgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggncccgaccaatgaggccttcgagaagatccctagtgagactttgaaccgtatcctgggcgaccaaaagcctgaganactgctgaaaaca

SEQ ID NO: 626450 - DNA, 212 bp, Homo sapiens
  misc_feature (14)..(14): n is a, c, g, or t
  misc_feature (37)..(37): n is a, c, g, or t
  misc_feature (91)..(91): n is a, c, g, or t
  misc_feature (97)..(97): n is a, c, g, or t
  misc_feature (112)..(112): n is a, c, g, or t
  misc_feature (123)..(123): n is a, c, g, or t
  misc_feature (136)..(136): n is a, c, g, or t
  misc_feature (142)..(142): n is a, c, g, or t
  misc_feature (160)..(160): n is a, c, g, or t
  misc_feature (173)..(173): n is a, c, g, or t
  misc_feature (178)..(178): n is a, c, g, or t
  misc_feature (200)..(200): n is a, c, g, or t
  misc_feature (206)..(206): n is a, c, g, or t
aaaccacccccttncccttccattagcagaaactctnggggaactttgtgtctcagtcctagaatctccccaagtgagtggaagtgacatnatgcantcttcctcatggggnacctgaaagancttagtgtgggtncttcgntctaccttgtctgtcagngttgaatatctcnttccnctatcgatgctgcttctgaaanttcagntttcgg

SEQ ID NO: 626451 - DNA, 1298 bp, Homo sapiens
gcacgccatcatcggagcgcacggccagcttcgtgtgcaggcaggcagcacagttcgagatcaagctgaaggccaagcaggcccgggaactcccagtttgactttcgtgcgcttcggaccactacctcaaccccgtactataagcttcagtcgcagaaagcctatgtaaagagggacgctacacatgtccatggctagtaatagatcgaaagagtgacgagaaaacaaagaatcaggaggtcagcttctgacaatgaatgatgatgatgatgaagaagatgggaattaccttacatccctcgtctcttggccgtccaagaatgtgtgaaccgccttggaagagctgatggaagcccttgagaggtagtggacctcgagatcgatcacccgtcgtcgatgctagcttgattcggtataaggcacgaggcatgacgagtttccgacatcgcgcagccactcacaacaatcggcatgacgggttgcggccatgatgcatggaccctcacgcagggatgtgagtcacgacggcaggatcgtcgaccgttggcagaccattgtaattgacaggctagcttacatggctaccgggacgggcactgtacttgcgcttgggcggcccgacccgctctaccgcgtggaaatccgatcggtgaactaacttaactgacaagtcaagccctttctctgacttggactgtggacctcgggtgtcttaactacaccctgtgaggtgtacagagccaaatcggctcgtaacacaccctttcatggagaaccatatacgaccaagcagagccccccataaggccaccgggaactcaccatcaatccgagctcgatgcagaaaagcatagagaagcaataccaaccaacaaacaaggatgggccccagggccgcagtcatcgacattgcagggataccacatggtcaacactcccggcgagtattcaactagatcagagcaacacctttccccgcgggccgaggaggcgccagcgaggccgcaacacagcgcaacaccaccctaagccaaacttacccggcacactcacaacacacggcagcaccgccacacctagcctagaccaaagcaaaaggaggaacccaaagagagaggaccacaccccatccggagagcaacaacagggagcaaagacctgaacaccacgcccgcaacgaacacgacacaacacaaatcccccacagccagaccaccacgacacaacacgcgacaaactccatcaaaagacaagaagagacgacacaagcgcccacgacgacagaacacatgagcaca

SEQ ID NO: 626452 - DNA, 752 bp, Homo sapiens
  misc_feature (24)..(24): n is a, c, g, or t
  misc_feature (26)..(26): n is a, c, g, or t
  misc_feature (29)..(29): n is a, c, g, or t
  misc_feature (31)..(33): n is a, c, g, or t
aatgctagaggaggctcggttatncngcncnnntgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttgggatccaccaccactcagctgtacacggaccgccacggagaagctgaggcctgagatggaggggcccggcagcttcaccatcttcgcccctagcaacgaggcctgggcctccttgccagcttgtgaggatgacctccagtactagcccggggggactcttatggggaactgccttacttaccccgaggggtgcgcatgatgaactgggagtctgcagaacattatcatacgtggtttaaagaagcttactccattaaccccattagaacaggctgaggaacattgagctacaatatgtcttaacaggtagcgtctaaattgccccccggacccta

SEQ ID NO: 626453 - DNA, 461 bp, Homo sapiens
caagtgcctagaggacccattcttcgctcatatctctccaagaccacgacttcaaaagaggaagagcttgagatttctatcgctcatatactctccctgggacaaaagtatagtctctagtaaatgtctagtgacctttggctccgtagtgaggagagactgagcatacattactccacgctaacaaataattaatctatctatttgattagactttcagtgtggagtgcagagctttttcactaaaagtgctaataaagccagtcctcattaaaaatatagtcagatgagtcagcaaagctaatgttatttacaaaatctgaagaaatgagacaaaacaactttgagagtaatactataacctatgaaaatttggcagttagcaatagaaaaccttgtactttatcatctgtcccttaagcatggcctaccattgaggagagacctatgaccgacgaaat

SEQ ID NO: 626454 - DNA, 103 bp, Homo sapiens
aaggtggggttgagcatctcgtaagacatgtctagcctcgccatgtcacataaaactatgatcaaattagtccgggcgcggtagctcacgcctgtaatcccag

SEQ ID NO: 626455 - DNA, 793 bp, Homo sapiens
cgcgccatttgaatgggacccggcaattcggccattaatggccggaggcctaagagccgggctgtgggaggcaacagcctatactgttcatctaccggcatcaccataggcagtcagcgaagcagcaaccatgccctgagcgcaatccccatacagcgaaggccaggcgtggtgtacagatccgttaatgctctgttggtagctcctattgcctggaacacgtcatgcaggactgggggggagcatgccaactaacaaagactattgtggtgatgtgacgtatccttcctccccactcttcaccacacaccaacgcccgccgacgccccccccccctcgcccggacttaggaactcgcgggccacgggcatgtcgggagcgggcgagggggggttagtggaggctttttttccgcggagccacgtggtgcaggtgcttagtagtttgggttgaggaccaacaccgatccgttcacccccgattcgtcctgtcctcatatacttccattctatctaacttaataataatgatgtatttacttaatatgagattttatttgaacacatacgttactcaagctcacgattgaagacaggtgttataagcttattagactgtccgaagacggacgacacaaggacaattacataacctttacgtacacccctctccacgtctctccaccctacccaccccaatatgaactaatagtttgaaatatgtttatcacgtacatcaccatgaggatacccatcctctatcggtacaccgcaagaacgcactccctcagtaa

SEQ ID NO: 626456 - DNA, 633 bp, Homo sapiens
tggagatagagtctcactctgttccgcaggcacgagggcgggggcgccatctgtggctaactgaaatttccacctcccaggttcacgtgattcttctgcctcagggcagttgagtagctgggactgcaggcatgtgccaccacaccgggtcgatttggtatttaagtagagacggggtttctccacgtgggtcacgcgggtctcgaaactccgcgacctcgggtgatctgcctgcctcagtctcccgaagggcggggataataggcgtgatccaccaggcccagccgtaacatagaataaccttaaaattcaagttgcatgttgactcggataacattgggagagggaatctcgctcggtccccatagggtgagtgcaggggccacgatcacgggaccccgtgcaaccttccactcctccgggggtgtgagcctggaagatttggcggcccaggtgtgcaactgtcacaaggctccgggggggtgttggaacccccaagggggggccccaaaaggggggggctcttcccaacaaaaaagttccttcttcccaaaaaaaaaaacacacacatacacaacacaaaatggggggcgcccggagggggcacccacgggattgcggggaagagcataa

SEQ ID NO: 626457 - DNA, 1041 bp, Homo sapiens
gctggctccggcattcgcgggacaggcgttgtggtgccagagaaacagtagtcagagcggcgcagtggcggtcgcgtgctgtggttgttccgcgtattcccccagatccgcaccttctcgcgcctctttgcggacgaatcgtgaccaagatgtggaacagtggattcgaaagctatggcgagatcctcatacggggtgatgccggggcgtacacgcaaatccccggggggctttggatctgacctgcagcttcggtctcgccgatactggaagatcaggagcccgagcccagcgacattgtgccctgtatctatatctcagctgctttctgccactttggttgatgaacgtgttcagaattgggaatgctgagatttcacaggctcacatactcgtggggatcatcagacatgcaggagaagtcctccagaccaagatggtgcaacagaaactagatgacgctgacggactgtaacccatggatcgttcagccatgtagggttgagcacagatgacgaaccagcagtgaaaacactgtggttcctccagaaacatatcgtgaaaatgtggcaggccacctgagatcttttcagaactaaaaagagcctggtagctttacgatcgtgccgctggaggatatgaatgagttcaccagcatattctggaagtgatcaagtgcgcacatggtactatgcaaaggccagagcagccctcagcagggagagcacctatcagcaatccaggagtgagtgaagcatggaacttggtgggaaatagctccgagcaagcaatgggctcaactgtggcctcagaccaggtgttgaacttgagtaagggttgtccggactgaggtgcacgtcggattcagaacagcgtgaaacatgttggcactcacacagcaggggggtacggccggggccctttgttcggggaagacctatcccatcaatggaaggccggcatacacgccgcgcggtccccagtgcggaaggggacaccccttaactctttgacacaggacgtttttaatctttcttttcg

SEQ ID NO: 626458 - DNA, 546 bp, Homo sapiens
tcagatcctactcttcttgctgaaagcccttgaattggctaacattactttctttgggttctctgactttattggtccatttctttatggaattttttcttcttcttaaatgtggtggtttcctcaggttctgttcttggctcttcctttcttcttgctatttgtctactactccctgatgaatttcatttcctaggtcagttccgtaatttaatgacacttctctttcccactggccacacctttagcaccagctcttcacctgagctccaggattgtgtttagtggccttttagacatcatcatttagtatttaacagagtcatgaagcctccattgcagaccctagctcctggacaacatttctagacacaccctaggccagaagggaacccactgcattgaaggaaaggacccagtcctggcaggatcaatcacctgctgactaaagagcctttgagccctgaataaccagcagcagtacccaggtagcatatcatgggccttgggtgaccctctacgatgtgctggtttaggtgtgaccta

SEQ ID NO: 626459 - DNA, 478 bp, Homo sapiens
  misc_feature (9)..(9): n is a, c, g, or t
aaggatctncgacgagttgtccgagttacctggtcactgtaatactgggtctccattaaaatgtacatgctatggctaatttcacttgaagatgataccattgagcttctatagctatgaactatcaaatactagtttcaagtatgttactgtgcctatatcatatctggtctcaactgggtctgattctcaactcattgtcaatcacagttgatgccttctttgccttgcttctttggcttatttctgccttcatctcccacttctcacccaactctgccactgttcaggagcagatgactaaacttttatccttcctttaacttagtctttttatccttctgtttttagttcttacagtggtgatcacatgagtttggcgatctaagatgtctttatgaagggtcaaacgttttctatttggagctgaatcttttatttcatgtgaaaatctacatgtgtatacaagaaatgtatt

SEQ ID NO: 626460 - DNA, 178 bp, Homo sapiens
agcttgaagaatctccctagagcgagaaaacctctcaccgagactccatctaccaaataataaaaaaagaaaaaaaataattgtattcaaagactaaaatgtggggttaagggggggttggataaaaaaaaccccctgttgtggaatatttcacatggccaaaattgtcaccattaag

SEQ ID NO: 626461 - DNA, 374 bp, Homo sapiens
  misc_feature (155)..(155): n is a, c, g, or t
  misc_feature (165)..(165): n is a, c, g, or t
  misc_feature (176)..(176): n is a, c, g, or t
  misc_feature (182)..(182): n is a, c, g, or t
  misc_feature (205)..(205): n is a, c, g, or t
  misc_feature (213)..(214): n is a, c, g, or t
  misc_feature (236)..(236): n is a, c, g, or t
  misc_feature (315)..(315): n is a, c, g, or t
  misc_feature (331)..(331): n is a, c, g, or t
  misc_feature (363)..(363): n is a, c, g, or t
  misc_feature (368)..(368): n is a, c, g, or t
gtctgcctcccaaagcactgagactacaggagtgagccactgtgcccagcctactctggttttagtgcattcaagaggaacaaaaaaggaagaaaatcactagtaaatatacctctttctggttagagtggatgtttggaaattatatatatatnatataatacntatcccccatntacccnaccatgtacatacatgcacacanatatatgnntttttgattataggatagtatnccaaaactgagaaatattatggaattaacagaatttagtaaggcagataagtagtaggtagaaaaatattaattttatnttccagcaggaagcantgtgaaaaattagacaacaaggcaaacatttncattnaaaata

SEQ ID NO: 626462 - DNA, 133 bp, Homo sapiens
ctgaggacccccagatttacattaccaatgtgtagaaggtcagaaactagacttctagattaggttcaacatttgtagggttagttcttactagaccttcaaacgtattcaacgaaggtttggattggcagct

SEQ ID NO: 626463 - DNA, 490 bp, Homo sapiens
acctggatatccttgtcactattctagtctctatgtatctgtctaatgttgacagtggggtgttaaagttttgcattattattgcgtgtgagtctaagtctctttttaggtaactcaggacttgctttatgaatctgggtgctcctgtattgggtgcatatatatttaggatagttagctcttcttgttgaattgatccctttatcattatgtaatggccttctttgtctctttttttactttttggcttaaagtctattttatctaatataagtatagctactgctgcttgtttcagattctgtttgcatggaatatctttttctagtcctctattttctgtctatgtgcgtctttacaaagtaagtgagtttcttataggcagcatatagttgggtcttgtgtataactcattaagccagtgtatttttttaaattggaaattttaatccatttacattcaaggttattattgacaagtgaggtctac

SEQ ID NO: 626464 - DNA, 956 bp, Homo sapiens
ctgcgtggaacgcgctgaagtctgccagaacacatgtgggtcgcagaccgagcataggatgaccgcccggtgtggcagggtggctcgtggcaacacagagggacgcctgtgacacgacagtgtcgcgacagaacaagatgcgggggccccataaacatgacgtgggggcgggtgccgccgcccccacagcccgggtaaaacgacccggcaccatgtagccagaggcagcggcggtcccaaaaatggggcaacgaaccgggcgaaacaggagacgttggtgccgcatcggcaccccgccggagccatgcccgcttaaaaaacagggggatgttggaaagccgctgggtgggaacacgacgcggagaatggacagtcccacggaagccgacacccaccacgttttggcgcacacagggggggaatcgcacccgggggtcataaaagggggggaaccccccccgcagtgtgccgcaggtatgttggcaaacgagtcttccgctccctgggttccttccgaagaagggtctgtgggattacgtgtgcgagctcgcccctgacctgtgtcaaaggtggttggacaacccgggcgccagcattttgtgcgttggatctaccccgagagctttaggcgggacgcggtcgccagccctgggtaacgtttttcccaccaaagttcgggcagtgatggactaccccttcgagaagagaagaatctgcgcagttgtggcccccactaagacagttaatgtgtgggttatctcctccacaagagatccagacgcgagcggcacatccttcggcaagaatactggttgctgatgaacatcgtgaccctaggacacaacccattttaaacgacggggacaaattccctcatgaacaatactgcagcttcggagcgatttacagaggacgagggccgcaacaaaaaaaacaaaaaaataacccacaagaca

SEQ ID NO: 626465 - DNA, 92 bp, Homo sapiens
ggatttgctggtgcagtacaactaggcttaatagggacatgtccctattaattcaagcttctaacgttagaagcttgaattcgagcagtagt

SEQ ID NO: 626466 - DNA, 296 bp, Homo sapiens
tcggcacggaggcctgatctacaagtaccagcatcgttcttttgccagccagtgattttcttttaaatgaaaatgatgggatgagatgtaattttagatcgggaagagagtgtgtgtctaattcttttgagtatgcctgtgccatcagagaagagatcccaccccagtaggaaggtatggggcagtccagtttataactttgcaaccaaacccaagcctgctctttttgaagcagctgattggagagtaaagattttcattcaataaaagctaaacctcagggctccaaaaaaaag

SEQ ID NO: 626467 - DNA, 536 bp, Homo sapiens
  misc_feature (1)..(1): n is a, c, g, or t
  misc_feature (77)..(77): n is a, c, g, or t
  misc_feature (94)..(94): n is a, c, g, or t
  misc_feature (144)..(144): n is a, c, g, or t
  misc_feature (300)..(300): n is a, c, g, or t
  misc_feature (310)..(310): n is a, c, g, or t
  misc_feature (315)..(315): n is a, c, g, or t
  misc_feature (319)..(319): n is a, c, g, or t
  misc_feature (328)..(328): n is a, c, g, or t
  misc_feature (334)..(334): n is a, c, g, or t
  misc_feature (340)..(340): n is a, c, g, or t
nttttttttctttctgtataatgcctattcttgaaagctctgaatcatgggcaagaggctcagtggtatctggaggncagggcactggccactncagttaccatcttctgccaggtagcctgcccctcaggggtgaattctttnccgaaatggatttccaaaacggtcaccagcccatttcccaggagcttgaagttctcaggatccacatgcagcttgttacagttcagttcactcagctgggcaaaggtgcccttgatatcatccaggtgctttttggcttctcccaatggttttttnctccttcttnccatnttcnttgactttngggttncccatnttggctgatgcagaagacaggttgccaaagctgttaaagaacctctgggtccatgggtagacaaccaggagccttcccagggtttctcctccagcatcttccacattcaccttgccccaaaggcttgttatagttgccttgttctcctctgttaaatgacccatggcgtctggtcttggagcttattgataaactc

SEQ ID NO: 626468 - DNA, 308 bp, Homo sapiens
ggttctaaatgtgttgaggaatcagcaagtcaaattctacaaaagaaagagccttctggaatttcaattgaaatcatgctaaatatatagatcaatttggggagaactgatatctgaacaatattgagtcttccaatctatgagcatagtatatctccccatttcactaggccttattgaatttttccagcaacattttgtagtttccagtgtagaagtcttacacaatttttcctcaacatttatccccaagtatttcataacgttttgactgctatcgataaatctgtattgtatttcacgtttca

SEQ ID NO: 626469 - DNA, 433 bp, Homo sapiens
  misc_feature (145)..(145): n is a, c, g, or t
  misc_feature (168)..(168): n is a, c, g, or t
  misc_feature (177)..(177): n is a, c, g, or t
  misc_feature (186)..(186): n is a, c, g, or t
  misc_feature (204)..(205): n is a, c, g, or t
  misc_feature (217)..(217): n is a, c, g, or t
aattgacatcatcaaaattttagatatattcagtctatttctcaaaaactcaaagaatactaataaatgtgcactcaggtatatgtccacaaattgctgtaacattataattttaaacaatttaaaacacactaagtttccaaanttaacgtacaataaaaaaaaacntggctaatntaaactccnaaaaactttcccaaaccnnaaaaacaacacnaaaccccacccacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaa

SEQ ID NO: 626470 - DNA, 453 bp, Homo sapiens
  misc_feature (31)..(31): n is a, c, g, or t
  misc_feature (67)..(67): n is a, c, g, or t
  misc_feature (85)..(85): n is a, c, g, or t
  misc_feature (113)..(113): n is a, c, g, or t
  misc_feature (192)..(192): n is a, c, g, or t
tttccccccctctgtctccgtggtggttatnatactgcctttgaatccacacacaaaaattttaaanccagaaatattggagcanagtgaggggaaacacttgttgattttanccccggactgtgagtcacaagacctagaggtggagccctcagggatctgaagaaaaagggagtgatggcccaggtgtgngtgtcacgcctataatcccagcactttgggaggccgaggcgggcagatcatctgaggttgggagttcgagaccagcctgaccaacatggagaaaccccatctctactaaaaatacaaaattagctgagcatggtggcacatacatgtaatcccagctactcgggaggctgaggcgggagaatcgcttgaacccgggaggtgaaagttgtggtgagccaagattggccattgcactccagcctgggcagcaagatggacact

SEQ ID NO: 626471 - DNA, 325 bp, Homo sapiens
tcgggcggtaaccaagcggcgacgaaatagtgctggatcatcgcgagccacccatcctgcgcttggctcagatggtccgctttgccttccgggatcgctttgaaatcgatcttccggtacttcgtcgcttccgtatagatcgcgggacccgtatacgtatgtacgccgaaaacttgctgctcttcggcgggtttatcgtcacgcaagaagtgatagtacgtggtcagagggccgccaccgtcgatcccgtgacggacgtctatcaaataggagccacgcgcgaagcgcaaagtcttccgaaccgtgcgcccgtctgcagtcgaag

SEQ ID NO: 626472 - DNA, 119 bp, Homo sapiens
tcctgtgatgctttacatgccactggggtgctcctctcctgagactgaggcacacaggctggtgggccccgaatgccctatcccaaggcctcaccctgtccccccctgcgaacctatga

SEQ ID NO: 626473 - DNA, 344 bp, Homo sapiens
atacagagacatgccacagttaagcacgtacacgaatcccagcaggatgtaaccatcctcaatccagtaccataatgatgaacagacggacctcgaggacctgctcttaggttcagacagcgaaactcacgtgcaacactgaccggactgagagatgcctcaggtgtcagcttcaactggacgcccctcaagtgggaagagcgctgttcaaggaccaacttagcgttacctctgtggcttctaccgcgtgtccagtgtcctgccgggctgtgccgagccatgtaaccatgggaagaccttcaattgcactgcttgcctaccccgagtccatacttacctgggga

SEQ ID NO: 626474 - DNA, 216 bp, Homo sapiens
cctggcgtccatgagagcagacctacatgtacgacgtgccgccagtacagggtggggcggaaccacggtcttatggaccacctcgtcacggacgatctccaccgccggcttcatcgagttcgtcacgtcgcctaacaacccgtacgccctgatctgcgcatccgtcctctgcagctcggcggctagtcatcgtcgaccacgcgtattcctggccgt

SEQ ID NO: 626475 - DNA, 329 bp, Homo sapiens
tctttggcccccccaaagaccttcaaacagcagaaagttcggatggcaaatgagggcttcgaccccagccccctgtttgaccccctgtacgttttggaccaggctgtaggtgcctacctgcccctcccaactgcccggtacagggccctcctggcaggaaacctttgaattttagaacttccccccctgaggcccctgaaaaaggaactttgtggggtgggggccgttgcaggtgtactgggctgtcagggattttttttataccaaaactgcggtccctattttgtaataaatgtggctggagctgatccacctgtttttgcccccca

SEQ ID NO: 626476 - DNA, 404 bp, Homo sapiens
tcccttggggcctttggggcatggctcaagcttttggggctggttccatggttggggaagggccctttgctcaaaatttcccggggtctggggcccttttggtcctttgtaagcctttttcagtccccttttagcaaaggtttttgagcccctgttaggattcagccccgcccagggggggtattcaggtttttgtgattgcccccaggtttatttccctagattttctttaggggttgccggtttccccccaggcttttcattgttccagcccctgattaagctccagttttgtaatgttttgcctggaaagaaacaaaagccctttttcccctaaaggtagttggagggcatgctttttaacccctaaagttcagccaataaatgttacgttttagccccca

SEQ ID NO: 626477 - DNA, 876 bp, Homo sapiens
gagagtggacggtactagggttcggagtactgggctgcaggcatacattgagaatgagaactgtggacagcccagagtgcctcagatcaactccctatgaatcatgcattaggcttctcttcctcagtgctagttgactgtgataaatgtgcaaccaagatcaagcaaatgaagacctaatggaagatagtagatgcattgcggtgcttgatatgtcctagaataagcagggatgggtttattgcttgaataaactctgcttttggggttcatagcaaagttccatgatagatttggggattcgtattaggacattgggtggggtaaggtctgaagggttaaagatgttgattattgcaaggaaaccactctatgaaagatcgacaaacgaattgacttgatagcatctttcaggatctgaattattaatacacatagtatggattcatactgtgttcatcactctttgcatctgaagactgcttccttataacgtcgaggatatatggggaagagaaatgctagtagtatagaaagtaataatcagtcaattaaagggaatctgctaatttcgtgactttggtagtgctgggtcttaaagatctcattaaattcaacatagactgtttcctcacttgaaaagacgaaagcgtaagacacaagactttgaaaggcgtccatgctggccaagtgaaaccctctgccaaaaaagaacacccgtgtggcaaaactcccactgatagtcgacctggggaacaacgaacttgttcggacagtaaccagttggccctaggtagagcgcggagccttaatacccagaaggcgggggagctcaccgacggtttaatttaaaaccgtgcgtggagaggcttaaca

SEQ ID NO: 626478 - DNA, 261 bp, Homo sapiens
gagggttctcccaacctcactgcaagaaagatcttatattgtcctttccagcagaatctcccacacgaagttgtcacccctttttggcctggaccattgtgtattggagagaaggactgagcgatcttggcatgtatcctgtaaatgtaaaaaaaggacattttccccgaccggctggaccatatcctttgagcgtttcctgaggcttgttgcacagcccatgcaaacaaccatttggctgagaaaagacctaatcatata

SEQ ID NO: 626479 - DNA, 469 bp, Homo sapiens
cacagtcaactcaactccctgagtctaaataataagtcttatctcatttcagtcagttttccttataatgccctttttctgttctaggatcctagccaggatcccttatcacgctataccctctaatgacctccaatctgatgctttctactaccttcttagtctttcatgacctggactgtatgaagactactgtcagtattttgtagaatgtccctcacattatgagctccagatacttttctcatgattagattgaggtaatgcattttagggaaagaactcctcaggaagtgctgttgtgcctatcttagtatctcatgtagggctgcataagagggtatttgcttaatattaccttgagcacatcgtacaggtgatgtcagtcaggtgtcttctgctaaggcctgccgaggtagagtcatcatttggccttcagtcagttacacatatcttcgagaagactggg

SEQ ID NO: 626480 - DNA, 160 bp, Homo sapiens
tttcccccccccttttttgggggcccccttcctcttagggggaaaaaaaaaaaaattttttggggccccccccccttttaggggggttaaaaggccctttttttttggggttttttttgggccccccaaaaaacggggggggggttttgggggttcccca

SEQ ID NO: 626481 - DNA, 141 bp, Homo sapiens
tggaacccttaggcggtcatagccgtttaacatgctgaaagcgcaatccattaggaattcccagagtagccccaaacctgcagtgtaagcggaagttagcctgcagctagtacctcgagctagtgtaaacagcgccacctt

SEQ ID NO: 626482 - DNA, 626 bp, Homo sapiens
ctagttctagatcgcgagcggcctccatgactttttcaaaaaaaaaaaaaaaaaaaaaaaaaaaaaaaaaaaaaaaaaaaaaaaaaaaagggggggggcccaaaatttcccccgggggggccatgggccccccatttttgttgtgaaagaggggggtcccaagatagaggaggggatttttttatataagcatgaggggacggacggcgtcgtttttacaaaaatgtgtgaatggtggggaaaaaaaagctgtcatacagtggggattacttgtggtagaaggaaaacctataattgggggtgtggggaaacaatggtgggaacaacttatcctatgaagagataaatttaaaaactgctaacagggggaagaatattaaaataatatttgcagcgagtgttcatataaggttgggttgaaaccacatgatgctgtaaatattgagctgttggccgcgagttgaaaaaactgttgtgtgagttaatctagatgggatttatatgtattttaagagaaaatattattttatcacaacgagtgaaagaattgtagtataataaaaaagtagtaatagaaatcatgaaagtagtagtcatttagtacgatagtatgtcatataatcgac

SEQ ID NO: 626483 - DNA, 1023 bp, Homo sapiens
  misc_feature (476)..(476): n is a, c, g, or t
gacaaccttagccagaaccagtgttacccaaataaagtataggcgatagaaattgaaacctgggcgcaatagatatagtaccgcaagggaaagatgaaaaattataaccaaggccataacagtagcgaaggactgtaaccccgtataccgtatcgtgctactaaggtgacagttaacgttagcacaagtacacgatttgtgccaagcgcagcaggcccgaaaggagggccccatcaagaaatggaacggcgcccccgccagtgtaacaaacaccgcccaaaatggacaaccctggcaaaacggacccccttcaagcgcccggactttaaacaatgggcgaaataaaccccaaactgggccctgctttcaacccagcgcaagcaaactgggggacaaagtggggggcccataaaaatagcaaaaagacccccacccatagccatagggtgagagttttccccgctcttttaaaaacncagcttttggcggggagttttctacaaacagcggagtgctccccagaaatatataaaccgtgaaaacacaaaaacgcgtgtttcacaaaacgcggggagcccttttttagggggggcgcgggtctattggcggcgtacaaaaccgccaaaacgtcggcgcagcaaaaaaattgttttatgctattacgtgctaaaaaaagggttttccaacaaagtgggaggtaagtggggtgcacttatcaacaaggggagctccaaaacacaggagcgacagggggggaccccccacgggggcgaaaaaaaaacccacagtaaaacaccaacaccgaccacaacaaacaccccagcaccccggagtattttttaaaaaaggacacaggacccccaggggggggacaaaaacatgggatgagacgaccccaaggaccccaaacttttgtgtggggggggcgtatgaaccatttgttcgggtgtgcccaacacaacaactttttctcgcaccaacgcgggtcccaacacccacatactttttcttgtgcggggcgtg

SEQ ID NO: 626484 - DNA, 312 bp, Homo sapiens
tatggcttggggtctgtatgggatgggatgtaatgagatatgatggaatgggtgagatagaatagaatggaatatgaagggatgggatggaatagaatgagatatgatgggatgggatggaataaaatgagatatgatgggataggttgggattcaatagaacaggatatgataggatggggtggcatgagatgggaggtgatggaatgaaacagagcaatagtgacaagatctcttcaaatcacaatagagacacttgctcacagcagcatcagaaagacaaaaatatccataatgtggaaggcaaaacac

SEQ ID NO: 626485 - DNA, 206 bp, Homo sapiens
acccaggctggtctcaaactgtgtcctcttttaaaggacaagctgttcactcgctttttcttttcttttcttttttccatgtggagacggaggctcgctttgtcccccaggctggggggcaggggcacgatttccattaattggaggctccgcctcccgggttcaccccattttcttgcctaagcggggacccgggctcgaattcg

SEQ ID NO: 626486 - DNA, 101 bp, Homo sapiens
tcaacgctttatacattcctacaacgcttaactttctcaacgctttatacttcctccaacgcctttatacactccgtcaatcgctcttatactatccgtca

SEQ ID NO: 626487 - DNA, 395 bp, Homo sapiens
  misc_feature (18)..(18): n is a, c, g, or t
  misc_feature (49)..(49): n is a, c, g, or t
  misc_feature (190)..(190): n is a, c, g, or t
tttaattatcccttttanagatcctatctccaaaaacagtcacattctnaggtcctgggggttaggacttaaaataaaggaatttggagggatgaagttcagcccataacagatgcttttgctacattaagatttccctggccgggcgcgggtgtcacgcctgtaatcccagcactttgggaggccgagncgggtggatcatgaggtcaggagatcgagaccatcctggctaacaaggtgaaaccccgtctctactaaaaatacaaaaaattagccgggcgcggtgcgggcgcctgtagtcccagctactcgggaggctgaggcaggagaatggcgtgaacccgggaagcggagcttgcagtgagccgagattgcgccactgcagtccgcagtcc

SEQ ID NO: 626488 - DNA, 140 bp, Homo sapiens
ggtggtgtaggtgacacggggaaagcgcatctgctagccttgtaggtgtggggactgggccggatttggggtacagattgtgatctccgtatggccgtgtggtagtctctccagcttctctcccaacttcactgtgtggt

SEQ ID NO: 626489 - DNA, 375 bp, Homo sapiens
ggtatgaggccttaagctacgttatatttccaggagcaggtcggggttatattagccgctcgtaatttaaggcccatagttaggggtatataatccggagggaagagtagtttccctcccctcctaccgcggccccttacaggtttctctcgcttcctcttgccccgacctaccgatttcaagagcagtaccattcctacacgtagtaccaggcgaacgccaagtacccttagagattctttcaagaagccgccgccagtacctcctcgaagaagtcgcagaaacgaagcagtagagatcccagatcagcgataaaagtaatcattcaatagccaggcaccgatcgatcggggtcaggttacagtttcacctccc

SEQ ID NO: 626490 - DNA, 415 bp, Homo sapiens
agtcattttaggatttttgaaccaaaaaaggagggggatgatttcactttgcatttgtttcaaacattgggaaaatggtaccctgattacattaacaataaaaagctgacttgacccttgggggctgacctttgaaaaacacatagccggaactttagaaacatggccctttagggattaacaggtgtgtgctgaagtaaaaaaagggatgtaatgtttactctttaacgtgcccgcttggtaatttttggccaaattgttcactaacctgctgtttacttaataaaaatcttttctttaaattgactgttatttgcttgatagatgtcttcagaatgttttacttcttagcttcatcccatgtaattatgggtttgctgtgtgttttgtgtgtgtacctaagagagggaaggat

SEQ ID NO: 626491 - DNA, 135 bp, Homo sapiens
ctagaccagcaagcattcatttttaggtcgctcattttttaccatgttttccagtctgtttaacttttgcagggccttcactaccctgccttacataaacccaatcccaataaagttcattttccggcccttgga

SEQ ID NO: 626492 - DNA, 335 bp, Homo sapiens
acattatgaaggttaaatacagactacatttttcctaagacttatttaggctttccaacttctagctaatcttaccctaaaagtaaatgaatctttttttgtttgtttgtttgtttttggaaatggagtttcactcttgttgcccaggctggagtgcaatagcgtgatctcggctcactgcaacttctgcctcccgggttcaaacgattctcctgcctcaacctcctgagtagctgggattgcaggtgtgcgccgccacacccagctaattttgtatttttagtagagacggggtttcaccatgttgctcaggctggtctcaaactcctgacctt

SEQ ID NO: 626493 - DNA, 444 bp, Homo sapiens
ggcggtacggcccggagtaagggatattaagggatatgatactaaaatagtaatataagcaaggtgccggtgtacaagcggtgatcaggtcttttcagcacttgagcatttactggctcatttagtcttcctttgtagcgcatggtgggaggaaaaagtgcatgcatcattccgttcactcgttctcctttttcccggcacaaaaggcatcaagcttcgggacagtaagggggtagggcagctaaccatgcttctgtagtgacaagtgcacaggatagagtgggaacgcaagtgcaaagatcaccattaggagagagtagaagctatgaggaagagacatcgcagctagatcacggcgtcaaaagataataagtgcggccgcgaatggcagcagaagacaaaacccacacatgcataggagtctacaggacagtatgaagagtg

SEQ ID NO: 626494 - DNA, 926 bp, Homo sapiens
gaggagtggcagcggcaagggagccagtttcgcgaaggctgtcggcgcgccggggcccgaggcacccggacgcgcttccccgagcacccggacgcgccttccccgcgcagatgcccaaggaggaaggtcagctccgcgaagggccgcagggaagaagcccaagaggagatcgggcggttggtccagtaaaccctcttgcaaaaggtggaagcgaagcggaaaaaaggggcagcacgcgaacgggatcgacttctccagacaaaacagtctgccacccacacagcgacagcgggggaccacggggaacacggccgtcggggctttaccaaggaaatttagaggacgatttacctgggggaaacgcgggaaacacgaaagcactggaggaagagccacgcccttcttgattagagcggacagagaaaagacggcaggtttgattaaataaccatattcccattgtttaactcaagggggccgcgttggcttccctttttggtccactctccaagaaggatttttttacatcaccctaatggtcgcagcgtcgcacggttgtcagggacgctcgtagaaaccattttgaagcagcgggggactccccactcatcccattttgagcgtgcaactgctttcccaacggggtcgacctcctggggcggcttggtaattttgggtaccacccagacactggtgcggattttgcgaattattgacggcctgctggttcgggttgcagtacacatcccacaggggcggtggtttacttccaatatcaccggcttaacggcaaggggcgccctgtcggttgaactaattacctatcccagtgtttgcaactgctccagaacccttgggtggttcccaagggcctgaactgtggacgtcacatgcgcgagaacactttattaggggaccagttctcg

SEQ ID NO: 626495 - DNA, 1331 bp, Homo sapiens
  misc_feature (678)..(678): n is a, c, g, or t
  misc_feature (1016)..(1016): n is a, c, g, or t
  misc_feature (1144)..(1144): n is a, c, g, or t
gaagggtgttttttttctccccccggttattttgtaaggggattgttgaagttgtaaccccctctggtttggtggaaggagaaatatgtataaaaccttcggggggaggcctcctccacgggccgggttcctaaagaaaaaagattttctttaaagagtctgttttatattaaaggcggccacagacctgtgggtgcgccccggctgaggaaatagtgtgtacaaagacccgcgggtgtggcttaggacaggtttgttggtggcgcccacccccgctccaacggtcgtgagtgttatatttctaatgggcttattaatgtgccccgcgggagaaaccaactgggtggcctgtatcaacatctcctcgtctggggagaaattgctctgtaaaaaggggagagatattgtagagtggggggccttctctcgcggagagttgtaaaattgtttgggcccaccacttgtttatataataatatatatacttctccacatttggttttggggagcaccctcgccaactaaatgtttatagcgctctctttttgtgagaaccgcccacagctttgagatttctccctctggagagtgttctgtcacataaataatatataagagtcctcgcgctggccacagtttcacacacattcaccacacatatttttctcacagctgggngggtgagagaaattctcttgtgttttgtgtgtatacctgctcacattccccacatgtccccttttctgcggtttatagagattctacgagatataagaagatgtgtgtatatgtctcaacacaatatatgcttatagagcacacaggtgagaacttcacattccctcgtgtgtgttatatataaatatgccacattttgggagaaaaccacactataaagatataggggagagagtttatatatggccacatcggttataatatattgtgagaattgccctccgtggctttgtatatacacacctataatgtgtgtagaatattctatatctggggtntataatattgttccgcctcatatgggttatatttttggtacacacatttgtagagccacatgtcacacaccacacacctcgagatgagatgacacacggtgccacagccacgctatattctatatttnggttatagaaagggtttaacacatggtgtaaaataattatagtcgcacagttataagctaaaagcacgtggtttgctccaccctttcacatatcttggctataggtaagggtcacacctatagggaagcacacttgctccaaatctgtgacctgtccagaatataaaatttggtttgtacaaatcca

SEQ ID NO: 626496 - DNA, 818 bp, Homo sapiens
gatctcagctcactgcaacctccgcctcccagttcaagtgattctcctgcctcagcccccaagtagctgggattacacagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagcctgtactttttttttttttcatggtagctcgtgtatagcactgggataatgtcgggggtgtctctttaaccatcaaacgtggtccttttatttaaaagtgttataattaaccgttataaaaatctctagtcctcaataaggtgggtggctcagtgctatggtgtgttcctaaagctaagcttggctgggacggaaatgacctatagttctcttaaagaatcattaatccttataggattcctgagttacggtttggttcctccccacggtgttcccattcctgagtttggtgaatcctaatccttctataatttctattaccttcaccatggtcatctttccttacgcaaagcccagggaatgagctgtgctactttaacagtggggtcattatgatgcatgtgtgacaccgaggttggggactgtgtcctaaataacttttataccagctatgtggggtaccaggaacaggtgggttcacatattccaaaaacacaccgggtcattgtgaacacgtggcacatacacagggggactctatacatcttaggaattaagactactttgactggatattattac

SEQ ID NO: 626497 - DNA, 407 bp, Homo sapiens
  misc_feature (21)..(21): n is a, c, g, or t
tggagaacaaagaaggctcancctggtgttgattgcccatgacgtagaccccattgagctggtggttttcctacctgctctgtgtcgaaagatgggggtgccctactgcatcatcaagggaaaggccaggctggggcacctggtccacaggaagacatgcaccaccgttgccttcacacaggttaactcggaagacaagggtgctctggctaagctggtggaagctattaggaccaattataatgacagatatgacgagatccgtcgccactggggaggcaacgtcctgggtcctaagtctgtggctcgaattgccaagctggaaaaagcaaaggctaaagaactcgccactaaattgggttaaatgtacactaaattttctgtacctaaatataattacaaaatta

SEQ ID NO: 626498 - DNA, 350 bp, Homo sapiens
ccggtggccaatggaacctgaaaacttcacagacaacatgctgccaagtggtagtgggcatggtctgcgctctttgtggtaaccctggtacacaggcgtgcgtgggaagtggggttcccttcagaatgaaacacttttattttccctttttgccctgggggtcccaagctgttctcctggtgaggtgggctggagggacacctcagtcttcacattgtgtggcgggggggagaaacttgcaatatgacagagcaccactgctcgaagaatcatcacatagaagatatggcgccccctcttttttggttacttggcttggaccgctgggacaggacccgtcctccttcatg

SEQ ID NO: 626499 - DNA, 348 bp, Homo sapiens
ggctgtgctggcggttgcggcggttggcaggcggagaacaacaaaccccggagcctggagccaggtgaggctggacgggacgtggatgggctgacagcggtgcgcggactccctgaatgcccagacatgctcctccccaaatccccttccccagggaagtccactcctcgcattcatcctcactgaggagcaggggcataacgcctttatcatacaaactcacagacctagttgagtagagcgtacacatatatacatagaaatccgaagaaacgacaaacagtaaatagcgcaccagcactagaacacacacaaccagactacaaagacaaagaccaaccacacaca

SEQ ID NO: 626500 - DNA, 882 bp, Homo sapiens
  misc_feature (7)..(7): n is a, c, g, or t
  misc_feature (61)..(61): n is a, c, g, or t
  misc_feature (390)..(390): n is a, c, g, or t
  misc_feature (407)..(407): n is a, c, g, or t
  misc_feature (583)..(583): n is a, c, g, or t
  misc_feature (662)..(662): n is a, c, g, or t
  misc_feature (724)..(724): n is a, c, g, or t
  misc_feature (765)..(765): n is a, c, g, or t
  misc_feature (790)..(790): n is a, c, g, or t
  misc_feature (806)..(806): n is a, c, g, or t
  misc_feature (870)..(870): n is a, c, g, or t
gcaacgntccacaccagagattagataaatgcactaaaagataaaaatacaaacctatcgnctatataaaaattgatataaaattcgcccccgatgtttcgtgccccacgttccgggacggaacattatcacataaacgagatcaaatcggaaatgacgcgacgcgtatacgcacatcataggccaatggtggggcggacgatcgtcatctcatacgaacgaacgccgtctaacgtaaatccgccaggcttgaaaacacctttaaacggaaatgcgttgatctctcttaatattaattcatgatgtttgtgcaaaaccgccggcgcaattggggaatgggaatgacgaacggcgaccgccataatggacgtgctttgcgcctttcttcgngtttggatcgtgttttnccggaaacggactaaaaaccccccgaaatggtggtgggcgtccctttacctgaaaatctttcccctgtcatgctccacttcccacgcttccgaacgattccaaccctgaacgcctccacatccgatgtcccgccggcggggtaggcaatgattcataacggaacgcagaccctganacacgcgcccaaacggtccgcgtgtaccccccaccataccggcacatgaaacggggggggcccgaatctcatacggcgnaaatggggtgcacggccgacccgcccgcccctcacaccgtattcctccaaccccacgcccgnaccacgacgggcccaatgcgaatgcacgtgatgaaacaacnaaataacggaactgaaatgccaaangcacgtaaataaaaanatcggccctgtaataaaatcggatcgctcgccacactacacacgaggcgtttcgcccgattatnctgcacgttact

SEQ ID NO: 626501 - DNA, 229 bp, Homo sapiens
attagatggctgctgacctgcttagggtggtggttgctagaaggttgggtgacagtggtaatttcagtgattatttgtttagtatttgtatctttaagagacaggtctcattctgtcactcagggtggagtgcagtggtacgatcatagttcactgcagccttgagttcccgggctcaagcaatccttctgcctcagtctttccagtagctaggaatatcaagaatcgg

SEQ ID NO: 626502 - DNA, 93 bp, Homo sapiens
ggttttttttaggggggggggggggccaaaaccccaaaaaaccctaaaaaaaagaaacccctttaaaaattttcctttttaaacccgggggga

SEQ ID NO: 626503 - DNA, 426 bp, Homo sapiens
gaagatgtaggtgagaaaatattcctgaaagtagaactgaaagagacaaagagaaaagatgaaagccacagaagacaaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtcacccccccagggtcccctgtgcgcgggtgagttgaacaagacctgatggttttatatagggctttacccatgttactacatactcttcttctgaggtgtgtgaacaagggatgagctgtccctttgccttcccccgtgatg

SEQ ID NO: 626504 - DNA, 342 bp, Homo sapiens
  misc_feature (86)..(86): n is a, c, g, or t
  misc_feature (105)..(105): n is a, c, g, or t
  misc_feature (107)..(107): n is a, c, g, or t
  misc_feature (282)..(282): n is a, c, g, or t
ttagaggatcctgttatcccaacactggagatacagaataacttcaaataaaaattaattccaggccaagcacggtggctcatgcntgtaatcccaacactgggngncaaggagggaggatcacctgacgtcaggagttcgagatcagcctggccaacatggtgaaatcccgtctctactaaaaatacaaaaattagccaggcatggtggcaggcgcctgtaatcccagttactggagacactgaggtaggagaatcgcttgaacctggaggtagaggtttnagtgagccgaggtcatgccattgcactccagctcgggccacaagaaggaaactctgtctc

SEQ ID NO: 626505 - DNA, 93 bp, Homo sapiens
tctgaggacacggccgtgtattactgtgcgagaaggggattttgtaaagatagtatctgctactcggggggacttgactactggggccaggga

SEQ ID NO: 626506 - DNA, 570 bp, Homo sapiens
gttctggtgtgctaaaatctctttaaaattagaacttaccccaactaagacacatgggtccctttgattcaattttctcttgtgctggagccattggtcttctatgggagtacaatgcaataactctatttatccatagttgacaattatgtgacatacaaaaagacatagacaggagctcacattctaaagcgctggcagtggcccgaaattgactccagagctggaggtgggagggcaatcagagaggagacatcagctcactcatctcctctgccttgccccctatgcacagaaggtgacaccaggtcctgtcagttcagcatggacaagctctctcttcattcagtccctacctccttgctccctgctaaccctcattaattccacgtcttcattctctagcccagattagcaaaatgctaaggataaggaacacagaagctctttaaggtctttggtgcaactacttattccaccctctgcaagttccacccactccttagacctggcattttggtctcatcctgtctcagcactgcagagcaaacccattcttcctatgtctgt

SEQ ID NO: 626507 - DNA, 342 bp, Homo sapiens
aatatcggtgagctgtcacatatgatgtaggacagtgcttcctctgtacacgcacaggattcccgtgatgattgtgactatgagagcctgtctgatacgatgtaggacagtgcttccctgtaacatgcacaagattcccgtgatgatggtgactatgagagcctgtcacatatgatgtaggacagtgcttccctgtaacatgcctaagattcaccctggaagcttattaaaatgcaaactcatagaccacactttgactagctaagacaagagcatttaaatggatgtccaggtgacagtgctaagatcctactgttcatgtgggcattggctcaccaatat

SEQ ID NO: 626508 - DNA, 957 bp, Homo sapiens
caagtgtcccatggattaagattaggtcggggggctttaggtgatccgaatgcctccagaattctgggcgacaacttaatttcagagtttcaatggatggtaagagttttaatgaagacaagttttaaccttattcggaagttaaatattaatactttagaaaattattgtactaaacttatcgcaagccttttgaaagtagcagagtttcatcataccacatatattaccagagccataaaattttctataatcaggcaccttttgctgcttcttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattaccacgggatggtttttattaacagagactcgtttcatcgatcacgtcctagttgcacactgtgtagatccgagcacagtgcctatgccacatacttcttgtataactgctctggtactcggaacgcagtcacactcgtgtactcttgctgtggtaagacgcgaatctcagtacaatgattatataggttggaagtctgagtatccccagcaccaagtccagcagatctattcagaaatccagttgctgtcatacatgttatatgtctccatgccactatt

SEQ ID NO: 626509 - DNA, 295 bp, Homo sapiens
  misc_feature (56)..(56): n is a, c, g, or t
  misc_feature (60)..(61): n is a, c, g, or t
  misc_feature (157)..(157): n is a, c, g, or t
  misc_feature (199)..(199): n is a, c, g, or t
  misc_feature (219)..(219): n is a, c, g, or t
  misc_feature (270)..(270): n is a, c, g, or t
  misc_feature (289)..(289): n is a, c, g, or t
acctgagctgaaatggcagacgatctcggagacgagtgttgggagaaccagccgantggnncaggcagcagcccagaagcatcagatggtgaaggagaaggagacacagaagtgatgcagcaggagacagttccagttcctgtaccttctgagaaanaccaaacagcctaaagaatgttttttgatacaaccaaagganagaaaagagaataccaccangaccaggaaaagaagaaagaagaaaattactgatgttcttgccaaaatcangaaccaaaaccagggtttncctgga

SEQ ID NO: 626510 - DNA, 368 bp, Homo sapiens
gtgagccgggcgcagtggctcacgcctgtaagcctgacactttgtgaggccaaggtgggtgaatcacttgagctcaggagttcgagaccagcctggcaacgtggtgaaaccccgtctctaccaaaaacaaaacaaaaacattagccaggcctgtggtgtgcgcctgtggtcccaaatacttggaaagctgaagcaggagaatcgcttgagcccaagaggcagaggctgccgtgagctgagatcatgccactgcattccagcctgggcaatacagtgagaccccatgtcaaaaaaaaaggaaaaggaaaaggaaaaaagataaaagcagctttaccctgtaatcttagttctagtcctatctggactag

SEQ ID NO: 626511 - DNA, 248 bp, Homo sapiens
atagttttagaagtttcaatagcatcaggaaaatggctactgcatgcgggcttcatagctacgcgataggttgatcagtgcaggaataaatcgacagcacatgtctacctatgtaacaacactgcacatcctccacatgtgccctgagaaattaaaattaaaaaacaaaaccaaaagatcctagagttactatggtatacaatagagctcttgaacttcttcctgctattgcaccttctaaaactagg

SEQ ID NO: 626512 - DNA, 184 bp, Homo sapiens
tgaatgtaaaccaaacatgcaaggtgataagcttcatcattttggtggacatttcatcaggaacagttcccaaagttataccaagatgcctcctctcccagtccaactgcccagtgggcacttctcatgccccgttgtgtcagcaatgccacatggcgtgtcacccaagcactccagcactcgc

SEQ ID NO: 626513 - DNA, 138 bp, Homo sapiens
acagtctcgcggagacgagttaaagtctgaacggctgtagagctgtgcgccaaatgaatccacatatccgtggtgacaagcccaccagaaccgtgtgggtgctgacacggagcgcatctatgatgacgactatatacc

SEQ ID NO: 626514 - DNA, 224 bp, Homo sapiens
gctcagtagacagtttcttctcccaggtctgcacccacctggacgccctaaagtagcatcgctggaggcggtaccccagctcagagccccgtcccaccccgtcctgattagaggtcctcctggactgagagcagcgcctccaccctggcctgcgtgagcacagacggaggaagccgcttatcctgtttacatagacagctgagcactaaaggaatttctaagga

SEQ ID NO: 626515 - DNA, 195 bp, Homo sapiens
cccaactgagatccgatgagctcctgggaagccctgctgctgctggagacggccactgctccctgagtgtcccgtctcctgagggctcctgctgtccccatcccggtagttctccatgctctcctggtgagacaaagcgataataaaaggaagtgtttgtaatcccagcactttgggaggccgaggtgggcggat

SEQ ID NO: 626516 - DNA, 134 bp, Homo sapiens
cacgagcgcccagtacccctgaatttaagccagctgaaatgtactccggaggaagcagagttcacaacagcatcataatgcgaggtacagtccctttaccacacgcgcctagatgacttgtgggcgctcgtgcg

SEQ ID NO: 626517 - DNA, 192 bp, Homo sapiens
gagcagaggttgtgctggttgtcggggcagaggttgtgctagggtatagaagcaggggttgtagctagttagtaggggctagaggtatgagctaggtctagtgtagtaggaggttatgcgtgcttgtcaccacaagtggttgtcctggatttctagccaagaggaggtgctctgagcttgggactgatggct

SEQ ID NO: 626518 - DNA, 509 bp, Homo sapiens
cacatgtggtacccgctggtggtagtacgatgactgtgcttacaaggcatgtggtatcatagctgctcggtacagtgacagagcgtatacagtctagttgattccagttggtggagcaggcaggatctcgaagtaatctggtacgacttctgcacgatctcaagcctaacacagctatatcagcaatgtgttgagtgccaggcgcacaacaacgcgcagtgcatttgcatctatcttaggcagaagagtcctctcaacatccgaactatacagattcagcaaatgatgctaccaacaggggtggtgtttctatcttttactttcccaaagcagagtcctcccaccacaaacgtgggatccgtgcacgttaacgattactaggactatgcagaaaacctttgaagattatttgcaacttctgtttgttcaccgaactgtgatgatctagagtggatacagtttgtgcctgttcagagcaggtatcatatgacgatgcttttatgacttta

SEQ ID NO: 626519 - DNA, 772 bp, Homo sapiens
ggcttctcccctgatgcagagaccgcaccacagaaatgcaacggctctaaagttagcttcttgcctaagaatcatcgagcgatttggtctacttcctcattggcttctattctgatatcaggctatagcttttctcgctactggtattgtatgctccctcttcgcgtcttgactacccggtcattcaggggtaactcatcacgtcttcacacagtgcgatctaaatccaagaaactaaattggctcatgtgaacattccacacatttctcttggttctcaataccctatttgaatactattgtgagggcaaaaagaggggagaaaaacaggagtgatgtcatttctttttcatgtattccaagttaaagaaacaagggcaggctcgtatacatggcatacttaactacacttagacttaatctagaacccctgtggcctttttgatgtgttttatttcttatctctttgaattcctgtttggttacttggcttccaatggaggtgaacttaacaaccatacttgaatattccgtcttgactttgtaaactgtggctacttgaaatgaagtcatctggggttgatggatgactggtagatttttgcaatgtctcaaggcaataggatgtgtattaaactgtagatattcttagtacagtaaatttatgctgataattcattttgtataatttttacctttacagttactattttttccttccactttattggtttgctcctgagctaccctccttacctcccttctccctcag

SEQ ID NO: 626520 - DNA, 254 bp, Homo sapiens
aaggctttagaacacataattttcaaagactaaatctagaacccatagtagacatcagtgctcagagttagcataatttggcgctatgcaggaattgccgataaatgcgttttcacagacatcaagatgtaatctatgtatactatatcacttagacaactgtgtttcatttgctgtaatcagtttttaaacggtcagattggaacggccccattaggagtccatagcaagcatagaaattgtcaatttccaaa

SEQ ID NO: 626521 - DNA, 218 bp, Homo sapiens
aaatacgaacttgagtaatcagcatgatcttccacctccctgacacatggctgtttccgaactcaattacgcatttaaaggaccaacatttgttatgaccctaagtagttcaaaagaacatcccccaggctccgggctgactccgaaagaggaatcccacaaacgctcggcacagtgacatttccggaagccggggagagcctccccccggtgagtac

SEQ ID NO: 626522 - DNA, 428 bp, Homo sapiens
acaaaggcgctgatgaatctggcgtcggtttttacgaccacatctcctatccgttgaacatgtactgcttttacgcgagggcgtgttacgtcgggccgaggctcacggatttcccgacgccccgtatcatgatgacgtcgagccttccgctgctagaccgtgtattaagcggtaaggagaagggcgtatccattcatagaatccaagtcttgtttccaacagatacctgctccccattagagggggactacgacatcggacgcgtgatgcgagtgacgcgtcttaaggcttccgggcggggcaagccgagatatctagtcgaaagcacgtcgggagtgatactggaaggcgatgtaaacgtgctgtgggctacatacgagagaacagtcctgttcgattactacccaaggtcgttagctggcgaagat

SEQ ID NO: 626523 - DNA, 786 bp, Homo sapiens
gggtgaggccccgggaatgaaaaacccatatgtaataatcgaattcatttaacatgaatcttgagtacgtggaccattgcttgcatgttaacttctggtttgttgggtatgtatgttttgcatttttaagtccagatatcctaaagctcaatgtttggtctctggttttcatccttagagaagccatggagaacagacttgaaaagtttaggaaatcatagatgtggcagaggtggtgggaagaagaaagttgagctttttccccttgtagtaaacttctgcatttagtgttctatctttccatgggcaaaacacaatgtggttattcttgttcatacaaccattttcaaatgaaccttagaaaagtcttaacattttaaggtatttctatgctcagagatacacttagattgagtaggaaagaactcgtaatggagtttgagtaaagaaaatgactgatgtactaaacccagtaaaaccttgtggacagatgtttacaggtcaggatgttctaaattgggaatctagagtatagctttagattttcctatggggcttagagtatttgctataacaaatggaagtgggatgaccaattataatatttcctactgcggtcgtacctggactgggttcgttctcttaaatatactcagtaatgagctcaagctctgggtattaaaataacctagatggcgttttaattgccagagccaaattatctggggttcctggcccttttaaggggcgttaattcaccttttgggggaccctgttttttcgggg

SEQ ID NO: 626524 - DNA, 109 bp, Homo sapiens
gtggcctcgagcctcccaatgtaggtgggattacatggcatatgccaccacaccgtgtctaatttttgtgtattttacagtacgggactggggtttcactcattgttgg

SEQ ID NO: 626525 - DNA, 848 bp, Homo sapiens
  misc_feature (4)..(4): n is a, c, g, or t
  misc_feature (121)..(121): n is a, c, g, or t
  misc_feature (144)..(144): n is a, c, g, or t
  misc_feature (176)..(176): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (262)..(266): n is a, c, g, or t
  misc_feature (285)..(285): n is a, c, g, or t
  misc_feature (296)..(296): n is a, c, g, or t
  misc_feature (298)..(298): n is a, c, g, or t
  misc_feature (300)..(300): n is a, c, g, or t
  misc_feature (308)..(308): n is a, c, g, or t
  misc_feature (316)..(316): n is a, c, g, or t
  misc_feature (319)..(319): n is a, c, g, or t
  misc_feature (343)..(343): n is a, c, g, or t
  misc_feature (358)..(359): n is a, c, g, or t
  misc_feature (420)..(420): n is a, c, g, or t
  misc_feature (439)..(439): n is a, c, g, or t
  misc_feature (443)..(443): n is a, c, g, or t
  misc_feature (453)..(453): n is a, c, g, or t
  misc_feature (514)..(514): n is a, c, g, or t
  misc_feature (527)..(527): n is a, c, g, or t
  misc_feature (843)..(843): n is a, c, g, or t
gaantcctgatctgtttctttattaaaaccgctgggggaaacaaatgttttacgtaagtgcctacatttccagtagattgcacctggcatcaaaagctcagcttcatcttagggtcctgcntgatattacaaaagactaatttnaagtcctaggactcaaaataaacatgattttntgaataatagatatatacatcaaaaatacatctaaaaaggcattgggnagggcgatnanggggcgctatgggcgcgggtacatttnnnnncttacaggcaaaagccagngggaacatttntntncaatttcnaggaattnccnctcggggaaagtcggtcgaaagtnacctgatcatattcnnccgcttcatctccactgtccatttcaatatccatctcttctgtatcagcagctcgcgacangatgtctgccatcagtgcntctnccaatttccngcgtacttgctgtactcgctcttcctgtttcttgatgtcttcatctgtgacaataaaagcnttgccgaggggtngagatgtgttaagccaaacagcagggttctttgccacagcagcggagacttgccctgtgattggcgcagagcttgtgtgcaaagcctggcaacagcagataaaagggtctcatcattgctacctggaccaactccttgaagacctttgggtagttccatggtttttataatttgttctgttacatctgatgcactaagtccttgtagcctcttctcccagaaaagctgacgtggctgttcattcattcgttgtgggtctgatttcactttattactaggatgatttgtgactttggttaccggttgtttgaaaatngatgc

SEQ ID NO: 626526 - DNA, 182 bp, Homo sapiens
tagaggatcccggcggtattgctgagagccctcgcggtccaggccccagccaggtggccggccttgtcccgcctcatcacagaaagggaggatgggcgatgacggtggtttctatgccttctgacccatgtttcccatgtttataacttttggtcgcagctgtttaattcaatcccacgccc

SEQ ID NO: 626527 - DNA, 1365 bp, Homo sapiens
  misc_feature (536)..(536): n is a, c, g, or t
  misc_feature (690)..(690): n is a, c, g, or t
  misc_feature (757)..(757): n is a, c, g, or t
  misc_feature (763)..(764): n is a, c, g, or t
  misc_feature (770)..(770): n is a, c, g, or t
  misc_feature (772)..(773): n is a, c, g, or t
  misc_feature (792)..(792): n is a, c, g, or t
  misc_feature (799)..(799): n is a, c, g, or t
  misc_feature (803)..(804): n is a, c, g, or t
  misc_feature (814)..(815): n is a, c, g, or t
cttagattgcacgaggtcgggatgtcagaaggcttcagcaactgttcgagtcgtagagtaagcaagcaccttaagtagctgtgttcaatgtagtgagacagacttgtcacttcgcgcttcgccgatcgtgcttcagtctcgtaaagatactacaggaaagctggtatattgtacccttaataaacatatgtctcatccgtaaacacacaaaacgagcagaaagccatagacaccataacagacgagcaaaaagaagatgagagccatagaacgtgggcgacaagaaaggcaagatcgtggacgccgagatacaggagcaccagccctccgtgctgctggagctgggggcctactgtggctactcagctgtgcgcatggcccgctgctgtcaccagggcgaggctgatcaccatcgagatcaaccccgactgtgccgcacatcacccagcggatggtgcgatttcgctggcgtgaaggacaaggtaccaacccttgtggttggagcgtccaggaatcatcccccagctgaagaagangtatgatgtggacacactggacatggtcttcctcgaccactggaaggaccggtacctgccggacacgcttctcttggaggaatgtggcctgctgcggaaggggacagtgctactggcatgacaacgtgatctgcccaggtgcgccagacttccntagcacacgtgcgcgggagcagctgctttgagtgcacacactaccaatcgttcctggaatacagggnaggtgnntggacngnnctggagaaggccatctacnaagggcnccanngcagcgaagnnagggccctgaatgccccccacgcgggcccccctctcgggctctctccacccagccgtgggtactgaagggtgccagaaatgtgcttcctgctgaaccttctggacggtccgggctgtgtccctaaaatgcaaagcaactctcggccgaggggccttgcgcccctgaccaatgcttaacttcttctggaactgccaacacttggattgggtaccttctttaaagacttccacatcatagacttcttttactaaaccaattggctaaggctaattagtgacctcttctattattacctacaatattccgtggtcgtacacgacttataaacttacgacacattccggccctcctaagcaagacgccaggacacacgcaccaacagccgacgtcgacaacacgactgtggtgcggcgccgccgcccctggaaacggcttctaccaaccagtcagggtggagggagagccccaaaaggtatgtccaccggcgccaccgcgcgtccgcagaaaccgggcgacaaacagagccggcatccccccaaaaaacgccgg

SEQ ID NO: 626528 - DNA, 361 bp, Homo sapiens
  misc_feature (31)..(31): n is a, c, g, or t
gtaagaagtggggcagcgaggagcggaaganagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggaggc

SEQ ID NO: 626529 - DNA, 1109 bp, Homo sapiens
  misc_feature (536)..(536): n is a, c, g, or t
  misc_feature (690)..(690): n is a, c, g, or t
  misc_feature (757)..(757): n is a, c, g, or t
  misc_feature (763)..(764): n is a, c, g, or t
  misc_feature (770)..(770): n is a, c, g, or t
  misc_feature (772)..(773): n is a, c, g, or t
  misc_feature (792)..(792): n is a, c, g, or t
  misc_feature (799)..(799): n is a, c, g, or t
  misc_feature (803)..(804): n is a, c, g, or t
  misc_feature (814)..(815): n is a, c, g, or t
cttagattgcacgaggtcgggatgtcagaaggcttcagcaactgttcgagtcgtagagtaagcaagcaccttaagtagctgtgttcaatgtagtgagacagacttgtcacttcgcgcttcgccgatcgtgcttcagtctcgtaaagatactacaggaaagctggtatattgtacccttaataaacatatgtctcatccgtaaacacacaaaacgagcagaaagccatagacaccataacagacgagcaaaaagaagatgagagccatagaacgtgggcgacaagaaaggcaagatcgtggacgccgagatacaggagcaccagccctccgtgctgctggagctgggggcctactgtggctactcagctgtgcgcatggcccgctgctgtcaccagggcgaggctgatcaccatcgagatcaaccccgactgtgccgcacatcacccagcggatggtgcgatttcgctggcgtgaaggacaaggtaccaacccttgtggttggagcgtccaggaatcatcccccagctgaagaagangtatgatgtggacacactggacatggtcttcctcgaccactggaaggaccggtacctgccggacacgcttctcttggaggaatgtggcctgctgcggaaggggacagtgctactggcatgacaacgtgatctgcccaggtgcgccagacttccntagcacacgtgcgcgggagcagctgctttgagtgcacacactaccaatcgttcctggaatacagggnaggtgnntggacngnnctggagaaggccatctacnaagggcnccanngcagcgaagnnagggccctgtattgtcgcgcctcccgtgacccacctgctcgagggcgtcttctcatcgccatgtccgtgcgtatcgtgcaatggttgaccacgacgctgcgtcgcgtgcctgaacctgtactagcgagcgtgcctggggtcgtgatgtcgcatacatagtagcagaaatgccaaacgaaccgttcgagcgcagtagggtccatgtcagccccttgtacccatgcgtaaaacacgtcatccttgagagcatgcgaaaacgaacttcgtggatgtggttgcgtttattgttacacg

SEQ ID NO: 626530 - DNA, 475 bp, Homo sapiens
cagactggtctcacactcctgatctcaaatgatccacccccctcagcctcccaaagtgctgggattagaggcgtgagccagggtgccctgcccttgcttcctgtttgtaccttcccaggatcatgggtgctgactcctgacctcccatctctgccctccaggtggtggtaaatggaaatcccttctatgagtacgggcaccggcttcccctacagatggtcacccacctgcaagtggatggggatctgcaacttcaatcaatcaacttcatcggaggccagcccctccggccccaggtgtgaggggtcccatcccttcttgcgtcctttctttctaaattcagttccacattcatttttttctttttttctttttttcttttttttttgagacggagtctcactctgtcgcccaagattgcgccactgcactccagcctgggcgaaagagcgagactccatctcaaaaaaaaaaa

SEQ ID NO: 626531 - DNA, 470 bp, Homo sapiens
  misc_feature (440)..(440): n is a, c, g, or t
  misc_feature (467)..(467): n is a, c, g, or t
ggcctattttgggttctttaggagggggattaacagatatttagaggaggatgacggtagtgggaagggatctagaagctatcttctggtgaagaatggtttttgtaaggatcgattagacaatgaatgtaagatcctaaaatagtacccagtagtttttgcattgtaaacaaagcagttaatcctgttttggggattgtactttagttggtacctttatagattaaaacctttgagatctaatcctttaatatgtatatatttttcattttcatagttcttttttgctttaaaattaaaaattgagccaggcaagttggcatatgtctatagtcttagctactcaagaggctgaggcagaagaattgcttgagcgcaggagtttgaggctgtagtgtgctatgaacaggcctggcaatagcaactacactgtagtctgngtagcatagtaagactccttctcttanaaa

SEQ ID NO: 626532 - DNA, 299 bp, Homo sapiens
cccgggcacatcgtggagcgtgacgagtagtacggtggctgtaacttggtaatcctttttataactgttggctgtgtgttcttgtactgctggagacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggaggc

SEQ ID NO: 626533 - DNA, 1331 bp, Homo sapiens
tgagtgccagtgaggagtgtggagtaggcgcccagtgcatcgtgcagacagtgacgacatcagctgtgggacgatggtgcctgagctaggtgctggaaagaagggggagccaggcattcatccctggtcacttcttgtgttacatggactgtgtgcagcttggtttgtgactgaggggatgcttggtgaggcatgtgtgtttgatccacagtggacctgtgttgcaactggagtgttgtatgctagtgcagctagctggtgctagtgttgatgtgaaccccaatcgttggcctgtggtgccagtgttgatgttcccggttccgcttccagccatgtgaccttctgcgtatcccacatgacgctatccttgacagagacacgtgacgtgttatacgtggggactccgacagtgtgcattgtgctgcgtggacagaacggcaggaacaaccgcttcccatgcacagacgtgtggcacgtgactgggtggcacgggcatgaacgtttatggcacgaaatgtgttgaccattcatatcatctggtgtgcgcgtgatgccctgagagaacgttgcgtctagacgtggcttgcgcgtgtgtgtataattgtgtgccgctggttcacaggctgccacgggaaaaatggaaggcaaaacaggactggggggccaacgcggcattgtgcggcatgcgaccaaggtgggcggctagtgggacgccaaagaccggttaacggtagtaccccaaaggacaaaccacggattggcgcggccgtatggcggataaccccacaccgaggtggcagcattagggagtgttccgacagaaaacaacaggagcgaagccacattaggcgacacatgcgcgagtgggaacacacacacactaggggaaccaatggaaagcagagagatacccaccccaaggagcacgtaggacgccagagcagttacaagaccagcaaaccagggcagaatatacaagtatcgtaaacgtaaacgcgacaacagagggcaaacccaaaggggggcggcacagggcacattcgcggcgccaacccggggcgattataccgtcaacgggccgcccgatacgtgcgcgcggggcacacgcccattcaggaaggcggtgcggtgggcacgtgaaagaccgggggcgtacagcggaacagaaggtggcccaacggaggccacatccgcagcgagagaacggcaacaacggccacacatcaacgggaacaactgtgtccaaaccccaagccgacaggtgcgtagccgagactacaccggagcgaccacaacagcgcagcaacgcggcgacgcgcagcacaccaaca

SEQ ID NO: 626534 - DNA, 163 bp, Homo sapiens
ggtgcatgatgtggaaaagtgtggtaagctctgcttgtgttcttagattcattcatactgtgaaaagtctgccatgaaggagactgtggacatgctctcgcacatcagttatttctgcagatgtctttcagaacaaaggagcttccatgtaccacgtctcaaa

SEQ ID NO: 626535 - DNA, 156 bp, Homo sapiens
ctagcaggagctatatacaccacctggctcccaatcttatttgttacaagtcctgcttcagggttacttccctggcactgctgctccctcccagcatttgcaggactgtcattgccttagttattttttctgtttgtttttttttggtggtggtat

SEQ ID NO: 626536 - DNA, 558 bp, Homo sapiens
gagcgggtggagggaccgttggggcgggaggcggcggcggtggaggcgcgcgctgcgggcagtgagtgtggagtgacgcggacgcgcggcggagctggaactgctgcagctgactgccggcgtccggaggaaccttgatcaccgtgctccggcagggggccgggactcgccatgcgctgaccagctgactgaggagccagattgcagagttccaggaggccttctccctctttgacaaggatggaagcatggcaactatagaccagcaaggaagtggggacagcgatgagatcactgggacagaacccccactgaagcaggacgctgcacggactcatgatcaatcgaggtggctgaacgatgggaacgggaccatagacttccacggaagtacctgaccgatgattgggcagaaagatgaaggtacacagacagatgaggaggagatcaagagagggaggtaccagggatcatttgaaaaaggaatggtaaatggataaaataagagacaaaagagaaaggatcaagtaatgacgaaactgagggagaagatgaacg

SEQ ID NO: 626537 - DNA, 957 bp, Homo sapiens
ggctgagcgtttttgcagactaccatcttccctgcaactctgaaggatggaatttaatgcaccaccatgtcgagcaacaagaacaaatgaccaagatcaatgaagcgccctcagggtgcaacatccaagtgtgtaggcattatgtagactcagttcactagcattactagcggcatgttcaatagaggccttcaacatgacttgatcagatacagagatggcttatcatcgacaagggaagaattggcatggatttggttgcttaatatggggaaaaaaaattccacatgtgatgagtctctgagatgccatgatgcatgaggcctccagtccccaatcaaatttctaaccattgtgcctcaccatgtagggtgagaaagttaacttggggtacaagatcctgaaagatgtcatcaagaaaatgcctttgttgtggttgagatgaaagatagcagctggaagccatagaggaagattacttgagaacagcttgatgataagcatgggggatcggtgtaacagatgagggaagtggtatgagcttgttacgggagaatgcccctattgatagtaacaggggaattgcaattagatcgaagtaacagacgcatcgtgaaaaattgatgccagagacgaagatgagtggagatacacttgtaaatccaggccagagggtactgtggcactggggaatcgagaatttcccgtgcatgccattggcttacagggttgcggttccgaggtattaatctcaggcaatggggtagtattttttataaatagacgggagacggagttgattagtatggtcaggaaataaatgggaatatccaccagcgttcccaaaaaggttaagggagaattcgagaagagcgacaagtgacctataaatgagcaacagtggcatcttcacgcgggggtcctccaagagacacaagttgttacatcctctatggt

SEQ ID NO: 626538 - DNA, 301 bp, Homo sapiens
cagtggaactttatttttgaaagtttatgtaaaggccggttgccgtagctcacacctataatcccagcactttgggaggcagaagtgggcagattgcttgaacccaggagttaagcatcctgggcaacatggtgaaaccctgtctctaccaaaaatacaaaaatgagctaggcatgatggcctgtgcctgtagtcccagctactcgggaggattgcttgagcccagtaagtcgaggctgcagtgagccatgattgcaccactgagctccagcctgtgcgacagagtgaaactgtctcaaga

SEQ ID NO: 626539 - DNA, 1122 bp, Homo sapiens
  misc_feature (276)..(276): n is a, c, g, or t
agcggcggggcggaggccgcgccgggagcgcggtggggctaggcgtggggcgctcccggcatgtacctgtaccgcagcgtccgtgtggcttcgcccaaggggctgcgccgagctaccaccaaggagtggcctatgaatctgcgatgtccagactttgtccctcatgcacgttggcaggtccagcattcctggacagtagtctcttcccggtcactgcgaaggaacaccacgccggcattggcacatgcaacgttgcccctttgaaatcggcccaangctgatggtggcgacaagttgcgaccttgggttggttcggcagatgcaaagcactcctagctaggaaggatcgcctaggggtcgagatcatcgcgtggacgatgctggtcaacgcacgaacgattgttttcttgcgactatttgttgcgacattgtgcctgattcccagaggctaaagtcgtggacagactctatggtcagcaatccactttgtcacaaggcatgtgcaaatcatgaaccttcccaatggttacctgcatctagataaatgtcagcgatttggcgatgggcttcaaagtagaagagcaagaggcgtgcacagtgagagactggtaccgtctgagaaagcaaaaccttgagcctgcctagattagcttcttggggtagtgtaccacttactcagcggaaccaggcacgtgatctcacctgttcgctgggaggcaataggaaactaccgagccccccggaatgctgagtaatcgcagtcgtaccctccagagtagggaaattgttccgggttcactgataaacctcgaaatcaacgcacattgtagtcctccaagtccccgaaagatgaaaccaccgattttgtgattgggaaacttaatggttcttaatggcaacgaaaataccacaagggagggcctggccacgttggggttcctgaccggcatcgcgattgggccccaaaggggccaccgcggtcctatcccaatttttcttttccatggcagttcctgggcctggggccgaacgacccccagggtgttgaagcgcagggcggaatgccggggggttccgagcggccagggttccgggggacccggcctgcgtctccgaaggccc

SEQ ID NO: 626540 - DNA, 149 bp, Homo sapiens
gcgtgatccgctgcttggctccaaagtgctggaattataggcatgagcactgtgccagctgatagggaactaagttctttcggtgcattggttatcttttgctgcattaactgactatggaaaaatagtggctaaatatatctgtcatc

SEQ ID NO: 626541 - DNA, 200 bp, Homo sapiens
  misc_feature (45)..(45): n is a, c, g, or t
  misc_feature (65)..(65): n is a, c, g, or t
  misc_feature (72)..(72): n is a, c, g, or t
  misc_feature (110)..(110): n is a, c, g, or t
gcaattcgtggcacgagccaggcgtccgggacgtcctctccggcnttttgccctgctctgcctgncctgggnttaagaggctggtgccgttcaaaccgttcgcttatccnggctttttgaccacgctatgcttcaaggccattgaggtggaccagcttggccattgatacctaccacgagttttatgaaacctatatccc

SEQ ID NO: 626542 - DNA, 212 bp, Homo sapiens
tggaccgccgtcacgccacgatttcgcgctgattggcgctaatgtccgacgccgcttgacggactccgccacggcgcaatcttcaccggcggcgacgcggtggcccacttccggcagatcgacaaacaccatatcgcccagcagttcctgcgcgtgttcggtgatgcctacggtgtaaacgccgttaccttctgaacgaacccactcgtggg

SEQ ID NO: 626543 - DNA, 336 bp, Homo sapiens
gttgctaggtgagtgatgaaatcttggtcactcactcactccgatcagctatctctgctcactctcgagtagtgggatacaggcatgaccaccagcaggtaatttgtattttagtagagatggggttctccacgttggtcaggctggtcttgaactcccgaactcaggtgatcctcctgcctcagcttcctaaagtgttgggattacaggcgtgagccactgcacctggtctttttttttttttttttttttttttttattttttttttttttttaaacccccccaagggaaagggggccccggcccaaatttgaaaattggggacaaggtttttc

SEQ ID NO: 626544 - DNA, 762 bp, Homo sapiens
  misc_feature (315)..(315): n is a, c, g, or t
ggcgtggttgcggtgtatgtgactggacgccaggggcagcctgcgcatcgcctgaaccgctgcgtgtgcgccgtggcctgccccttcccaccctcgcctctgctgtctccagcctcgctttctccgactttcctgctcctctgctgccttcgtttcttggtcctcggccgtcctcgccgcctgcccagatggatgtccccgtgccccgcaagaatgcctgttttcctgctttggccctgcatgcctgcctgctgatttctggcacaggttttctcccctctcggcttatgtctcccgaaactggcgctggctccntctgcccctgctggtgggaaagacccatgtgcttgcctgatcctgctggaaactgccgctgattccgtcctccaagggaggcccgacaaggctggatgctgcccctgtgtgggccaacgagcccccttgtgaacacatcaaccccctggggtggggcgtctttcggggcaccatggcatgctggcctttgcgctttttctggccacaggcacacagccctggtcaagcctcccttccggacccctgttagagaactgagaccgacaccgccggacagggcccccattcgactttgcgaggggctggtgcctggagaaccccggaacctggggagcccccaaggaagcccaagagacttgccaaaggaatttgcggccggacccggtgctcgcaggttcgacattgggcccgttccagaggtgttccccccgggagggatcagggtac

SEQ ID NO: 626545 - DNA, 813 bp, Homo sapiens
caggtgcaccaccacacctgtatgtcccagctacttgagaggtaaagaggggggtctcactgtgttgcccaggctggtctcgaactcctgggctcaagcggtccacctgcctccgcctcccaaagtgctgggattgcaggcatgagccactgcacccagccctgtattcttattcttcacatatttatttttacttttcactgttttaacaataataaccaaagctattgcataaacaccaaaaaacaaaaacacaaacaaaaacacaacaaacaacaataacagaagaggaggcgcgcgcccgccccccgagaggtacttctcctcgctcgagagtgctgcgccccacagaggggtcatatcaacggcgcagcgacaacacgcccagcggttgattttcatgtgatgtagcaccacaagaagcagagtagtggcggctacgccccagtaatatatagtagtagtggagcgactgtgcgtgactatatatattgtaagcaccagcaccatcgcgaggagcagcgtctgtgtggaggcacccaccagctgcgattctctactcaccaaaccatcacgcgggttatgcaggtgaagcatacaaagcgtgcggacacaacaaaaagacgctgttgagatgaatgacccgacgttgttgggggcagccacccctactgctggtgtgatgaacaagaagagggagaacacacaccaatctggtcttacaatgcactcatcaggagccggagcggtggtgtgcatcaacctaatctatctagggtcggcaccaaaaagacagtaacctctatcagaaga

SEQ ID NO: 626546 - DNA, 423 bp, Homo sapiens
gggaatctcacttgcaaccacctaaaaggagtattttcaactgaaattttacacatttgaattacaaactcaagacatgctggtcataacaaattaaatgacaaggaagtgcctgagtcaaaatgtatgggagctatgtggtatataaagctatgcggtgagctgagatccatataaagggaaggccacagaagcacccaaagcatcgtgggtcggctacagaagaagacaattttgactccctgtacaggacactatcttggtaccactcactttcctccctacaaaatctgaatattgctcacatatattcaacatatgtccaagaagcttcttatgtatgtctcctgcctcttctttccatacctcccaaatgttgatccagaacactgatcaatattaataaattaagcaaagttttga

SEQ ID NO: 626547 - DNA, 161 bp, Homo sapiens
gcccaatacctgtcgcgcgtgtgcatcaagacgacggtggacgccatgacgcgctcggtctacttccccaagcgcgccaagcgcgagttcagcttcgccatgggtggctaggtcgtcggaaaccggcgaagcctcctcgtacctgcagtactgggtcagcg

SEQ ID NO: 626548 - DNA, 959 bp, Homo sapiens
tgggggggggggggtccttatttccaaaaaaaccttgggagattttcggttatcaaaacgggggcattaatggtattctctttttcccccaatgggccccaaaaaaacccaaaaaagggggagtcacattatacaacccaaaaggcggcggggttgaccccatcacagacccccctatagaaaaccttccacaacaaagagtgggggcgggggtggggagcgaaccataaaaagaccaacaaacgggccacccccgggcagcggcagaaggtggtcaagacacagaaggggggtggccggggggccccacaaaccccaaaagccacagagttctcacacaaaataatatctataacaattattaaaagcagcttgggtgtaactaatacagccatattccaaagaagttcccaccagcaccgcgggagcgggtcaccacagcgcccccatagtgggaaagaggggcgcattctaagaagaaacagcagtgcttacaacacccccagaaacaaggggggtaaggaaaaataggagtatccaccacgtgggctaataacactcgagatgggacaacaacaccacagccgtctgtctctgtatcatctaaaatctatcacatccaggaggaggacagggaaagcagcctattatagggtggcccaccctcaacaaaagtggggggcacgaaggaccccaacgtgagacaacccagacgagggaaggcggggaaagcaaaggtggcaaccaaattgtggggccccacgaggtttttaacgactctaatggtggacactctgtggagacaactacaacacagaaatcacctctccccgaagatcctatacggcgcgacacgtgtcaaagacagtactggctgggtgggggtggaaacccggggaccctcgtgtacaatacagtccgacaggggtcccgggggtccgggcgaggcctcgagaaga

SEQ ID NO: 626549 - DNA, 353 bp, Homo sapiens
accggaaggatctgtgggcaagatagcgccactgcactccagcctggggactgcaggagacttcatctcaaaaaaaaaaaaacaacaagatatggcagatgcggcggccactctgtccccagttttagatgttttacctcattttaattctctcaaaacctcaagtttagatttcagtgctatccccatttcatgtgatgcacagagagatcaagtaattggcccaagttcaagcagcataccttggggctgagcgggagtttaaacccgggcactcagtgacagcttccacactcattaccacaatgctaagagtttggccagacaggtgagaagcacatttttgggaagag

SEQ ID NO: 626550 - DNA, 308 bp, Homo sapiens
ggggtttaataaaagggctttttccccctcggtccaaaagatcaaccggcctttctccaataagaccttaaaaggatccgtttaaaaagattgcgtaaggttagccctccccggcatttcccaaaattcgaaggaagccaaggaaccctattctttaaaaaaccttccccttccaatgttaccaggggttattaaggatgggtgggcccatagaagattttaatttggggtttctaatcggacctttctgatttttccccaaagattgtgtattacttgtataataaaaataagagctttaaattgtg

SEQ ID NO: 626551 - DNA, 739 bp, Homo sapiens
ggaaaatcacattggtgattatacagtcagagaactcattcgaactgagaagcctcatatgaatggccaatgaagtgtgacgaaaggccgtacccttaggaaggcatcacattgcaggatagcaccagcaagactcattccgggagagataccctttataagatggcagtgagatgtggaagagagccttcactcatgaatgtcatctctcagttggacacatcagagagttcaccacgtggtggatggagaaaccagtggtgaaaagtggcgtcatgaacatgttggggaaaagtcgcttatcatagtcgaggaatatctaccgaggggccttccgtgattaccaatctgggaacaggacttcgatgacacattgatgcaacattccagaacactgggattgcacattgtgaggcaccacctggatggttaccaaggagacgacgtttcgacgattaactaagtagagacgaggacttttgactaagtccaagcgatgggggacacttaaaaaagagttagcgaacgtacaagttgttctaagaaaacaatttcgaagacggacgtggagagggaagaaacgcaaagacccaagtaatcttgggtggggaacttggaccgttgggtgaaaagaagagcctcttttccagggaaagacataaatgttttagcaggaaggtgctttggtggtagggagttgacacaagtaaaggtgtgtgacagggggaatgtgtggggg

SEQ ID NO: 626552 - DNA, 284 bp, Homo sapiens
tgtaccttggctcactgcaacctctgcctccggggttcaagcaattctccctaattctccctgcctcagcctcccaagtagctgggattacaggcacctgccaccacactcgactaatttttgtatttttagtagagacacggttttgccatgttggccaggctggtctcaaattcctgacttcagttgatccgcctgcctcagcctcccaaagtgctgggattacaggcgtgacactcatcacccggcccagaacaccaaatttaaacactgtcaacacagaa

SEQ ID NO: 626553 - DNA, 263 bp, Homo sapiens
actgcgccagtcgtcgcgggatgcaaagcttcgctcgctagctgtaatatcttccacgagagagggctttctcaggacctagttgctactggttcagcaactgcgaaggatgtcctcccttatgggtacctcagttcctgccctatggcctgaagtcccagcattaatggcagcgccacatcttcgactttggtgctcccctttgcctaggccctatggcctcctgggcctctctactccccctgagtaaggtctggggatcc

SEQ ID NO: 626554 - DNA, 794 bp, Homo sapiens
  misc_feature (3)..(3): n is a, c, g, or t
  misc_feature (124)..(124): n is a, c, g, or t
  misc_feature (244)..(244): n is a, c, g, or t
  misc_feature (262)..(262): n is a, c, g, or t
  misc_feature (284)..(284): n is a, c, g, or t
  misc_feature (306)..(306): n is a, c, g, or t
  misc_feature (309)..(309): n is a, c, g, or t
  misc_feature (415)..(415): n is a, c, g, or t
  misc_feature (769)..(769): n is a, c, g, or t
aanataaacaaaaaccaaataacaggaaatcaaatacataatataatatcaacacaagaatacaaagaacacaacaaggaggaagaatgagaaaaaaggttcccagtatttagtcactagtgantccacagacattccttttagtgttttcaataggaataaaaacatgtcctgcgatggctctgcaagaatagagcagcctggaaaaggaggcaaagaaaagaaaatggacccaaagggaganaaagtgaagaagagaatncaggaaagtaatacatatgganacaaaacataagggctcccttnggngagagagaacataaccaatgaggggcaaaaaggaagaaatgagatcgtcccagatcaacctcaaaattgcacgggtagaaacaaaatagaaagtacccaatcaccnaagaagcagaacttttttcacagcattgtaataggaatggcagggcagagggaaaggaaagtagtgggagaacaacttgcttttaagataccctgggtgacaggtatcaaagccttgggcaaaacctgtcacagtaaagctgtgactctccaacttccttcacaaatgacaatatacataatagcagctttctattaaagaactacatgaactgaaaagaaatgtttatggaaaggggccagatacccaggcagcaaggcaatgaggatactaaacaagagttaagtgctttcaacctctctgctctacagatcaggttaaaaactctaaacccttcaactttaggtcaaagancagggcaaatacaaattaatgccat

SEQ ID NO: 626555 - DNA, 108 bp, Homo sapiens
tattggaacaacccctgagctacggaaagctctgctgtgatgggctaggccctttatatctgtgtgaatacagatttataaacaggttaataaacttatccaaggtca

SEQ ID NO: 626556 - DNA, 86 bp, Homo sapiens
  misc_feature (32)..(32): n is a, c, g, or t
  misc_feature (58)..(59): n is a, c, g, or t
  misc_feature (62)..(62): n is a, c, g, or t
aggcgccgggagcccgttcggttgcgggtgtntctggccctgcggtcagccctggganngtnccggtagagtttttttcctatagg

SEQ ID NO: 626557 - DNA, 102 bp, Homo sapiens
gatccgtacaatagcgtggttttccagtaaatattttcttctacggaaatggagccattattaagagtagtgtgttttttattatgtacatttgtatatttt

SEQ ID NO: 626558 - DNA, 958 bp, Homo sapiens
atcatgtcctacgtgccgagatgaacctaaacgtgttgctgctgaggcgtgtgcgtcgctgagctgcgcgagttcctgtgacaagtgcgcaggaagcaaggcaatagttatgggcatgaatacctcaacttggacccttatggcctgatatgcacagtcattccactcatttgaagtgaacatgcaatgtgtgaacaaaatgttcgacagcttaaagtgaaatcagtatatgccatggcaagcatgcatgttgcacagcacatcatcacatatttaattatttgtgtacatgcaccccaatgtgcgtaagcatggtattgcattgtgcatacatcaaatctgcgtatgcaaacagactgttgcctccatgttgcacaagcatcatggcactgcatgtgcgccgcacactgcaagcatgcatatatatccaatcatttcttgtgtatattggtatagacaccagctgacccgggtaaaaggcacatgtgatatatagtatacgactggcacaccacatggacgaggaggttataggcaggagggtggcatacgtttggggtgtgaggttcctatatagtaggagaaatccactaatataaattatacaaacaatggggtgacatgtggcatgattaacaaatggacattataaaagaatacattacccatatacccgcatatactggaaattggggggaggcattacctcctctacattaccccaatagtggaacacatccgatggaagatggtggattagaacaaataataccacaaaacaggacaggtaggaccataacacaccttagtgggaaggtgggtgttgggaaccccaatggacactgggaaggaccccattggtacaccacacagcgaacaaaggcacgaaaatggtgggtggtcttatggaattcggaatcccaccttaggacgagacagggcttacataggtaaattg

SEQ ID NO: 626559 - DNA, 151 bp, Homo sapiens
ccagcagagtagcagaaggtacatgctggataaagaaaatatgcaacaaatatagttgcttcctaatttcatttcatttgatttagtcatttaaattcatttcacattttaaaagctacgattcttacagctggttaaggaaacttaacac

SEQ ID NO: 626560 - DNA, 704 bp, Homo sapiens
  misc_feature (60)..(60): n is a, c, g, or t
  misc_feature (75)..(75): n is a, c, g, or t
  misc_feature (78)..(79): n is a, c, g, or t
  misc_feature (81)..(81): n is a, c, g, or t
  misc_feature (90)..(90): n is a, c, g, or t
  misc_feature (107)..(107): n is a, c, g, or t
  misc_feature (112)..(113): n is a, c, g, or t
  misc_feature (119)..(119): n is a, c, g, or t
  misc_feature (121)..(121): n is a, c, g, or t
  misc_feature (127)..(127): n is a, c, g, or t
  misc_feature (137)..(137): n is a, c, g, or t
  misc_feature (140)..(140): n is a, c, g, or t
  misc_feature (155)..(156): n is a, c, g, or t
  misc_feature (160)..(160): n is a, c, g, or t
  misc_feature (164)..(164): n is a, c, g, or t
  misc_feature (167)..(167): n is a, c, g, or t
  misc_feature (173)..(175): n is a, c, g, or t
  misc_feature (191)..(191): n is a, c, g, or t
  misc_feature (218)..(218): n is a, c, g, or t
  misc_feature (251)..(251): n is a, c, g, or t
  misc_feature (261)..(261): n is a, c, g, or t
  misc_feature (264)..(264): n is a, c, g, or t
  misc_feature (273)..(274): n is a, c, g, or t
  misc_feature (290)..(290): n is a, c, g, or t
  misc_feature (292)..(293): n is a, c, g, or t
  misc_feature (299)..(300): n is a, c, g, or t
  misc_feature (303)..(303): n is a, c, g, or t
  misc_feature (307)..(309): n is a, c, g, or t
  misc_feature (311)..(312): n is a, c, g, or t
  misc_feature (315)..(315): n is a, c, g, or t
  misc_feature (324)..(324): n is a, c, g, or t
  misc_feature (332)..(332): n is a, c, g, or t
  misc_feature (343)..(343): n is a, c, g, or t
  misc_feature (350)..(351): n is a, c, g, or t
  misc_feature (353)..(353): n is a, c, g, or t
  misc_feature (357)..(357): n is a, c, g, or t
  misc_feature (359)..(360): n is a, c, g, or t
  misc_feature (364)..(364): n is a, c, g, or t
  misc_feature (372)..(372): n is a, c, g, or t
  misc_feature (374)..(374): n is a, c, g, or t
  misc_feature (381)..(381): n is a, c, g, or t
  misc_feature (393)..(395): n is a, c, g, or t
  misc_feature (397)..(397): n is a, c, g, or t
  misc_feature (404)..(404): n is a, c, g, or t
  misc_feature (411)..(413): n is a, c, g, or t
  misc_feature (424)..(424): n is a, c, g, or t
  misc_feature (429)..(429): n is a, c, g, or t
  misc_feature (434)..(436): n is a, c, g, or t
  misc_feature (439)..(439): n is a, c, g, or t
  misc_feature (444)..(444): n is a, c, g, or t
  misc_feature (454)..(454): n is a, c, g, or t
  misc_feature (457)..(459): n is a, c, g, or t
  misc_feature (463)..(463): n is a, c, g, or t
  misc_feature (467)..(467): n is a, c, g, or t
  misc_feature (472)..(472): n is a, c, g, or t
  misc_feature (474)..(474): n is a, c, g, or t
  misc_feature (486)..(487): n is a, c, g, or t
  misc_feature (489)..(489): n is a, c, g, or t
  misc_feature (497)..(497): n is a, c, g, or t
  misc_feature (499)..(499): n is a, c, g, or t
  misc_feature (502)..(502): n is a, c, g, or t
  misc_feature (504)..(505): n is a, c, g, or t
  misc_feature (510)..(510): n is a, c, g, or t
  misc_feature (519)..(519): n is a, c, g, or t
  misc_feature (523)..(524): n is a, c, g, or t
  misc_feature (528)..(528): n is a, c, g, or t
  misc_feature (530)..(532): n is a, c, g, or t
  misc_feature (542)..(542): n is a, c, g, or t
  misc_feature (550)..(552): n is a, c, g, or t
  misc_feature (557)..(558): n is a, c, g, or t
  misc_feature (562)..(563): n is a, c, g, or t
  misc_feature (569)..(569): n is a, c, g, or t
  misc_feature (573)..(573): n is a, c, g, or t
  misc_feature (581)..(581): n is a, c, g, or t
  misc_feature (584)..(585): n is a, c, g, or t
  misc_feature (587)..(588): n is a, c, g, or t
  misc_feature (594)..(594): n is a, c, g, or t
  misc_feature (597)..(597): n is a, c, g, or t
  misc_feature (606)..(606): n is a, c, g, or t
  misc_feature (608)..(608): n is a, c, g, or t
  misc_feature (611)..(611): n is a, c, g, or t
  misc_feature (618)..(618): n is a, c, g, or t
  misc_feature (624)..(624): n is a, c, g, or t
  misc_feature (627)..(631): n is a, c, g, or t
  misc_feature (638)..(638): n is a, c, g, or t
  misc_feature (696)..(696): n is a, c, g, or t
ccgtccgcccactccgcggcgttcggggaaatggctgcgagaccctagaggcctgcgganttactccacgggaanagnntntagataatntgagttgttgaaaatangaagnntgttantngtgaanagtggctganaanagtgttgttgtgagnntggntgtntgnttggannnagaggtttcgtctgcnagggtttttggttgtatttaggatttnagggaaaagtgtccaagctttcagtgttggagnaggtatgganganaaaggcganncgagcaatgaggaggnanntaaggnnatnaaannnannagnaaagagttnaggaaaanatggggttttngaaggannantatngnnaagngagagggngnaggggangcggaggctgannnantggagcngaaaaannnaaagaagaagntgggnatgtnnntgnggcgnagtgggaggnagnnnaagngcantgagngngtggagcagttnntnaccattgngnggngnngcggnaggaggagnatgnntgtntnnntggaggattntggtgagnnnacgtnntgcnncgccanagangccgaganagnntnngagggnagngtggaaagngnttntgagaanagaagnggnnnnnagtatgnttaaaaagatgtgaaggaaagaaaagaatattatgaaaaggtgaaaggaggggatgancacgatga

SEQ ID NO: 626561 - DNA, 547 bp, Homo sapiens
  misc_feature (301)..(301): n is a, c, g, or t
  misc_feature (307)..(307): n is a, c, g, or t
  misc_feature (338)..(339): n is a, c, g, or t
  misc_feature (360)..(360): n is a, c, g, or t
ccccagacctaagcatactctgttaatatcatcaaagaaaaatgagaattatttatactagatacagattaaattggctaaaaactggtcagtgccaaaacaagtgtctttagtgaggccactcaagttatctcttgaaaaattattaatagaatgactgtgttaagtccaagtttaacacgttatatagttcatcaacatgcgtggatatagcccaatgcaatagaagcataacgctattcaatatacatttaatgtgctatcaacatctgtacacatagtcaaagattctgtgaactgnaaccanaaccaattcacataatatacatcatattttnnaacaaactacaaaagtatacnttgtaaaaatacactaaattaagttcatggaagtttataattactattaacaagtgaaaatagggtagtatgaatacatggtgctaatgtctttttaattatttatttttttaagaaatcctaagggaatggcggggtctctcaggaatatgtttcattggatttggagcatgtggggtaaggccgg

SEQ ID NO: 626562 - DNA, 302 bp, Homo sapiens
tgaggatccccaaccctgccacccacagctggacgagggtctgaacccagtttgtttttgttttttttgagatgcagtctcgctctgtcagccaggctggagtgcagtggcatgatctccggctcatagcaacctctgcctcccaggttcaagtgattctcctgcctcagtctcccaattagctgggactacaggcacaccccatcatgcctggctaattttttttgtatttttagcagagacggggtttcaccatgttggccaggctaggcttgaagtcccgacctcaagtgatccagcca

SEQ ID NO: 626563 - DNA, 113 bp, Homo sapiens
cctcaggaggttgaggcaggagaatcaattaagccctgaagttttaggtttctgtcaactgtgatcatgtccctgccctccagcctgagtgacagagtggtaccctgtttcca

SEQ ID NO: 626564 - DNA, 500 bp, Homo sapiens
gagccgacagcgccagactgttgcctggcgcgcattctcggcattttgcttgacggtagaggtgagtcttccatggaggacgcggtctgttccagcgagcttgcctgctcttcggtccgcgaggacaggtccatgttgccggcggcgatttcgcgcgaggcgctggcaatggcatcggtgccattgcgcacctggcctaccaggttcgccaggctgtcgcgcatttcgcgcagcgcatgcagcatgctggactggtcgccgggctttgtgtcgatggcaacggtcagatcgcctgctgcgatgcgatcggccagttccaccgcgtgggaaggttcgccgcccaactggcgtagcaggctgcgcgtgatcaggaaagcggcggccacgctcattaccagggcgatgccggccagcgccagcatcagattgcgcgtcttgccatattcgctggccgagtcgaagccgaacatgatgctttgcttgttgaccagtttggccat

SEQ ID NO: 626565 - DNA, 553 bp, Homo sapiens
accccctgagaaggacatcttcctacagtgatcacctcaccagcccagtgttgtggctttgtagcgcaccccgtatctaccatattctgggccagcctagtagcattacagtgttctagaatatggtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagttgtgctaaacacactgctttatttttacagcccacgtctttcatgaggatacgaattgttaagaggcagtctcgttttgcttttcaaa

SEQ ID NO: 626566 - DNA, 364 bp, Homo sapiens
tcatgaaatgccattaaaaaaaagcccagtaaagtccatgaataaaccagatatggagatatattttctgtagttattcattagtatgtgtttatgttttggggagagctcttattggtcataaagatgtggaagtcattaatctattaacaataactgaaaccacaagaatgactggccttaccaaatgtaaagatgcaaactggaatttaaggagtccacatctttcctacaatattattagacatgtatgcttgtattccagaattgcttaattcagaatgtccctttttagcttacatgtagttctccctggtagcaactttacgctttaatagcattgattcttagatttccatttgtt

SEQ ID NO: 626567 - DNA, 440 bp, Homo sapiens
agaaattatttgcaatctatccattggataagtagggattaatagctagaatatatgaggaactcaaacaacccaacaacaataacaaaaatctgattgaaaaatgagccagtgacctaagtgaacatttctcaaaagcagacattcaaatggcctgcagctgtacgaaaaaaatgctcaacatcaccaatcattagagaagtgcagatcaaaacccacagtgagataacttctcatcacagttaatgtggctattatccaaagaaagttataacagatactggcaaggatgcagagaaaggagaactctcatgtcaatgttggtgggaatgtaaattagtgtagccattatggaaggcaatatagaggttcctctaaaactaaaaatagaactactgtataatacagcagtcccactgctgggtatttgggtatgttgc

SEQ ID NO: 626568 - DNA, 1496 bp, Homo sapiens
gggaccctgaactccgggaaggctcgagaatggacacccagggcacatagatggctcaacactcagcaaaccgagacagcgtccgatgagtcagcagcagaagcattctgtgaatctcctcgtgtgtgcgaggcttggagaaggggagtgctgagcaatggaggaggcggtgggcgtcagggccatggccgtctggagcagcccgtgcataacctgcctgactcgtgatggcaccgtccaccgcctgtccacagacagagggacggctggtgacctggacgcgcctgtagacaagacagtgaacgagggcaagcagcgtggcagcgtccagagccatgcagcccaacaggggcaacaaagaagaaagatacgagaaaaacagagaaaaagaaaaaagcgaaacaataagaaactagcacagatcacgaggaacgaagacacaagacaataaacaggagccaagacaacagaaaacaacaccatagcagaaaaacagaaaaaaaaaacagcgcacaacacagccaagaacaatagccatagaccaaaacgaagaacagaaaatagacacaccagcaaacgagccaacataacaacaccgaaaaatgagaaacacaggcacgcaatcaaatccgagaaccccacaaagaggacaaagagcaacctgacaactccaacaaaaagaacatgaccaacaggaacaaaggatgcaaacgagacgaattcaacccccagcaggatcactaacactcacgcagcaacaaagcgaccaccaaaaacaccttccatgacacacgccacacggaccacaccatggacacaaccagagccgccaacccaaccaaactcacaatgagaccaacaagcgagcacacccgaactacacataaaccataaagacacaacatgcagaccacgacaacagaccacaaaaccttcgaactcaaactccacacaatttaagaacaaacgcaaatcgatccaaacacaagacaaaaccataaaaacacaatacataatatagacaacacaaatcatcacatatcccaaacacctacacgtaaatacaaacaccaataccatgttaacgcacaccataccataaatatacaaacaatcaataaaacactaataaacaaacaccaacatgaacaactactccataacatcacacaaatcaacaaaaaagaacaagacaactaccatacacccaaacataacaactcaaataactacactaaacaaattgacacacctacaacaaacattgaaccaacaaaaacaaacaacaaaccaaaaaaatcacaaacccaaaaaataccaaataaaacatacacccacaagcccatccaaataaaccataaccaaataatcctcacaactacaaaaaaaacaaaataatcaaaaaacacgcactcacaacaaccaccacatctaacatctaccacgaccacgaccatctaaatacacatagtaaacataaaaaaaatacactacta

SEQ ID NO: 626569 - DNA, 310 bp, Homo sapiens
tccactaagatacaggcaccgggatagcgtatttccacaagtaaatgtctcgggacatttaggactgtcatagctgattactagcactcacgaagctctaggggtagaagtcacagggtttaccagttgtatctactacaactttgctagcacagttataggagatctctttccaacttctgcagacttttgggtctgcaggggcctaattttcatgaggtcagccagcacagactggtccgacaatgtagaagaggcggtgtgcaatacagtttccatcgcgtgagtactgttatcacctgtattagag

SEQ ID NO: 626570 - DNA, 826 bp, Homo sapiens
  misc_feature (384)..(384): n is a, c, g, or t
  misc_feature (403)..(403): n is a, c, g, or t
  misc_feature (406)..(406): n is a, c, g, or t
  misc_feature (410)..(410): n is a, c, g, or t
  misc_feature (414)..(414): n is a, c, g, or t
  misc_feature (418)..(419): n is a, c, g, or t
  misc_feature (422)..(422): n is a, c, g, or t
  misc_feature (425)..(425): n is a, c, g, or t
  misc_feature (429)..(429): n is a, c, g, or t
  misc_feature (433)..(433): n is a, c, g, or t
  misc_feature (436)..(436): n is a, c, g, or t
  misc_feature (450)..(452): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (468)..(468): n is a, c, g, or t
  misc_feature (470)..(470): n is a, c, g, or t
  misc_feature (476)..(476): n is a, c, g, or t
  misc_feature (478)..(479): n is a, c, g, or t
  misc_feature (482)..(482): n is a, c, g, or t
  misc_feature (487)..(487): n is a, c, g, or t
  misc_feature (521)..(521): n is a, c, g, or t
  misc_feature (580)..(580): n is a, c, g, or t
  misc_feature (599)..(599): n is a, c, g, or t
  misc_feature (612)..(612): n is a, c, g, or t
  misc_feature (638)..(638): n is a, c, g, or t
  misc_feature (641)..(641): n is a, c, g, or t
  misc_feature (648)..(648): n is a, c, g, or t
  misc_feature (652)..(652): n is a, c, g, or t
  misc_feature (666)..(666): n is a, c, g, or t
  misc_feature (668)..(668): n is a, c, g, or t
gcctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggancctctcaggacatcaagcnctntgcncagncagnntanccntatngagnccncctgctgccgacgnnncagcagtnantgangncngctggncnncgntcccnctcagctgctgcctctgtgcctgtgtggcaggancgtaccattgcctcctcccggctgcggctcctggagtattcagccttcatggaggtgcngcgagacctgacacgtacngcaaacacctgtngtgcacatcggccagacgaaccccgnctnctcaganccanccctggaggcagtngntgtgcgccagatctatgacaaattccccgagaacaagggaggattgaaggagctctatgagaaggggccccatactgcatctccttgcaacgcactggcccgacctcacagaacacccaggaacggccccggaaccccaaacagaaacacccacacac

SEQ ID NO: 626571 - DNA, 170 bp, Homo sapiens
gatgcgaacatagtaccctgcagcctccaactcctagcctcaagtgatcctcctgtctcaacctcccaagtaggattacaagcatgcgccgacgatgcccagaatccagaactttgtctatccctctccccaacaacctagatgtgaaaacagaataaacttcccccaga

SEQ ID NO: 626572 - DNA, 383 bp, Homo sapiens
  misc_feature (6)..(7): n is a, c, g, or t
catatnncagagtgtatgtgaagagtataaaaagttagttgtggataatctgcttcagtgttattaaggtagagacgggttgtgaaaaaagccggataaagtattcagggaatgagtgtataaggagtatctaaatgattacgataatcagtgcttaagattgaaatctctcatgagatgactcaagatcagaaattactttggatgttggtagagttggcaaaatgacatatctatatctgcttggtcaggtttcactatctaatgtctattagtaaattaattatttttacaactagaaattcaactaagtatttaaaagctaaggatataggaagaattacagactgatagagaagatgggagaaaagaaagaacagaat

SEQ ID NO: 626573 - DNA, 166 bp, Homo sapiens
  misc_feature (25)..(25): n is a, c, g, or t
  misc_feature (31)..(31): n is a, c, g, or t
  misc_feature (33)..(34): n is a, c, g, or t
  misc_feature (37)..(37): n is a, c, g, or t
  misc_feature (39)..(41): n is a, c, g, or t
  misc_feature (57)..(57): n is a, c, g, or t
agggctcgggccgtagtaaggtcanctgctngnnagnannngatttagtgtagggcngaaggaggagctccagaagagcttaaacatcctgactgccttccagaagaaggggccgaggaagaggagcttaaaaaggctgtcatgtgattttgccagatctagtgta

SEQ ID NO: 626574 - DNA, 415 bp, Homo sapiens
caatatgcccccagaattcaaggacctttccattgtaagagaaaccaaacccctgcaaaagaagtgtgccgactatcaaataaatggtgaattcatctgcaaatgtggccaggcttggggaccaataatggtgcccaaaggcttagatttgccttgtctcaaaataaggaattttgtagtggttttcaaaaataattcaccaaagaaccaatccaaaaagtgggtagaattccctatcccatttcccatttttgcctattcagaatgctgtttattaagtaataaggataagcccttgattgaaaattcttttaaaaaacaaccagttaaccatttaaaaggataaggataaatgtattccataatgctacagaactgacataagaatcaataaaatgattgttttactctgaaa

SEQ ID NO: 626575 - DNA, 628 bp, Homo sapiens
  misc_feature (320)..(320): n is a, c, g, or t
  misc_feature (351)..(351): n is a, c, g, or t
  misc_feature (396)..(396): n is a, c, g, or t
gcgagtagtaggccgcgcgcgcgcgcgcgtgagagagaacagcaccactcgccgcagcgcgcgcgagagagcgcgcgcgctcgtcgtcgtatgaagagagagagagatagtatgtgtgtgtgcgcgcgcgcgcgtgcgcgctcagctgctgagaggccacacagtgcctccgcgcgagtgcgcgcccaccaccctgcttgctcgccctctctctctctccccctcttctctctgtggccccctctctctctctctctctctctctctctctcgccactctgctgctgtgtgagagacgaccacctgctctctgctgtggnccgcgcgtgtgggcgctttgtgtgcggcccnccccccacgcgcaccccgctgagacgctgagacaaagagcacacncctcccggagcccccggagaccttgaccccacccacccgcccaccacccccacctccccccccccgaccacaccccccgggtgttggagattttgttttcccccccagacaccacacaaagggtttttatagaacccccccccccccacacgaaatgagaccccccccgacgcgaaaccctaagagagagggggtcttgtccccccacaaaaaaaacacccctgccccggga

SEQ ID NO: 626576 - DNA, 106 bp, Homo sapiens
  misc_feature (13)..(13): n is a, c, g, or t
acccagccgcggntgaatggcgaaggcgaacaggaaacgatacaggcgcgacagcttgtcggcgaggggatcgcctgaacagattccacaccagctgggcgaacag

SEQ ID NO: 626577 - DNA, 1797 bp, Homo sapiens
  misc_feature (421)..(421): n is a, c, g, or t
  misc_feature (1797)..(1797): n is a, c, g, or t
ccatgtcattcggacttagcttctagatcttggagttcggctgtcccttttattcaataaaatgagaaacgacatctaatcgtaagaaagcaacacaatatgtaagcatatgacaagagcatcatgatgctttgcacatgacacgtattcatggatcataggcgacgagcgtgcgattgttagacctgttagttaccaggggctcttgaatgtagatgtgcctgaggcagttgtcctacttgaccagagacgggagtcaaacaaaccctaggttgctgcaagttctggaccgtgctctaggtcagttggcctttcgcagagacagtccccagaagcggctgtagcgcatacacaagattttgtacacgttcacctgtgtattcgtagcaattgctgcatttgggcgacactagggataatnatctgctagagtgcttgttctaggcctatggtcgtgaacggaaggtaggtgaacagggcgagatactatggacgcactacaaacccggactctatggataaattcaatcggtaactcttcgagctttccggtgtagcgcctcgttagtgcttagacagacggtgaccatccacccacgtggtggcacagccgcataatagcggtgtccccaaatgggccacatatgccgatagcacgacacgacagttgaaccacaaacacgaccataagcatccggaacgtggattgcacaccgctcaaccgcatggggtgccaacctgcacttgggaagtggatacccattctcaacaacagggcacacccctttacggagcaatatgccacgcggttccccataattgggcggcggttttaaccgggggcccaccttcccacttaacgaacacagagactgtggatttgaggccacgaggtaactttgccgagcaaaacacacactactcaccacacgcggcgccccaacagacacacttgtgcaaaccgggccaccttcgcatgtcgaatccaagtacaggtcctatggctacaccccgccaactatagaccagtggggggggacgcccacaccagattagggcttatcaccttcgaacgcgacacagtttataaccttcccaagatcgcgtgtgtggtcgcttgtgtggcatataacaacgagaagcacggttcgagatgtaaccccgcttgcctctatgtacagcgacaacacagcgcgcacaccagcacacacacttactagcgacgaacgcacctttccggacagcccacggcacagagcccgccacgtgcgcctggggcgaatgacaacaaagggatttctaggttcctagataggtcaacccccgtgcttgtcgcaaaatacaacaaccgccatagtgtccactatcattatgacgccgaagagaaagtactatatgcatatgctgaggaacagaaggcgccagattgccccccagcggtggacccgggcaaccgttggcctagtatgcgtgctgggaccgaacaatatcaccccctggcgaggcaacaacgatcggataataggcctaccccactaaccacccatcattttgaacagggacagtgcctataccggtcaaaaaggcacccaacaacacattttgaaaacgcacatggtgttagaaatgtacaagcagctcatacaccacacaacacggcatgcaacattagtatcagggcgctatctcggtaaccacacgacccaaactatttagcacgagacatcctatgaagaagaagacacgcatatagaccgatacacgagaagccgacaaatactcatctcacgggacggn

SEQ ID NO: 626578 - DNA, 175 bp, Homo sapiens
tctagaggaccccatcaggcgacagagtgtgcacagagggccacgacaggtctgcgcgtgtgtgtggatgatcagcttgtactcctccgcctctggcatattgtgaggtaggacactgagggcgcgcaggtctcttccggcttcagcatggacctgaccacagtcttcgcctgat

SEQ ID NO: 626579 - DNA, 153 bp, Homo sapiens
ttatactccacaaacagaaagactaaggattaaaactggaattcataggaaaatataaatgacctgagtcttaactttaattaactgttagcaaatactggccgggtatggtggctcacgcctgtaaccccagctgtttgtggaggtagcact

SEQ ID NO: 626580 - DNA, 198 bp, Homo sapiens
atgtcattttaatcccatgagaaggggtgttcaaagattgtcgcgaagttcactgttaaagtgagctgaatagtcatcaataattctggagaataggcagatatgccagtgatgaagaacaaaagaattcagccttttttttttttttttttttaaaggtttttaaccccttttttttgggaaccagtatttcaaccg

SEQ ID NO: 626581 - DNA, 178 bp, Homo sapiens
ggttgatctcacagctcgctcgcaagcaggcgggtaggtgggtccaacagtcactgtcaccccacacttcttccatccatgtcgtctcactttcttggccgggtgggcaggcccccacacgggccatcttgcagggtcacgcagctcgcaattcgtcaatccatggtccatcagcgtg

SEQ ID NO: 626582 - DNA, 328 bp, Homo sapiens
ggtcaggttggcgaaatctttggctcactgcaacccttcggcctcccagaattcacttcctttcctcagactttcccggggtaagctaggggacttcaagggggttcaaccaaccacggcccaagcttgattttttgttattttttgagtggggagggagggggtttcaaatcaccctagtttgggccgggatagtgtctcaaatctctatcaaccccaaagatcttttaccaccccgaaacctgcccaaaaggcttggggattacaagaagggtgagaacaatttccccccacaaaatctactattattattaaaaattgtcaaaaa

SEQ ID NO: 626583 - DNA, 135 bp, Homo sapiens
agccccttcagatgtccctcagacttccatctgatgaccctttttacaatgtcaggcttctgttgatattcaatatactctgactttccttggatatcagcattggctgcaaatcttgcttggattggaaacctc

SEQ ID NO: 626584 - DNA, 937 bp, Homo sapiens
gaggagctttggctatctgcaggcagcgccagggcagtagggtgtggcatggacgtagagcaagattaatgcgagctcatatcctgtgttcttcgtctcgccggcgcggaccatcataggttccttcaatgtttgccttaatctgctgttgcctgtcccaggacctgggctccacctgtcttcaatctaagtcttagaagaagggccaacttgtggctccgtgtacacgcatgtgtctgaggtcttcttagatacgatgtcttgtcattggtagcgctgtgggcagtaagatcctgtataacgacatatgccgacgatgtgggattgcgaggagaattccctactcatgttcctaccgatggaagactgcctaaatgatctgtgggtcaggtctaagagctgtggtgccttgcacgtccagtcatcctagggatatggagaatctaggatggtggttgcaggatgccatggaaacaatatgatgctaataggttcgttctactaggtctatactatggagtagtcaggagtatagatgataggtgataatgggcatgtattgacagtaatatctctgtggatggtcttggcaggatgcattttagaacctgtcatatgggttttacggttgaaaatgtaggctgatttggcatgtgatgtgtggtcactgatcactgactaggtctggccggttcggtccctataatccggatccgagagatgcccttgataaggcgtggtcatattggtgtaacgagatggtgccacttttggggttaaccgcacaaggaggcctatggggtttcacagcctgatttttcttcccagggagctctaaaaccctgtccgtctaagcttattctctcgctggacggaaagtacccctcaaggtccgatttgaggtggcctcttaaacccatcggagggacttacaatg

SEQ ID NO: 626585 - DNA, 323 bp, Homo sapiens
cttctcctgctttatttggctatcttggcaaaacccctccctggttaaattcactccaaacatacacccctgcagctgaatatggctggaggaaataaaccatactgaccaatctcactttaaatttataaccacagaggccgggcacagtagctcacgcctgtaatcccagcactttgggaggccaaggcgggcagatcacctgagaggtcaggagtttgagaccagcctggccaacaaggtgaaaccccgtctctactaaaaatacaaaaattagttgggcatggtggcgcacgcctgtaatcccagctactgggaggctg

SEQ ID NO: 626586 - DNA, 787 bp, Homo sapiens
ttttctgttgcattgtgtgtaccaggtggtctagaggaataattaaacattttagaactattaacaggtaaagtactgaaatgggtacaacttacggaaaacaagaatgtcgtcttctaactctgacattataccttgtttgtacccgccagcgggaagcttcatggctggccgtgtgtcaccctgaccacgtctatctctgggggtcgcacgttgctgggcagagcgcagggatacaccagaaaacgctgtcctgtggtatggtctcttccaagcttcatgtaccagtcgtaaagattaggagtggaaaacttcagactttggcttgtcattgtttaatctgtgttcggagagttaagtgtctgaaactttaacttaaatggtttttttacaggagttaaagtacgtagatgcctttttacagcttaatcatttggtcttctgttgagtgtgtatttcaagtgtggagcctcatttgaagtgttcattctttgaagatttaatgctttgttttgtcttttaatagctaatagtgaaatctacaaacaaaaaagaattctacatctgggatttgattgacgtgatcatatggcccgatcaatttatgttcttgtaataaacttcttagaaatgtggcgtcgggataagcatttgactgggtgatagagaatgtgctaggagaacttgagttagatagttgacttggaatgggaagggtggttccagatctgcgaggaaatgagtatgggatgggacccaggggttttgttcaagtttcccaaatgtt

SEQ ID NO: 626587 - DNA, 1049 bp, Homo sapiens
gagacgttcttcgccgaagagtcgtcggggtttcctgcttcaacagtgcttggacgtgaacccgtgcgcatcgttccccagaccgggcggacagcccatagccagcccatcacgtcatctcgttcaccgcaccctcaggacagccccaaggtccccggtcgccgctccgagctgaccgcgcatgagcaggcagcccagccggcccggcacatccgtcctccttatagttcaggccgaccagtgaagcgactcgcggtccaacactccgcaagggtgcggcccagcaagctacacacacagggaactccagagggcggccatcaaatgcggacagcatgcaaagcgtggtaagtctctcacggccgtaccctttcgggtcataccctggttcgcgatggtgctatatcctatctttgtggacccgcgaattgagtaggtggctgtgcgaaagcaactttggtcccttaattaccgtttcctttcacacgacatgctccgtgaagggcagtaggggaaacatttgctgtgagaaagacttgaatgaaaggtcgtgtgaaaactaaagagaggttggggcaggaatttttgccggtgtcagggattagtcaagagaaaacacacgagacgtgatgaatggaggagtgggaagaaggagggggtactgaaatggcaattggtgcaggtggctgccccttcaccatttctgggaacaacaaactggtgcaaattcaggtcaacttacttgggaacctggcaggcatacttgggagcccattggacgccaatacttgaaaccccccaattcagtggtgcaccttccatctggagaaacacctgtcggctggcactgagggcagtggttgatgcagccgactctgacaggacatgtggcgagtggacccacgttgaacccaggctatggcggcacgtgactggggaagcacgccgccgacaggcgatgggcgttgagcggacaaataaatctccgttggaaagcggcccgcaccgcctgtggaagaacagaggattaactgcggcagtcctacagc

SEQ ID NO: 626588 - DNA, 361 bp, Homo sapiens
  misc_feature (309)..(309): n is a, c, g, or t
  misc_feature (320)..(320): n is a, c, g, or t
cccagtctaggatatgtctttattagtagcgtgatacaccctaatatcaaagccagatcaaaaaaactacaagcagctgggtgcagtggctcatgcctgcaatcccagcactttggaaggccaaggtgggcagattgcttgaggccaggagttcaagaccagcatggccaacatggtgaaactccatctctgctaaagataacggaaattgaccgagtatggtggcgtgcacctgaaatctcaactactgaggaggctggggcaggagaatcgcctgagcccgggaggcaggggttgcagtgagccagngatggtgccanctgcactcacaccctgggcgatagagcgagactctgtctca

SEQ ID NO: 626589 - DNA, 648 bp, Homo sapiens
ggccctgaaaatttacgggttcgtcgtgagaactggcatcgtgccgaagcgtcagcgtcagctcgtggcggggggacccacaggggtgcgatgagcacgtcgacgtagttctggtcactgtgtgactcttagtgtcgtgggtgaagatgagagctcgtcgctgtgtcgcccacagggctggaactgtattgccgcgatctctcgactcactgtgaatccttcttcctcccggcgcttaagagcgcattctccatggcctcacgcctctagagtaggcttgagattacatggcatgcatccaacacgcccggctaatttaatgtgatttccagtagagacggggtttcgcgcactattggaccagcagtggtctcgaactcattacctcaggtgatccaccagcctcggtctcccgaagtgctgggattgcaggcgtcatgcaacgctgtgcggccgaatttgggtctgtactaaatgcttgcttgtaaaaggggttcctctgttcccttttagggactctcagatttctttggctcagaatggaaagaaaccagagtctgatttctgccccttctgaactctactacttttaaaacgaaagaatatctacattgcagggtcagttaaaaaaattttttgagttataag

SEQ ID NO: 626590 - DNA, 130 bp, Homo sapiens
tgtggagacgggttccttggatggtgcatgggcgagagcacacgggaacaagggaggggaatggtgttcttatccctgatgcaggtaccccctactgcggtgtctgttcccctatgggctaggtgtggga

SEQ ID NO: 626591 - DNA, 470 bp, Homo sapiens
  misc_feature (7)..(7): n is a, c, g, or t
  misc_feature (76)..(77): n is a, c, g, or t
  misc_feature (134)..(134): n is a, c, g, or t
  misc_feature (465)..(465): n is a, c, g, or t
  misc_feature (468)..(469): n is a, c, g, or t
cccggtnagaatatgtttggcctgcctttcctctcctaagcctacagagagaagttaaattgtttggtcccctccnnctttgaatgcattttgcctgtgtcaggagtagtttgcggaagaaaatcctgatcctnggtagacagtgattccaggctttgggggttcccccctagctgctttcccctacaggtggctacacaacagggtgctgacagattgctgcagagtcacctgcttgacccctccctgagtgatggcgacccacagccggcctttctacttctgtgaggcataaaataatttttcggaacagcattattctagctgagatataaaattataataaaaatgtatgaaattttagaatgggaactgtgaaaactagacacttagatgttctagctagactaaattgaatatgttggctatagctgctgctgaattatttggaaattatcaactgcntcnna

SEQ ID NO: 626592 - DNA, 390 bp, Homo sapiens
  misc_feature (381)..(381): n is a, c, g, or t
  misc_feature (386)..(386): n is a, c, g, or t
tggctgctcttagagataatagatgacaaatgtttcctattcagatcttcaaaaggtgttagacttttagttaatccgtttaggattgggagggcctggaagaaaaacatctagctatgttaatagatgttctttacagatgcacattttaccccacaaaggatagcttttgggggaaaatgctgtcctttatggaagaaattgcaaaatagggcaaggaaacatgttttggggtaaaatattttgactttctttttgtcacgtaatgttatgccagagtcagaatgggaaagtaagtcatcatatatagggattaaataaaaccccatctggatgaggatttatgggtttgtagggtcctgactcccccaggtccccttngggtngggg

SEQ ID NO: 626593 - DNA, 347 bp, Homo sapiens
cagctccagaggatcccccaacgctgctcacaggagagtgtgtgtgtgagagtgtatatgagagtgtgtgagtgtgagagagtgtgtgtgagacgagtgtgtgcatgtgagtgtaagagagtgtgagagtgtgagagaatgtgtgtgagtgtgcatgtagtgtgtgtaagagagtgtgtgagagtgtgtgtgagactgtgagagagtatgtatatgagagtgtgtgagtgcgtgtgagagagagtgtgtgtgagtgtgtgagagagtatgtgagagtgtgtgagcgtgtgagagtgtgtgtgagactgtgagagagtatgtatatgagagtgtgtgagcagcgttgg

SEQ ID NO: 626594 - DNA, 451 bp, Homo sapiens
gggaaggtggaggttgcagtgagccaagattgcgtcattgcactccagcctgggcaacaagagtgaaactccatctcaaaaaaaaaaaaaaaaagaaaaaggaaaaaaaaaaccttagcctttgaatagttggacaaatatttattttatctccatctacaggccctttgtttattttttatttataggatgggcctaaaacccgactatatttctccctagtgttgtaggtacattttgttggcctgtgatgggctctttaaggtctttaccccagaagaagccgtgaacttcatctagtcctgtctcgaggtgagaaaactcacacgggggtggtgggtgcaccaatcgtgtcataattttgagagaagtagaattttttggaccacaattactcccattgagggacaaccaatgggcgctttatcaaagggaattatgccaacagatt

SEQ ID NO: 626595 - DNA, 302 bp, Homo sapiens
tgggcagactaagccaattatccagaaaaagctaaaactacaaagaagattgtgctaaggcttagtgcattaagcccagaccaaccgcagatctaagagaatgctagctatcaaaagatgcaagcattttgaactggaaggtggtaagaagagacacggccaagtaatacggttctaagtgtctttttttttttttttttttttttttttttttttttgagacgagtctcgctctgttgcccaggctggagggcagtggcaatctcggctcactgcagcctctacttcccagggagcactaa

SEQ ID NO: 626596 - DNA, 120 bp, Homo sapiens
aggatggcatagtaatagggcacggacgctcctagttagtaggggcggatcggactattataccctagccaaccccttacacacccctccccacatcacgcccgaatgatatttcctatt

SEQ ID NO: 626597 - DNA, 112 bp, Homo sapiens
gatgatgttctaaaagatggcagctttgagaaaacacatcttgtgaaagtgttaaaacccctgcttctctaaggcctaaattaggctgctccaaccagctttacagggaatg

SEQ ID NO: 626598 - DNA, 475 bp, Homo sapiens
  misc_feature (146)..(146): n is a, c, g, or t
  misc_feature (239)..(239): n is a, c, g, or t
  misc_feature (262)..(262): n is a, c, g, or t
  misc_feature (273)..(273): n is a, c, g, or t
  misc_feature (314)..(314): n is a, c, g, or t
  misc_feature (317)..(317): n is a, c, g, or t
  misc_feature (331)..(331): n is a, c, g, or t
  misc_feature (344)..(344): n is a, c, g, or t
  misc_feature (352)..(352): n is a, c, g, or t
  misc_feature (355)..(355): n is a, c, g, or t
  misc_feature (362)..(362): n is a, c, g, or t
  misc_feature (375)..(375): n is a, c, g, or t
gggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctntgtccatcaaggctcggaaaactatccagtgccatgtctgctgcaaaagccatctgtgaccacgtcagggacatctggtttggaaccccagangagaagtttgtggccatgggtgntaaccccgatngcaactcctatggtggtcctgatgatctgctccactcattnccnggttgtaatccagnattaagacctggnaagtttgntgnaagtccncctaattaatganttctcacgtgagaagatggatcttactgcaaaggaactgacagaagaaaaagaaagtgcttttgaatttctttcctctgcctgactagacaatgatgttc

SEQ ID NO: 626599 - DNA, 592 bp, Homo sapiens
tccaaaaacgatgcagtcacagtcaactaacactgagcttgctgggcatctcctgaacagaaatgtatgtggtggtccatgtagcatgtatgcgatataattggccacccacctttccttttcacattaacatttatcacagaaacacattcatttgctacagggatatttcacaatttggctgaactttgagagaagtgggtgaggaaaaggtagtttcgtaactagtttatatataaacctaaattgtagtgagtactcttgtaagtggagcatcttttctatggtaattataaatggctgttagcccctttgcactaaagctaggtgggtggttttgccacagaggtaaattatctttcgggcggtataaccaaacaaataaaatataaagtgagattcagggcatgttctgaatacagcagttaattaggcagctaagaaaactgtattttagcccctctatgtgattggtatttttttaaattaaacaaatggaaaataatatttttaacaggttatgatatgtcagtcatttaatcctcacagtaactctgtggggtaggtaggtactgtttctatctcattttac

SEQ ID NO: 626600 - DNA, 508 bp, Homo sapiens
gctccagcaggataggtgaacgcatcacaggttcgtatctcggatcaaagtaagtagcgagtcacgatggcggagcacagtcccgtcatcgtgcggactggagcagaaggatggaatgtgctggggtgcgcagaagcccatagcaagtagcttcagcgggaaacctgttctcaatccggttccggtgacacccaccgcgaaaagaattttgcacagtgtccatggaactctagattaagagaaatactttgtcttgtggacccctgcacacgtggtcgtccacactacacttggcagccaggcagacttgtggggaactttgttctattcctccagcaaggcatcgtcgcagagccgtcccagtgtgtagaaagtggttggcggttgcccgtcgcagcccccggtacaggcaacgtggcgggagctctggcgtgtacgctgtcgtagtgagtaacggacgaaggtagggcccggcaggggtccgtagatctagggagcaggacgacag

SEQ ID NO: 626601 - DNA, 397 bp, Homo sapiens
caggtggggttggcccaaagcagttccccagcttgtcctttcaggtcctttggacactttcccccccacaaataaccctgggcctttacaggttccacacccccatccccccctaggaaaggacatcggactggaggtcaggggcctaggattcaagtcccagctttgccgacagctaccagtgtatttttgggcaagtccctgaacctctttgggtcctgattcccttacctgtaaaaaagtgataatcataaggccctctgcattgctttaaggatcaaaataaagcttgtgaaagttttccctggactttaaagtgtgattaatatatattttttatcctggaatttcctatttcctttgagtcctgttaaataaaccataatgtgaatggtta

SEQ ID NO: 626602 - DNA, 837 bp, Homo sapiens
  misc_feature (95)..(95): n is a, c, g, or t
  misc_feature (461)..(461): n is a, c, g, or t
gctgtaatcccagcatttgggaggctgaggtgggaggatcacttgagcccaggaatggagacccgcctgagcaacatagtgagacttcctctctncaaaaaataaacaaaattagtggggtgttctggcacgtgcctgtagtcccaactactcgggagactgaggtgagaggataacttgtacccaggaggtcaaggctggagttagccaggatagtgccactgcattccagcctgggaaacatagcgacactctgtctccaaacaaaataaaaaataaaatgtcattaatcaatttgcatttttgctgacagtctagttataatagctgttttaccgttcccataccccacttcactattaatcagtgttacttatagacatgtaatgaaatcagaaaccaagctctgcttctctaacagccttaaatcttcatcacaaaattaagcaaacagaacagcnagtatttcaagacatactatatcattttccttactaggaatctggattttatgtatataaatttatatttgtatttcatttcctcacttttttctgtttgcaaaaaacattacaggtgtgagccaccgcacccggccattttttctttaaaaaatactaaatacactttgttagagggctgagcgcagtgagactttgggagaccaaggtgggagaatcacttgagaccaggagttaaagaccagactggccgggcatgatggctcatgcctgtaatcccagcactttggggagggccaaggcaggcagatcacgaggtcagagatggagaccatcctgggcaacatgggaaaccctgtctcaactaaaaatacca

SEQ ID NO: 626603 - DNA, 182 bp, Homo sapiens
ataggatcccctgttctgctatgtgggtgtgtgtgtgggtgtgtctgtgctgtctaatgtctgcctatgtgtctcgtgatgtgtgggtgtgtctgtatatcaatgtctgcctaatttgctatcctgcattctcgcccccgcccagggctcttgagtgcagggggtaccgagactcgcaattc

SEQ ID NO: 626604 - DNA, 673 bp, Homo sapiens
agagtatgaactttgtctcccctcaaagaaacccaggttagcagttgctccccatttcttctacctgtagccacgaatctactttctgtctctatggatttgtctattctggacatttcatataagtggagtcatacaagatacggccttttgtgtccgacctctttcatttagcataacgttttcaagtgccagccgtgttgtcacatctatcagtatttcgttcttttttattgccaaacatcctattctaaggatatatcctgtttgtttatccagtcataagttgatggagcttatgatggttttcactttttggcttttaagaataatgcagttatgaacattcatgtacgagttttagtgtggacatcatatgtttacatttttcttgggtatgtacctaggagaattgttgaattaacgtggtaactctatgtttaactccctgaggtgctgtcacactgctttccacagtagctgtaccattttacatgcccaccagcaatgtatggaggttataatacctacacatcctcaccgacacctgttattgtctgtctgtcttttgacagccattttagtgagtgaaacgggatgtttagtaggttggatttgcattttcttattactatgatgttagtggttcaatgctataggtattgatatctct

SEQ ID NO: 626605 - DNA, 258 bp, Homo sapiens
  misc_feature (51)..(51): n is a, c, g, or t
ctccccaggatgaggaattgcttgaacctgggaggtggaggttgccgtgancccagatcaacccactgcactcccgcctgggccaccgagcgagactctgtctgaaaaaaaaaaaaaaagaaaaaaaggaatttacatagttgaacaactattctttggacatcttttagtccagtagacggtgttaaacttgaagacaataacgattgacctgtgatatttgtttttccctcttatctctaagcccatgtcaatcca

SEQ ID NO: 626606 - DNA, 192 bp, Homo sapiens
  misc_feature (71)..(71): n is a, c, g, or t
gaaaaagtagtgcaaatatttagggtaggagggtgagaaagcaaagaagtcgcacaaatattgtggttttntagttgaacaactattctttggacatcttttagtccagtagacggtgttaaacttgaagacaataacgattgacctgtgatatttgtttttccctcttatctctaagcccatgtcaatcca

SEQ ID NO: 626607 - DNA, 872 bp, Homo sapiens
ggtgagccatctcaccagccccacgagagcttctttaaatggggagttctgagggagtgtgatggtccacatatgtaaccccaggactagggaagcaaagaatggatccttgagcagccaaagccagttgaggctacagacagaaccttatctcaaaacaagaactaattggggaaactcaactccagtgtgttggtgaccatttatagctctagtacccagctgaaccaggttaaggtccaggccagcacatgtggttatgtttcagaacaccaaaaataagtaaatgtattgcaaagtccagcagggatttccttataatctactgctatctagtgttttcatggtactttttatcaatataccctccaacttctgtagtgaacagagcacactaaagatgtgatggctgggttatggcgctgtaggcctctagtcccaggtgtttagaaggctgaggcaggaggactgctaggctcagaggtcaagagggcgtatgatcctgcataactggagtcacagaatgttgtgagtgtccatatggatgcgtaaatataggtgtttaaagatcagctagtgcactgcacctctgagccgtttctccagctccatcataggatttttgattagtgaattacagatagataaaaacttactattgagggtaatgagttgctgtggtgggtaagggggaaggggaaggaggggtgggatggaggcggggtctttggatcggcgggttctcgggaaaaggggggttaaatcacaaaatttggcgggtctgactgagaggggagaaagggaggatgacaatgtgatgcctttagaagggaaaaaggggggtagaaaaatggcggaacaaagggaccagt

SEQ ID NO: 626608 - DNA, 243 bp, Homo sapiens
aactggtccggtacacacgacatagtgcaatcataaagagtatgcgactaacgaacttatcatggacatttacagggctacggtcgcaaacctcctggatgcgttataatcatgtgaagcccatgaaccccatgcactcagctcaaaatatgcctatttatatttaccctcagtttcttatacctctgcacacacacacacaatatatatatatacacatatcccagctgaaatactttcaat

SEQ ID NO: 626609 - DNA, 92 bp, Homo sapiens
gtcttgtgtgttatggggagagggtcagaaatagacttaaagcattaaatgcttttttaagaaaaagttttgatgtgtcatcctccatagtt

SEQ ID NO: 626610 - DNA, 948 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (11)..(11): n is a, c, g, or t
  misc_feature (15)..(15): n is a, c, g, or t
  misc_feature (21)..(21): n is a, c, g, or t
  misc_feature (25)..(25): n is a, c, g, or t
  misc_feature (27)..(27): n is a, c, g, or t
  misc_feature (30)..(30): n is a, c, g, or t
  misc_feature (32)..(33): n is a, c, g, or t
  misc_feature (36)..(36): n is a, c, g, or t
  misc_feature (44)..(44): n is a, c, g, or t
  misc_feature (48)..(48): n is a, c, g, or t
  misc_feature (66)..(66): n is a, c, g, or t
  misc_feature (69)..(69): n is a, c, g, or t
  misc_feature (73)..(73): n is a, c, g, or t
  misc_feature (75)..(75): n is a, c, g, or t
  misc_feature (77)..(77): n is a, c, g, or t
  misc_feature (81)..(81): n is a, c, g, or t
  misc_feature (85)..(85): n is a, c, g, or t
  misc_feature (87)..(87): n is a, c, g, or t
  misc_feature (91)..(92): n is a, c, g, or t
  misc_feature (96)..(96): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (120)..(120): n is a, c, g, or t
  misc_feature (123)..(123): n is a, c, g, or t
  misc_feature (125)..(125): n is a, c, g, or t
  misc_feature (133)..(133): n is a, c, g, or t
  misc_feature (135)..(135): n is a, c, g, or t
  misc_feature (137)..(137): n is a, c, g, or t
  misc_feature (141)..(142): n is a, c, g, or t
  misc_feature (144)..(144): n is a, c, g, or t
  misc_feature (150)..(150): n is a, c, g, or t
  misc_feature (164)..(164): n is a, c, g, or t
  misc_feature (172)..(172): n is a, c, g, or t
  misc_feature (184)..(184): n is a, c, g, or t
  misc_feature (188)..(188): n is a, c, g, or t
  misc_feature (194)..(194): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (234)..(234): n is a, c, g, or t
  misc_feature (244)..(244): n is a, c, g, or t
  misc_feature (248)..(248): n is a, c, g, or t
  misc_feature (251)..(251): n is a, c, g, or t
  misc_feature (254)..(254): n is a, c, g, or t
  misc_feature (262)..(262): n is a, c, g, or t
  misc_feature (276)..(276): n is a, c, g, or t
  misc_feature (284)..(284): n is a, c, g, or t
  misc_feature (286)..(286): n is a, c, g, or t
  misc_feature (293)..(293): n is a, c, g, or t
  misc_feature (303)..(303): n is a, c, g, or t
  misc_feature (305)..(305): n is a, c, g, or t
  misc_feature (307)..(307): n is a, c, g, or t
  misc_feature (314)..(315): n is a, c, g, or t
  misc_feature (320)..(320): n is a, c, g, or t
  misc_feature (324)..(324): n is a, c, g, or t
  misc_feature (329)..(329): n is a, c, g, or t
  misc_feature (340)..(340): n is a, c, g, or t
  misc_feature (342)..(342): n is a, c, g, or t
  misc_feature (364)..(364): n is a, c, g, or t
  misc_feature (371)..(371): n is a, c, g, or t
  misc_feature (373)..(373): n is a, c, g, or t
  misc_feature (376)..(376): n is a, c, g, or t
  misc_feature (381)..(381): n is a, c, g, or t
  misc_feature (411)..(411): n is a, c, g, or t
  misc_feature (419)..(419): n is a, c, g, or t
  misc_feature (421)..(421): n is a, c, g, or t
  misc_feature (431)..(431): n is a, c, g, or t
  misc_feature (447)..(448): n is a, c, g, or t
  misc_feature (452)..(452): n is a, c, g, or t
  misc_feature (464)..(464): n is a, c, g, or t
  misc_feature (467)..(467): n is a, c, g, or t
  misc_feature (469)..(469): n is a, c, g, or t
  misc_feature (473)..(473): n is a, c, g, or t
  misc_feature (475)..(475): n is a, c, g, or t
  misc_feature (487)..(487): n is a, c, g, or t
  misc_feature (497)..(497): n is a, c, g, or t
  misc_feature (506)..(506): n is a, c, g, or t
  misc_feature (558)..(558): n is a, c, g, or t
  misc_feature (564)..(564): n is a, c, g, or t
  misc_feature (651)..(651): n is a, c, g, or t
  misc_feature (710)..(710): n is a, c, g, or t
  misc_feature (732)..(732): n is a, c, g, or t
  misc_feature (836)..(836): n is a, c, g, or t
  misc_feature (887)..(887): n is a, c, g, or t
  misc_feature (943)..(943): n is a, c, g, or t
nanggntttcntttnaatggnaatnanttnannaanttgaaacnaaanaaaaaagcagtaaaaaancanaaantnanaagnaaananaaannaaanangnaaanttctgttcaaaaaggncanangtgcaggnanangaannanaagcgngcatctaggattanggccaaantgttttaaaaangcanaaaagnaaaaananancttgaaaaaaagaagagaggggcnanananttcaaaaaanaaangtngcntaaaccanagaagtatgaaaancacgggantnaagtganaagcagtaanancncaaaaannaaaantggncaaanaaaaagggaananttttgcatttcactgaaaaaanattgacnanaanaaaangaaaacaagcaggaacccagggaaaaaaantacaaaancnaaagccaaanacttaaaatttcttannaccnaaacaacagcanganantaananaaaactgcaccngcatttcaantgccaaacncacgttaattaagttccccaaaaaagaaatgcaaccaaaacgggttcaaacnccaaangaaagtctgcaaggctcagattaaaacatggaatgtttcagatgaaagtaataaaaacactattggttttgttctttattgaatggnataaaatgttgacatttctttgaaacttggaactactaaatttcatttttccaaatggntctacatttttttcttagtggngcaagttgtcttaagtagcttaggaagtcaatctctacaaagtacttctgtctgttgccattctgataaaacaaaaactattcattaacttaaccatatgtgtnttttttttgctataacacttaacacatgaacagacatctattatttctccnctaaaacaaaagagtacaatagttttcttctaactatcagtattgtatttaaaaanggtaa

SEQ ID NO: 626611 - DNA, 155 bp, Homo sapiens
  misc_feature (6)..(6): n is a, c, g, or t
  misc_feature (48)..(49): n is a, c, g, or t
  misc_feature (71)..(71): n is a, c, g, or t
  misc_feature (76)..(77): n is a, c, g, or t
aaaatntacatgatcaaaaggctttgttgccatgtaaagcatagtttnnaggttacatcagtgattttatnttctnncatttcaaatgaaatgttgaaagcacaaacaagcgccatcaatgtaacaagcaaggcagcacatatacatctgcaagt

SEQ ID NO: 626612 - DNA, 375 bp, Homo sapiens
ggtactatgctcagtgcggcactggggcgtggcgatggctataccagcgccgcatatggcgccagagggacgtggtggcccatgcagagggcgtgacatagacgccgtaccgcgtacgaaaccatggcggtggtcagtgcgccgggtgccgcgggcgccaaggtttcggggtaccccggactgacgctcgacagtcgcggcaatagcctgtggtgccgtaccctgcggccttttgagctgatcgaggtggccatcgacccgattggcagtacgctggatgtcgaactcaacgagaccaggcaaacaagtcgccccacgcgctggcgccgtggatagcaatcttaagtaacaacactaatcagggccgagaggtga

SEQ ID NO: 626613 - DNA, 674 bp, Homo sapiens
cacgagtgccagggtgggaaggagtctaaagagacgaaggtagtgggagagggatctgagatcgaagctgtgagcactgtgcgcgggtatagagtgacagttatgcacgaaaggtgacgtagaaagcgtatagtgtgatgggggtaagtggggagacgagtcgaggatcgggactgggggaaacgagcggtgtcatatggccaggaatgtggagagctgagagacagcgagaggagggcgaggtgtgacgggctaggctcggtccgtataggcaaaggggagatgatgggttacgggaaaagggcgaaaccgggggcatggtatcgtcatcaagtgtaagtcaattacagggaggatgagcgatgggtgccatagaggaggcacaatgggcgccctgcggctagagagtaggtagcacgaaagagggcacgtagatatagatgtgagcacacgaagggggatatcagagggtgtggggagggataggatgtgcttcaggcaggttgcgcaagtaggcaggagtgcaggaactgtcgggctttgagtgagactaagcaagtgatatgaaaccactctagataagtgctgtgccgctgcagatcctcatgaatgctatggcaaagtgttcgatgtatctaaacctcgtgtgaaagagcctcagaatttaatcaaac

SEQ ID NO: 626614 - DNA, 146 bp, Homo sapiens
  misc_feature (18)..(18): n is a, c, g, or t
  misc_feature (28)..(28): n is a, c, g, or t
  misc_feature (76)..(76): n is a, c, g, or t
  misc_feature (138)..(138): n is a, c, g, or t
cctttttgagggagcagnccctatgggnactcgtattggtaccccagaaacattcaggaaagcaaccattagcctncctgacccctctccccgcttccccagcagctaggatgaaggcaaaatattccttcacaggtnatttgatc

SEQ ID NO: 626615 - DNA, 127 bp, Homo sapiens
  misc_feature (29)..(29): n is a, c, g, or t
gatatttcctttgatttcgtggactttgnagatggatcacctctctcattcagatgaaattctttggagagacttttctttccggagtggggattttcatcaaaataaaaatctattcagcactttg

SEQ ID NO: 626616 - DNA, 488 bp, Homo sapiens
tgctgctgtaagtagaatctagaggatccctctggctctattcagggacaggatggagcagttggccactcggaggctagctcctgcaaggctgtgcccggagaggggacaaaaaagtaaagttgggtgtttactgggagtccactctagcttgggtttcttctaaatatgtccttccaatgacctgtagcctaatcaagtcggcgggcaacacatcccttggctctgctcaattccaggttccagcgagagaatctcatttttctggggggaaatgtttcctgattttcgtctttaccaccacccctcagggaggctgggtaaagtccttcttctccatgatgtttagacaccaggcctcttgcggtggcagggctctctaccccttatgatggatggggtgatgtctcaaccggtttcctgtggagaagcagagcagctcgggtaaacagaagggccctctaaagatgcccatgccctaatctctg

SEQ ID NO: 626617 - DNA, 118 bp, Homo sapiens
  misc_feature (6)..(6): n is a, c, g, or t
gtctanaggatcccaggctttgtatctgctcaggtcaaaggtaagatttttgtaggagaggtaaacaatctcaaagttagagatgtacatggggatgaagaagtaagtgcacttgggc

SEQ ID NO: 626618 - DNA, 432 bp, Homo sapiens
gcctagaggacccacgtaatatgtaaccatgtgtagcatctatcagtacttcattcttttttatggctgaataatattccatggcatagatatataatcatgcacttcttagtgatggggatatgttctgagaaatgtattattaggcagtttcttcattatgcaagtgtcatggagtgtgcttacagaagcctacatggtgtagcctactgcacacctagattatatggaatagccttttgctcctaggctacaaacctgtacagcacgttgctgcactgaatactgtaggcaactggagcccactgttaagtatttgtatatctaaacatagaaaaagtacagtaaaaaacagtgatataatctcatgggaccataccatagtcatatatgtggttccttgttgactgaaacatcgttacatattacggg

SEQ ID NO: 626619 - DNA, 577 bp, Homo sapiens
gtaaaagtggctcttcgtcttagagggcgtgaaaatacaagacctgaacaaggtaaattaattttaaattctttttttgatgaagtaaaatcgattgcaaaattaagtaaagaaatgcaatcagttggtaattttttaactcttcatattgaacgtgataagaaaaaattacccaaatttacttcttcaaaacaaataaaggaattaattgattttgaaaaaactataaaggaagaagaaactaatgcctaaagcaaaaacaaaatcagcacttaaaaaaagaattaaagtaactgcttctggaaaaatcaaacacaaacatgcatatcgttctcatttagcacaaaataaatctacaaagcaaaaaagacagtcaagacacgcaacattaatgtcctcttctgattacaaaagaataaaagacttaatttaataaatttatcaatatttttaataattaaaaggagattttaccaatgagagtaaaaggtggaactgtcacaagatcaagaagaaaaaaatgattaaaattagctaaaggttattgaggacacaagtcagtaggttataaagttgc

SEQ ID NO: 626620 - DNA, 321 bp, Homo sapiens
  misc_feature (182)..(182): n is a, c, g, or t
  misc_feature (313)..(313): n is a, c, g, or t
ttttttgtttgtttgtttgtttgtttgcagagtcttgctcttgatctatctcccaggctgaagtacagtagtgtgatctcggcttgctgcaccctctacctcccaggttcaagcaattctcatacctcagcctcctgagtagctagaaccataggcacacgccaccatacctgctaactttnctatttttagcagagactggattttgccatgttggccaggctggtctcgaactcctggccgcaactggatctgcccaactcagccttccaaagtgctgggattacaggcataagccattcatgtgcggttnttcaactg

SEQ ID NO: 626621 - DNA, 350 bp, Homo sapiens
gcgccagccttacctgcagctctctctgatggaattacatgtgcatagcaccgcgcaggcccattagtcttttttttttttactgggaagtcaactgggggtcatatactcggcccccaaaaccctccgagtggctctctgtatcattgagtaaaatctcactcttgcagtggcctatgaaatccttttagctcctctcctacatcccccttactcgggtccagctacctgggcctcggggctcctcctcaaacatgcttgcgaaagcccttgaccttcaagcggttatcccttcaagcctttatacctacggagtcttgcttactgaaactctcttataactgatgcca

SEQ ID NO: 626622 - DNA, 392 bp, Homo sapiens
  misc_feature (374)..(374): n is a, c, g, or t
gcgtcgacctaggttccatttattagctgtaaaagctctggcaagatactcatcctgtatttgcctcagtttccttctctgtaaaatcaaacagcaatacctgttgcctaggtttgttatgaaggttaaagaagttattgcttgtgtagttagtgtcagatacacataataactatgcaatatatgctagctttgttattttttgaaatggagtcttgctttgtcacccagactagagtgcagtggtgcgatcctggctcactgcaacctccacgtcctgggttcaagtgattctcctgcctcagcctcctgagtagctgggattacaggcacatgccactacacctggctaattttttaatagagatgaggtntcacatgttggccaggct

SEQ ID NO: 626623 - DNA, 267 bp, Homo sapiens
  misc_feature (80)..(80): n is a, c, g, or t
  misc_feature (88)..(88): n is a, c, g, or t
tgttcaagttctggttgttggagtttttagcccagagtgacatactgaagtcagtaaataattattttataatgacacancacaactnccttgttatgaatttttcttaaatgcatatatactgtatttaagaaaaattcataacaaggcagttgtgaatttttcttaaatgcatatatactgtatttaaaattaaaatataggataccaatttaccaaaggatacatattactaattctaaggcaaaacttaaaaaaaaaacccaa

SEQ ID NO: 626624 - DNA, 1385 bp, Homo sapiens
  misc_feature (1304)..(1304): n is a, c, g, or t
agagcactcgagcatgatagtacccctatatacatactataagacagcagctatggtgaacaccctaaaagaaggaaagcttttggaagactacaaggtagccaaagttatatacactagatagacctatattccagctatagctaggggagaagcgcaggccccctataacagcgtaggctatccgtcgatagcgggccacacacgctaccggcaactagggcataacacatacgacccctactgcgcgaaccagatgacctaggaatagcctataagtatacagcggccccacaagacgctaggtagcctagtaataccataacgcagacaactacccagggaaactacatacacaagtagaccacgagaaacgaagggaagggaacacagaacaacgagcgaaggctaattcacctaggattataaatagtatatatatataccccgagacacaccagcgtatccagacctagggccaacctaggaatatcagaaccccgtggcaaatctatcacacaaagaccaagggagcagactgtacctatgtaggtaaccaagaggagagctagggtgggccaatagtataggtacactacaaactactacgaacgaactaactaattactgcgccatcaacacacaacaaaaacttctagggcccaggcgacgcaacccaaacgctattaccactgataggggacaattagggccgaacacacagcaccgggtaaacagcacgaggcacgggcaccgagagcagtaaattaccacacgggcacacaaatagaggataataacggagaactaccggcaacaggccaaaagcaacgcaacacaccgcgaaggtattgagccaaggaccccttacaggcgcaggaaacaacggagaaaggaacgctgtataacaaggggcaaggtaccccaaacagcagcggggaaataaaggcactgtccccggagagctagggatataacccacgcaagaacatatccttatccccacggcatacccgtaacacagagactacaccaagagagtaaccgggacaaaagcaaaactagtcgccaggaaacgttaaccaaagaaaggctgtggcacgaagggctacctcggggcgcgatacactcggaaacgcgggccagcagacgacggaggcgacacacagcgtcgaggagcacaacccgcggcaggacggagggaacaggaaaccacgaccgggcggccgacaacggtgcaggacaacggacaactgggcaagggtacaacaacgggagcaccaacgtccaacagcacactcccncgcacggcgaagacgaaactcgaggcagacgccaacgcacgaaacatcgcgccgaggagccaaaaccagcaggaggaaaca

SEQ ID NO: 626625 - DNA, 263 bp, Homo sapiens
gacttagaggatccctctactcgcggctgcctagtatgacaggaaggcagctaatagaaccattgaagaatcacaattccagccagacgtggtggctcacgcctgtaatccccgcattttgggaggcagaggcgggtggattgcttgaggccagaagtttgagaccagcctggccaaaaaagcaagaccctgtctcttctaaaaatataaaaaaacattagcagggaatggtgacatgcctgtagtcccagctacttgggagg

SEQ ID NO: 626626 - DNA, 684 bp, Homo sapiens
gtgaaaaggagagagatgagagacgggcctagcctcccagcctatacctttctcccatgccggatgcttcctgaccttgaacattgaactccaagttcttcagttttgggacttgcactggctctccttgctcctcagcttgtagacagcttattgtgcaaccttgcgattgtgtaagttaatacttaataaactcccctttatatatatcctattagttctgtccctctaagagaagcctgactaatacaatccccgtgttggaagcctggccctccgctgtacagagttattgaggaaggagaacagggtctggaggcagcaaacctaaggctgcacgccaacttcctagaactaaatgaaaaggaaacccctaactttccacacacctaagtaacaaaaggaccagaggctactccctttaacctttttctgtgaggcagatgggaaattggctgccctcaatgaatcaaactgattgcaggccagtctttgtttgcataaaatgtaactttgagaccctgcgtggtggctcaagcctgtgatcccagcgctttgggacggcaaggcgggtggatcacctcaggctgggagtcgaaaccgtcttgaccgcatggagaaacactgttttactaaagaaacaaaatttcccgggcatgtggggcatgcctgtaaacccagttg

SEQ ID NO: 626627 - DNA, 675 bp, Homo sapiens
gacgtgcttatttccggtcttgtcgggatgctgacgctctcttcctgtctttgtggctccggaaagagcgtttgggatgccaatcgcatgaggctgctgtgattggtgggtgttggctctatctggctgtctacgtcaagcacgcagagaaggagccagtgctttgggctccaaatcactgctgaacagatacgccgtgccaagggacagagacctgaggcttgcagtacagatgagtctagcaatgttggctcaagtgctgcattagacgtgcgaacttatctgatgattccttccctccagaagtactttggccttgtgtctgtcatgctcaatgtcatatgggtaccggcattgcctcctgttatcaagtgtcgtcccagcatcctgtggtcctgcgtcgcctctcatggctggtttctttcactcgttcacctcgtcaacccttagttacgctggcccacgcaggttgtgcccgttgtgatgggttctaccagtgcacctgtagctgtgatggagatcctggctcgacggggacgttgcctaggcgattctcccctcattgttctggactgcggcaggccttctggggtcatgttgcctttccctccattcgtgctcccccctgctatttgttggtccctcccacggctgcaggacctattgacgttccca

SEQ ID NO: 626628 - DNA, 438 bp, Homo sapiens
  misc_feature (438)..(438): n is a, c, g, or t
gggaagtttatgattatgaaataaaaactaaataacaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggggcggttgggccaaaagattttaaaaatgaaaaaatataaggtgggggggaaaaatgggggttaatggggaaaaaggcccataaggggggggtataaaaaataaaggggggggttttaaaaaaaggggaatgggaaaaaaccggggggtaaaaaaaataaaagggttggggaaaaaaccctttttgcaaaaggggggaaaatggaaagggggcccaaaaaagggcctttaaaaaaagggggaaatccaaaagggggggtgn

SEQ ID NO: 626629 - DNA, 229 bp, Homo sapiens
tgctgatggtcgtctctcacgactccctcgaacactggccggttggaccattttggacactatacatcataagagggcctttggggtcacagcttttaatgcccatggcagctcgtagtccgggggcccctcgtcaaggagctcgcagtggtacttctgggccgtcacaggcgcgggcaggtggatggtgctcatctgcaaacacaggcgtctccgcaccagggccagc

SEQ ID NO: 626630 - DNA, 385 bp, Homo sapiens
  misc_feature (41)..(41): n is a, c, g, or t
  misc_feature (252)..(252): n is a, c, g, or t
  misc_feature (285)..(285): n is a, c, g, or t
  misc_feature (346)..(346): n is a, c, g, or t
  misc_feature (382)..(382): n is a, c, g, or t
taatgtaaaagtgtgcagatttttttttttaaataggattncactctagtgcctagactggagtgcaatggcctagtcaaggctcactgcagcctcaacctcccgtgctcaagcagtccttctgcagtctcctgagtaggtgggactaaggtcatgagccaccactcctggctaatttttaaattctttgtcaagccaacgtggtgaaacctgtctctaccaaaaatacaaaaattagccaggcacagtggnccacgcctgtaatcccagcacttttggaggccnagatgggtggatcacgaggtcaagagatcgagaccatcctggccagcatggtgaaaccccngtctctacctaaaaatacaaaaattagtgtgcgtgngtg

SEQ ID NO: 626631 - DNA, 284 bp, Homo sapiens
aggacagttgatatcgtagttgtatggtgattgtataggggatctttggctgaagagaagtgctgaatgtcaaggtcatggaattgatccatcttttatgataatgcttgtgggtggtattaagaggttcttagcgctcctaaagtcataaggacattttccctctaccggcttcatgaagttatttggtccttttcttacagtagtgacttaatattatgttatgtatggatataatttttttcactaatgagtaaatggcccgagcactggtgctcgtgccg

SEQ ID NO: 626632 - DNA, 368 bp, Homo sapiens
cataatctcagcaatagtcacatgaatcagggctgctgatgggcaacagatctataccatgacacaccctagcactcatgctggaatagtcctgcgtaacgaaggcagctcttcatatattcatgcacaagttgatgtgtgttaaaatccaagtgtcgatctaaactcaaagtggacgtcataaggttaatccatcagctgatgtgtccaatcaacattcaatcacaccccactcccatggcaggcttgtccctccatgtgcagcatagcgtcactacctgtgctacctgggcctctccaggttcatgagtatagatttcatcttgtacaattagcaggatgtaggacgtgtacaaacaaaacacgta

SEQ ID NO: 626633 - DNA, 1068 bp, Homo sapiens
  misc_feature (186)..(186): n is a, c, g, or t
ccacgcgtccggagaaacgcggggtcgcggttcctgcggatcctggcacttgtgccccagtacagccgtgcagggtcgtggcctagaagcgcctggcctggtgaccatcgtgcacgaggcgcatcgacagcttcctaagacgctgctggccatagcagaaagttgaacagaatcgcggtctcccanccacaccaagttcagcatttaccctcccattccaggagaggagagctctctgaggtgggcaggaaagaaatttgaggagatcccaatctgcacacattaacagcatcccacatacatacacacacgatccaggtagtctcgtgctagctaattgagccccttgcctttgcttcctgtggcacagagggcatttcggacctgcctcgaccgggcaccggcactcgccgtctcagaccgcatggcactacgccgccgccggcgaccacgctccccaccagggcgtgatccacatccgaactcgtggtgccccggccctggtcgcccggacgcttgtctgccatgcgccggcactgctcctggccgcgcctgccccctgcctctcactccaccgaccaacaccccaatcccaccaccaaccgcgcctgccgccccggcacggctcggaagctgacgatgcgcacgcgacgccatgcactcgcgacctgacctcacgccctcagctccaggaggcgacctcgctcacctgctccctgctacccgaccctcaccacacacacgcccgcccccaccatcgctcaggacaacaccccaccagccccgccctccctacccagcgcaccccgccggccccgccaccgcaccaggccggcacacgaaccaccccgcctccgctccccagccggcgtccgggcacccgtggccatgcccaccgcccgcgaccccctcgggccccgtacgccgcccccccccccccggcgcccccgcctgccaggcgcggccgccgccgcgcaacccgccgcccgcaccgcgccgccccaaccccgccccgagaagcacacccccgcgccgcccgccagcccgcaccccgatctggggtggcgg

SEQ ID NO: 626634 - DNA, 215 bp, Homo sapiens
atcagccgtgtaccatacatggctcagcattgagacttaggatctcatcaatgaatacctgatacctgtattgctatttatatatttaatgagattaatctataccccaggcatccaagtttttgaaactttgtgacaaggtttatagctgctttatacgtgtctggtttgcataggcgtaagctaataggttgtatcaacgatgacttcgattg

SEQ ID NO: 626635 - DNA, 2529 bp, Homo sapiens
aggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtctcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcata

SEQ ID NO: 626636 - DNA, 386 bp, Homo sapiens
cggcacgagggctatgtggttgaagccacatagcagtagaggggcgtgtgtgtgtgtgtgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcata

SEQ ID NO: 626637 - DNA, 2374 bp, Homo sapiens
aaggggagagagcgagcgagtagattgacataagcagcgagacccgggtctgtactgtcgtgccgaggctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtctcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcata

SEQ ID NO: 626638 - DNA, 352 bp, Homo sapiens
caccgtctcacaggacctacatcgcccacgttgggtgaacgcggatcagagcgatacactgcggaggactttgaattaacacaatcaacacgtgtcaagctgagtaaaagcttggcggtgtgccaggttgccttcattgtacgaagagataatggaagtattgacggttggtttccggggcgccagtggggagagaaaggaatatttctttgctccggcactggatcttatccctacttacagcacgctgctgtcagctggtgccaagctttgaggcctccgctactacattgatacacagttcgcgtcagttctttctttccagcctcccctggccatttatattcagctc

SEQ ID NO: 626639 - DNA, 415 bp, Homo sapiens
gaacaggagggccctgcaggagagggaccacgcagatggaagctggggatcagcccacccactgagcagaccttcagcccctccagcaagattctcctggtgacacgatggggggcaaagaggaaattctgtcctcctcagtgacctgggcggagtggcgtggtgtgatgggaaagggtgctggtgggagggccaggacagcagagtctaactctggcccttccaggagtagctgtgtgatctcaggcaggtttcttcacctctccgggccacctcagagccctctcttgtgaaatgaggcatgattgtggagagcattctggcttcaaatcctgcaattgatacctggccttacgtgggccagcattgctccacttcccccagatgcacctgcaagtccttccaagggggctgg

SEQ ID NO: 626640 - DNA, 213 bp, Homo sapiens
caagtgtgaaaccgtaggcttggattaaggcgcacgcgatttctaggatagttcgtagcacttagaattgtgaagatataagtgtcgagcgccggttcatggtagatatcgctagggtggcgctcccaatttggtgcatgagtaggtcgcctgcagtcatgttagcggttaggcgtacggccagggctattggttgaatggcacacgcgagtt

SEQ ID NO: 626641 - DNA, 946 bp, Homo sapiens
ggcacgcgcggttagtagtcgctgctgcgcggccgcgggggactgtctgaagagacgcgggaccaagtggcaagattgacatctgagctgtcatgccgaaaaaaggccgaggagagatatcaatatgcatttccaagcctttggctattgtgggggtctcctgtgcaatctcaattatgcagaaatttatggatgatgaatgttggagagggaagactttgtgaagaaaatcagaaagaactgggagtggttcatgaagggtgaacttttccctcagagatttacattataaagaccacctcaaacctatagggagaagtatattttggcaggaaacttttggataggttgggaaggtgggctggatggggtctaatcaaaacagcaaagaaagatgactggatgaggaaatttcaatatacgaatggaagagtgggaacttgcgaagagttgaaagaaaaacccaggtaccgtgtggacagaggactgttataaaaatctagagcaaagggcttcagtggcaatattgtgttgtattagaaaaaccatttccattgtgctgataaacccctgataagttcaatatgaagtaactttccacgatggtattggaatggggggggtgctaaattaaactcctagcagacactgatggattggtttctggacaccttctattgtaacacaattcctatttcattaatgtgggccagataactgttggggagatttttaacttacttattctcaacataagctcccacagggttcccagaacatggcaacctccgatgaacttaaaggtttccgagaaccattaacctggggaccgatccattcgtgttggcacacggccagacccagggtctcaaccaaagacctaaagggtaagccttcgcacgaggcgcacagttggggcactcacgggggccacgttggagtctgt

SEQ ID NO: 626642 - DNA, 2773 bp, Homo sapiens
aaggggagagagcgagcgagtagattgacataagcagcgagacccgggtctgtactgtcgtgccgaggctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtctcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcataataaaaaaaaaacaaacaacaacaacaagacaacaaaaacaacaaacccaaagaagaacaagaaaaggacaaagagacacaagacaaaaaaagagggggggcgcgcgccactaaagcaacacacacctctacggccgggcggcccccccccgccaccgccaccgctcccagcacgcgcagttggcacttgtggaacaacaggagtggcgcccccccactctaaaggcggcagctttcatattccaacaggcacatagaccggcgggtcgcggccggtatcgtccaacgtcgcgtacagcgggtggcgcaccaagcgactacttgtggcgtcttcattgcagctgaaagagagcacatccatatccgaagaagtggagaccagtaggcgcagacacgcaa

SEQ ID NO: 626643 - DNA, 235 bp, Homo sapiens
  misc_feature (27)..(27): n is a, c, g, or t
  misc_feature (71)..(71): n is a, c, g, or t
ccctaaaagtcccagagtagttttgcnaacggcatgattcctgtttttgcgttttatctcagtgctctaangttatcctagcctaggtgcaggaataggtaaggccccttaaataaaaatggagttagttatgttagttcttctgctgtttcatggttacaagacacagaagagaacccttgcatcaaaacaggatgagattaggttgttgttcctataaaaaatccatgtggtt

SEQ ID NO: 626644 - DNA, 249 bp, Homo sapiens
gcgaagggcttgtcgatttggacggagatggtgtgtatgatgcagtcgaccagtcgccaagcagcgtgtgtgccaggggcatctgcctgtccttacagaatgaattccatcccttgaaccaaggcatgtgagcacttggctccagcatgttgtcagcattccaaccagaaattggcacaaatgctactgtgtcggggttgtagccaattttcttaatgtaagtgctgacttccttaacaatctcctcat

SEQ ID NO: 626645 - DNA, 173 bp, Homo sapiens
cctcatatcatcagcaatgcctcctgcacaccaactgcttagcacccctggcacggtcatccatgacaactgtgggtatcgtggaaggactcatgaccacagtccatgccatcactgtcaacccaacacaggcatgctcataaggaaaggttcaaaaaagtaaaaggaactcg

SEQ ID NO: 626646 - DNA, 234 bp, Homo sapiens
gtgcctcttccccccaaatttgtatgtctgaagcacgtaaccctcaatgtaatgatattatggtagtgggagtcctatcacaggtacttaggcttagatgacgtcatgagggttatgtgtccttttggaaacaggaagagttcagaactttgtgtctctaccatatgaagacacggtgagaaggcaaccatctgccagccaggaagccagccctcgcaaatctgtcaatacaga

SEQ ID NO: 626647 - DNA, 360 bp, Homo sapiens
ggtcgacgagcaaggccgcactgaattccatggccagcaccttcctcagcgaaatcgaagcgccgaccttcaccgtcctgtcgatgcacccgggctgggtgaaaaccgacatgggcggcgaagacgggagtatcgacgtggccaccagcgttcgcgcctgatcgatcaggtcaatgcctattccggccggggcgggcatcacttcatcaactacaagggcgagaccattccctggtaagcaacaaccctgcaggagcgccgacgggctgctcctgcagcggagtttagccagtgtttcgacagacatctgtagaatgtccacccactgcacctgatgagaaaaaagaccatgtacgactt

SEQ ID NO: 626648 - DNA, 113 bp, Homo sapiens
ccactgtgctctcctggacacagggcttgtaaggtgaggtgcagcctgatgtatggaatcagcggagagtgaaatcccacgccaaatcaaggacactcagtacgtgagtgctg

SEQ ID NO: 626649 - DNA, 257 bp, Homo sapiens
gccctcaaattcataccggcgactagcaccgcgtccggcagagcagacctacactcgcccgcgccatagcctctgtctccgagctcgcctgcatcatactacggccctcattactgcacgacgatgaggtgacaataacggaggataagatcaataacctcattaaagcagccaggtgtaaaaaattgagcctttttggcctggcttgtttgcaaagaacctggccaacgtaaacattggggcctcaatctacaatg

SEQ ID NO: 626650 - DNA, 267 bp, Homo sapiens
aagcagttaatacagactcaaaaaaaaaaaaagaaaatttccacgagatgggtggaaatctaaactggagaaccactttggcttaacatatgagctcagcagagcttttaaatcacgatcaggttaaatttactatctaattttcagaaatacatttgtcacctgcggacagttagacctagacggttggtagaaatttccagcattcccacatttacaggaaaacccttgacaggaaaggaattacacaggcttgaccccttttga

SEQ ID NO: 626651 - DNA, 879 bp, Homo sapiens
ggctggcgtgcggcgcacgtgccctcggcctgagtcgggatggagctgcctgatatgaacctgaaggtgattctcctagtgtcacttggcttgtgacacttcaggggctgcaatttgtattctctcgtgctcctatgcactggtcccaacattacaccattcctgagcctatgctccagtgctgtggcttgtaggactcacactgagagacatcacactctgactcgcccattaaatggcattcgttaatcctatgcgaattcacaattagcatagagaccaacaccaggtcctatccctttggaccactcaggtgcaacaagtcaaggcactctaatcataacccctgcgcagcatcctacgcctaccaccgtgacaaacttgggcccatgaacttttagcacaggtagaatgcatgtgccacttacacatcaaggaatttgcattgcttctaacgcccggattacatcacatagactgaatatctgttcttaacccaacattgttacctgtggaagcacgcggcgagctgtacgtgcctctctctgggttccagccacatcgtcatgacccctatgagggtcgtatacataagtagacccggtagttggctcaaccaggactaactttgcctcatccctatgatccactggagaagtcccttgctgagctcctcagatggtaggcagacaacaatgcccgggtgtacctgaagtcagccaatactatcgcccgtgcctgccagtccccttcatcctactgaatgaaaccttaggcagtctatgctgccgatactgtgccatacaatgcatggttcccactcagaatagcgaacaagcagctagaacccatgctcccgttcactccgctgtccgactc

SEQ ID NO: 626652 - DNA, 367 bp, Homo sapiens
acattttctagctcatctattgggggccctgtgatccaaccaatagcagactgtgagcatcaacttctgtgtttgctaggctccggcatagtctcacaagagccagctatatctgggtcttttcagcacaatcttgctagtgtatacaatggtgtcagcttttggaagctgattatgagttggatccccagatatggcagtctctagatggtccattctttcgtctcacctccaaactgtgtctatgtaactccttccatgggtgttttgttcccaattctaagaaggggcaaagtgtccacactttggtctccgttcttcttgagtttcatgtgtctagcaaactgtatcttatatcgtggttatt

SEQ ID NO: 626653 - DNA, 103 bp, Homo sapiens
acttgggaacgcctacatctgacaacctcatggcggacgggacctgtcatggacgctggccatggtgggctacaatggactcgctctccgtctggtgcctgcc

SEQ ID NO: 626654 - DNA, 688 bp, Homo sapiens
ggggggcgggtgagcccccagaccaagttttttgttttgaataaaaaggaaattgcatgggtgcaagccgtttccaagcatccggcctcaaattataagccttggaaaccttccattagtggggcagtacagaattgaggctttggcccatgttttaggtttttttgacgagaaccgcaaccggcatttctccatcctttctttaaaaagtttttcttcataaaacacattttcccacaacgtgtctattttactccataaattcctttatggaacctaccttaaatgaacttttctttggtgatccatactgtcttacacccaactgtgaactgataagtccaaatattctcaaaatgtatctccaagcactctcatccatgtttgcttgatgctaggtttatctcacaaagcttataaccatcagctcttgtacattgttctggaacctaagctaaatacccaaataacttcatttgacacactttagggcgcttgtttcaggtaggggtgtatacatcccacgggagtggatatgatcactccatggaggaagtagcaagatgatttctttgtatttaatctcatcctatttcattgcgatttttgtgtgttttataatgtacataatctgttgaacaattgcacacttctattacttataaaacaacattaattggtgcatcaa

SEQ ID NO: 626655 - DNA, 280 bp, Homo sapiens
  misc_feature (134)..(134): n is a, c, g, or t
tgcgccggcagcgccaaggtcgagagcctgggcatcgccctgctggaggctgtcgagtccgacgacccgacggcactcatcggcctgccgctgatccgcacctgcgccctgctgcgtcgtgccggcctggagcntctggcatgaacaagggccggatcatcctgatgcccaacacactggacttcggtgtcgacgattccctggacctgcgcgaggtgctgccccagcgcgtcatcgagcaggcggcccgactgacgcactgggcggctgagaacgccaa

SEQ ID NO: 626656 - DNA, 107 bp, Homo sapiens
ttgtgtacatcctcaatgtgagtgcctgtttctaccagtgtccctgtacccctaccctgacctggcgttgccgcttcctagccatgaatgtggatgatcacttgagt

SEQ ID NO: 626657 - DNA, 468 bp, Homo sapiens
  misc_feature (127)..(127): n is a, c, g, or t
  misc_feature (130)..(130): n is a, c, g, or t
  misc_feature (318)..(318): n is a, c, g, or t
aaccttctccttgtggccctgctgtttccaggattgtctcaaaccaaacatgtgaaccactcagccccttaggctttcggaaaactcagggaaaaagcccctgggcaaggcacaaacgggtttcaanttntaccccacgcaatgaaaagggaccttttacccccgcgcaccccccctttccaaagggatgttcccccgggaattaaaaatacccttttccgtatgcaacaaaggatttgcagactttttttttgcccttctggtgagaaaagcgtgacctttgctctgatccctggaaaaggtgttgggtttccaatnccgattaaaaaagaaaaaaaaaaccaaaaatggatggcagatttggggttttaaaaataagctcccggaaggcagggatgtttaagtatccccagggcttaaaagaatgtgtggcttatagtaggtgttccataaaaatttgttgaatta

SEQ ID NO: 626658 - DNA, 104 bp, Homo sapiens
tcaagcttctaacgatgtacggggaatggcattctggttttggtttctgtatagttttgggtctttctatgctggttgtatttatattaaacccctggttagca

SEQ ID NO: 626659 - DNA, 926 bp, Homo sapiens
ctggtgtgtaggacagacaggaggaaaggttggctgtggagttgcttttaggcctaaataacctctttagttgtatttcttttcttttctgactatagcagtggaataaagagtggaaagaatgtgggggagtggggagcagggagcaggatctgagcacagatccatgatttactggctatgtgacctcaaaccactcgtcttaaatgacatttatttacagagacaacagaacatagtgattagagcatgagctttgaagtcggactgcctggtttatagactgatcctgctacttaagtaacttgcagaaacttacttatcctctctattacttatgtgatgtataaatgtaaatatacacagacatacatacatatatacatacatacacataagcatatataaatgtatgtttgagtatatttgagcttatataagtcaaataaatgtagtgtctaagagaattgaagttgtttcctcttttaaatttggaaagctggtgcaatgataattttgaaagttttagcatatacacatagtatttatgggtttgtccttgttgctgtttatagtggaaagtaatgtaagtggaggtcttaagtaactattgcctaacctggatttaagttttttttttaaatactctatcttgactctgtaagtttacataaatttagtctctttaagactttcttttatgactgtttatgtattaatttctggctttaacttactgggatttttatttacaatattttttaaatggcaggtatccctttaaaacagaaaaaaaaggctgagcgtggtggcacatgcctgtaatctaagcaccttgggaggctgaggcaggaagattgcttgcagccaggagctgagaccagccttggcaacatagcatctctacaaaaaagaaataaaaaaaa

SEQ ID NO: 626660 - DNA, 421 bp, Homo sapiens
  misc_feature (67)..(67): n is a, c, g, or t
  misc_feature (79)..(79): n is a, c, g, or t
ctgggcttccaaactttaccctctgactcttggttggcccctcagaagcctcagcctccctcctgtncttccctctccnacagtgatccttttccccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagctgtgccgaat

SEQ ID NO: 626661 - DNA, 741 bp, Homo sapiens
agaaataacggtaattcagtggcccattgtatctttgggttcacaaccacaaaatgaaccatctggggatgagaagccttgggaacattaagagggaataccattatcctttgagccatagtgcacatacaagcagtctagtatacagcccattccatagcatgtgcattatctacggattgcacaacaaaaggtatgtaggtcataggcacatactgcacccatcttcataaggggacttagaacgcatggattcccagtagatgcacccaaagataaaaggaaaagtctggcctaggtctgcgcggagaagtgcaactccatttttcacagggcattccatttcttgttttggacatcgtccctctgtagttgtttccattcccagtcttgcactgtgaaagatacatttacgtttcaaataaagctgcatctcgcatcctaatgattatggaggacttcctgttttcagccataagcacacattggtgctctataatgtgatattggaatgcccagcaggtgaattctttgtcctctacacattatgctgcgcattcgtctttgcctcctgctcccagatgagtcatagtgacactgaacagtgaaggcccctgggtattcacatagtcatccaggggctctccttcacctgatttcgagaaatgaaagaagtagaagctccagttccttatgttccattttgggactggccagcagtgtccacacaccgtgtcccag

SEQ ID NO: 626662 - DNA, 571 bp, Homo sapiens
  misc_feature (443)..(443): n is a, c, g, or t
  misc_feature (508)..(508): n is a, c, g, or t
  misc_feature (519)..(519): n is a, c, g, or t
gagaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtggctgaccccagtgaggagtgggtccagaaatacgtcagtgacctggagctgagtgcctgaggggtccagaagcttcgaggcccagcgaccttcagtgggcccatggggaggagcaggagcctgagcttgggaanatgcgtgtgactctaaagctacctcttctaaggactgggtattgccaaacagccacatgtgggantcttcttaacntaaatttaattaattataccaattagttttaatttaattttgttcacggggg

SEQ ID NO: 626663 - DNA, 775 bp, Homo sapiens
gagaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacgtgagtccatgttgttgttgtgggtatcaccactctctggccatggttagaccacatcagtctttttttgtggcctgagagccccgaagagaaaagaaggaagttcttaaagcgctgccaaacaccttggtctttttcttcacaacttttatttttatctctagaaggggtcttagccctcctagtctccaggtatgagaatctaggcaggggcaggggagttacagtcccttgtacagatagaaaaacagggttcaaaacgaatcagtttgcaagaggcagaatccaggctgcttacttcccagtggggtctgttcttcactctccagctcaccctaggtctcccaggagccctgtcccttggatgtcttatgagagatgtccaggcttctcttgggctggggtatgacttcttgaaccgacaaaattccatgaagagagctaagagaacagtccattcaggtatctggatcacatagagaaacagagaacccactatgaagagtccaggggaaccgaggaatatagacagaaacaaagagacatttctctgcaaaacccccaaatgccttgcagtcacttggtctgagcaagcctgccctcctcaaccatc

SEQ ID NO: 626664 - DNA, 150 bp, Homo sapiens
gatactctacgtgcatgtggtgaatgtcctctgcccggtcccggcggctttcttctccctcctttttcatgtggccttggtacttctggtgttctgcccttgcctcttgcttacgattcaaagcttcagggcgttgggttttctttcggt

SEQ ID NO: 626665 - DNA, 190 bp, Homo sapiens
aatgcctggcagcactttgccccagcatggtaaggcgttccatcaatcgcgaaaacacagagtgtggactcccattataagaacagcctcaagcatggtcctgttcacaatgtttattgtgtcatacagtaccccagaaatgggtttctactgagatgcaaagactgctgcttctggaataccctaccat

SEQ ID NO: 626666 - DNA, 448 bp, Homo sapiens
  misc_feature (181)..(181): n is a, c, g, or t
tggggtttccccagccagcccctttaccaggggctctccaaataggagcctccatctccaggtgttctctttgggtttgcccgtccccaaccctacgatcctcctggaaagaagatggtagcagccaaagtaaagggttagaaactggattaaaagctttaaaaaattgggccaacccagnccccccccccttgggtcccccccaaaaaaaggggggagcaggaggctctttttggttagttccaaaagctggaaaaaaaaaaccaggctttaaaaaaaaggggggattccctggcccaggagatcccgttccttaaaaattttataaaaaagggcccccaggccagggggaaaaaaagggtccccttgtttaggatagtcaggagggcccatgtgcttgttcaaaaaaggctgtaactgtgtgttcccataaatttttttttaggga

SEQ ID NO: 626667 - DNA, 362 bp, Homo sapiens
  misc_feature (193)..(193): n is a, c, g, or t
  misc_feature (250)..(250): n is a, c, g, or t
gggttcataatctcacaacaaagacgggtccctccatgttcttggagctgtacacccattggaactcttaagacatatggccctaaagcacctcagaagaagctgaaggaaatcagcctccataactttcaagcccctggactcctggagccagaagttaattcacactctgatctcagagaagttcaagacnttcagcagaacttttcctggccagggcatttttgcccctgagatatgtcattaaacnctgtaaccaggaacttctgttcttacccctgtccttcccttcaccttttatagttactaaatgcaatgttttatttttccaagtacaaaacaataaaatagttataaagaaa

SEQ ID NO: 626668 - DNA, 220 bp, Homo sapiens
  misc_feature (117)..(117): n is a, c, g, or t
  misc_feature (155)..(155): n is a, c, g, or t
  misc_feature (171)..(171): n is a, c, g, or t
  misc_feature (188)..(188): n is a, c, g, or t
atgcagaaaaggagtcgtgagcgtaacaccctcgctgctggtcataaaacccatagttcctgaactcatcaaagaacttaacttcctgacgccagatatctgccatgcgcgaagggntgataccactcaggattatgaattttgtttaaagtcgngtttacaatgatttgncctggactgaaattcangctgccttaaggtgctgatgatattgagaagt

SEQ ID NO: 626669 - DNA, 430 bp, Homo sapiens
  misc_feature (163)..(163): n is a, c, g, or t
  misc_feature (166)..(166): n is a, c, g, or t
  misc_feature (168)..(168): n is a, c, g, or t
  misc_feature (172)..(172): n is a, c, g, or t
  misc_feature (213)..(213): n is a, c, g, or t
  misc_feature (252)..(252): n is a, c, g, or t
  misc_feature (271)..(271): n is a, c, g, or t
  misc_feature (294)..(294): n is a, c, g, or t
  misc_feature (414)..(414): n is a, c, g, or t
ttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcccngtntngggnccccttttatgggcctttaccactggtggtaatgttcacgnaccaccaaggtaaagggaaaaatgcaggatggttaccgnaaaatccagctggctattncatggaggctgaaaaacaaagcncaaataatagatagctaagttaagaactactaaggtagtttatagaagtagggaaaaacgtaatactgctttttattcatgtctttaaagcctttttcagaattaagttgccaatcactnatgttgtaaataatgg

SEQ ID NO: 626670 - DNA, 395 bp, Homo sapiens
  misc_feature (12)..(12): n is a, c, g, or t
  misc_feature (20)..(20): n is a, c, g, or t
  misc_feature (28)..(28): n is a, c, g, or t
  misc_feature (86)..(86): n is a, c, g, or t
  misc_feature (97)..(97): n is a, c, g, or t
  misc_feature (186)..(186): n is a, c, g, or t
  misc_feature (207)..(207): n is a, c, g, or t
  misc_feature (223)..(223): n is a, c, g, or t
  misc_feature (291)..(291): n is a, c, g, or t
  misc_feature (330)..(330): n is a, c, g, or t
  misc_feature (353)..(353): n is a, c, g, or t
  misc_feature (373)..(373): n is a, c, g, or t
tctatttttganttggagtntcactgtntcccaggctggagtgcaatggtgcggtcttggctcgttgcagcctccccctcccggantcgagcgattnttccgcctcagcctcctgagtagctgagactgcaggcgcccaccaccacgcctgattaattttcatatttttagtggagatggggtttnaccatgttggccaggttggtntcaaactcctgacctnaagtgagccactatgcccagccctacagtgtgttctttatgcagcatatgtgctacagaatgctggantttgaggttctggttttcaattattaatgctagtttgtntagggtaatgccccaaaactcantcttgggagtcgtattgccngtccagagactcaagagtcaac

SEQ ID NO: 626671 - DNA, 206 bp, Homo sapiens
gaagctacatgatttgggattacacatcagtttcaattttggccatgagggaggaatttggaggcagagctctggccctatggcggtggaggccatactttgcaaaccacgaaaccaaggtggctatggcggttccagcagcagcagtagctatggcagtggcagaggattttaattaggacaacagcttagcaggagaggagagc

SEQ ID NO: 626672 - DNA, 289 bp, Homo sapiens
actaggcagggtttttgccctgccgaacactttccctcccccctgcctggtcctggggccttttccctaggggtagacttttttgcccactgaaatgggttttctgcccattgactggtcaggggcaaagtttgggtgctgtcctttggccccgtgtggggacttgtttaaacccaaaagaaaaggacagggtccccaacacgtttgggggtccttattttgggctggacccggttgtggatccaaaaaaaaggcctagtttcccataaattttaggaattttgcagga

SEQ ID NO: 626673 - DNA, 460 bp, Homo sapiens
acgggtactacgaatagtagtagtagggtagggggcatccatatagtcactccaggtaaataggagggtactatctactaataaggactatttcgctatcgaagcgaaggcttctcaaatcatagaaaattatataatattactagctgttagagaaatagaatagagcctacagatagataaggatagttcatagtaggtgtaatagcatcggggtagtccgagtaaacgtacggggcatatccggataaggccgagaaagtgctagtgggaagaaagtaaagatattacgccgatgaatatagatagtgaaatggatattggcgtaggtttggtctagggtgtaagcctgagaataggggaaatcagtgaatagaagcctaccaatagaaggcaaatacagctcctaatagaaaggacataagtggaagtagagctacaacgaataacgtagtacgta

SEQ ID NO: 626674 - DNA, 201 bp, Homo sapiens
  misc_feature (46)..(46): n is a, c, g, or t
aacagtgagcgatgatcatgcattgctctacgcctagggtgacagnagtgatgatccattctttaaaaaataaacaataaaaaacaaaaatcctctttctgtaacctgggtttgccttaaaggtaaattacttgtggctcaaggtttttatgagaaatggcttttcggtttttataaaacaagaagcgattttttttaaaa

SEQ ID NO: 626675 - DNA, 573 bp, Homo sapiens
  misc_feature (185)..(185): n is a, c, g, or t
  misc_feature (217)..(217): n is a, c, g, or t
  misc_feature (313)..(313): n is a, c, g, or t
  misc_feature (322)..(322): n is a, c, g, or t
  misc_feature (374)..(374): n is a, c, g, or t
  misc_feature (382)..(382): n is a, c, g, or t
  misc_feature (384)..(384): n is a, c, g, or t
tttaaggtggctgctcatggaaacgtgtgctgtcacaatggaggcgtgaccgcacctgtaagggatacttcgacaggtgtccactgcagttgtcctgttggattcactctccagttggatgggaagacatgtaaagatattgatgagtgccagacccgcaatggaggttgtgatcatttctgcanaaacatcgtgggcagttttgactgcggctgcnagaaaggatttaaattattaacagatgagaagtcttgccaagatgtggatgagtgctctttggataggacctgtgaccacagctgcatcaaccacnctggcacanttgcttgtgcttgcaaccgagggtacaccctgtatggcttcacccactgtgnagacaccnangagtgcagcatcaacaacggaggctgtcagcaggtctgtgtgaacacagtgggcagctatgaatgccagtgccaccctgggtacaagctccactggaataaaaaagactgtgtggtgaaggggctcctgcccacaagtgtgtcaccccgtgtgtccctgcactgcggtaagagtggtggaggagacggg

SEQ ID NO: 626676 - DNA, 103 bp, Homo sapiens
  misc_feature (1)..(1): n is a, c, g, or t
ntacatcaaatatctgtcaatggggcagatatgctaatattgtacaagcagcttcgtgaagttagaagataagaaacatgtcatcatattaaatgtccggtaa

SEQ ID NO: 626677 - DNA, 201 bp, Homo sapiens
  misc_feature (29)..(29): n is a, c, g, or t
  misc_feature (42)..(42): n is a, c, g, or t
  misc_feature (90)..(90): n is a, c, g, or t
  misc_feature (122)..(122): n is a, c, g, or t
  misc_feature (166)..(166): n is a, c, g, or t
cttgagcctagaaggtccaggctgcagtnaactatgactgtnccactgcattccagcctgggcaagagggagactgtttttaaaaaaaantttaaaaaatcaaccagtgaaaaatgattatntcatgattgagaacaggcacagaagacgtttttggaaatttgantaaagaccatatattagatgacaggggattactca

SEQ ID NO: 626678 - DNA, 99 bp, Homo sapiens
  misc_feature (16)..(16): n is a, c, g, or t
  misc_feature (79)..(79): n is a, c, g, or t
agccggtattcaagcntcacttcaaaaggcggtaaataccggtttattccaccagaaattcaagggggattaacgccanggaaaagaaacattgtggag

SEQ ID NO: 626679 - DNA, 303 bp, Homo sapiens
  misc_feature (22)..(22): n is a, c, g, or t
  misc_feature (76)..(76): n is a, c, g, or t
  misc_feature (89)..(89): n is a, c, g, or t
  misc_feature (91)..(91): n is a, c, g, or t
  misc_feature (114)..(116): n is a, c, g, or t
  misc_feature (119)..(119): n is a, c, g, or t
  misc_feature (130)..(130): n is a, c, g, or t
  misc_feature (142)..(142): n is a, c, g, or t
  misc_feature (166)..(166): n is a, c, g, or t
  misc_feature (175)..(175): n is a, c, g, or t
  misc_feature (177)..(177): n is a, c, g, or t
  misc_feature (185)..(186): n is a, c, g, or t
  misc_feature (215)..(215): n is a, c, g, or t
  misc_feature (301)..(301): n is a, c, g, or t
gtgggaggtggaaaggtttggntgacaaaaagtcagtgtaaatgtataataagattattttcaaggaaatctgtanattaagttttaangnctattttacttcatatatacatnnngtnctattttgggnggtgcgattctntatgcttattctaaaatattactngtttttttngngaaaggtnnggaccgtgaggcttttttcatatctgatntattacagtataatccatatttctcctataacacttagttctggaaaaggatctactggtgtctgtgtttaggcaggtattagttntg

SEQ ID NO: 626680 - DNA, 286 bp, Homo sapiens
tcgtgtgagtaggcaggagtgtggaggggcagtgttaccttcttctttttcttgctggtgcccgcttgctgtctcgcttgtgctcgcttctgtcctctcactcttgctgggtggactgcgactgggtctcctctctgcttctcttcctgcccttcctcttgtccttggtcttgctgcggctcctgctccgggtcctgctgccccctttgctcctggtccggctccgactctggcggaggctcttctcctggctcctagccctgctcacactccctcgcttctcctc

SEQ ID NO: 626681 - DNA, 300 bp, Homo sapiens
  misc_feature (209)..(209): n is a, c, g, or t
  misc_feature (268)..(268): n is a, c, g, or t
  misc_feature (288)..(288): n is a, c, g, or t
ctgcttatgtttttcgggattttgggagcccccactctatccgtctccattttgctttgggggacccagcgccgaaaagccaagacttcatgaactacataggttttaccattgacctaagatcaatttgaactattttagcccagtcagggagctttgcttcctaaaaaggcattttcgccagtggattcgcctcaaggttgaggccnccattggaaaatgaaaaattgccctcccttggggtagacaaaaaccagttcccattggngttgttgcctataataaacnctttttttttta

SEQ ID NO: 626682 - DNA, 311 bp, Homo sapiens
  misc_feature (31)..(31): n is a, c, g, or t
  misc_feature (66)..(66): n is a, c, g, or t
  misc_feature (138)..(138): n is a, c, g, or t
  misc_feature (301)..(301): n is a, c, g, or t
cctttccaaaattttaaatggaaccaggccngatccctccatgaaattccaagccaaagaaaaaanccccaattttattgggcctaaatagtcaaaacaatgttttccataattttcctatttgaaaatgtgctgatnctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttaantgcacaagtt

SEQ ID NO: 626683 - DNA, 118 bp, Homo sapiens
gcgtgcggcggtggaatgaaaatgcctgttatgagcagcagcaagacgggaacgccagagtttcaggaaggagctttggagagcggggcgctcggagcctggggctcagtgggcgtgt

SEQ ID NO: 626684 - DNA, 321 bp, Homo sapiens
gaggaagaggagccttctgtcgccccgcagggaggggagcagcgcccccttctctcctcgcaggaagcgccgcctggggggttcccaccaccccatttttttgctgcagcctccccaggagttggggggacaagaagccccccccctcctcgtgcccttaattggaagcgcccccctagcaatatcacccattacccttccctctacccttatcttcttcccaattctaattttactgcctatcctagaaatcgcggtcgccttaatccaagcctaggttttcccccttttagtaagcctctcccggcccgcccccccata

SEQ ID NO: 626685 - DNA, 97 bp, Homo sapiens
  misc_feature (90)..(90): n is a, c, g, or t
agcggccgcctactactactactgctcgaattcaagcttctaacgatgtacggggacatgctcaaaaaaaaaatcatcgaaaaagttgtnctgcacc

SEQ ID NO: 626686 - DNA, 115 bp, Homo sapiens
gactcgcactcagtaggagacaggcatgccttgcagtgcatgcagctcactgattcatcctcagttccgcacagtgccaccagaagttgtccgacaagcctggcagaaggcagac

SEQ ID NO: 626687 - DNA, 1094 bp, Homo sapiens
cgcctgtctcttggagaactacgaggagtatgcagctcgggcccgtctgctcacatgagatccacaggagggtcgccggcggcgcccagcggtcagggccgaagccggtcgggaccctgagaccagatgagcacttgaagctttcctccactcgatccctggcggcccctagcggggccctgggtaggggctgagggtcccatggccaagaatgcatgctgtgcgagtcgcgataatgaagcttggtcagtgctcacaatgtaaaagatgaccgggacgaagaacagcgggcgcctgccggcgcgcatgtaagatggagcatctctttcctaccttaccgactcgttgaaccccgaatcgcttcgtccgtgtctccccttcgccttcgcgaattcctggttctacttaagtctatgttgaaacattataggcgtgggagtcagtggcgacgaggtaccatgcgagggccactgtgggacctagggatctttggtattcttcttaaaattaacatgtctggccagacagcaaacatacttgagatagtcccaaaaggatacaagagtagcaccctttcggtgcgcctatctaaatgtctctcgggggatggcgggagacacacagagagagtggctatcctaagaaaggagagggacgaccatagggggctccattatacgcgctgttgctctcgccttagacctccgccagggaacttactctctgggtgaacctagacgggcggggaaatagaaccttggcgccgaagggggaccgcgcaccgcatatacaatgcgcagaggcggggatagtaacataggttaccgctacacaatggaagcacccgggtgggtttttccccctcacgggcgtgggtttacgagagagagtcggccatggtacggcgagtgacaatagtgacatagcatggcccacacaaggccctccgacagaggagggcaccctttggcgaaaaggaaaatgctttggttggcacacgaacttagcatggcagctacagaacgggcgggcacgacacgggcacaagaatggggggccccttggcaggcacctgtgagggacaggtggggccc

SEQ ID NO: 626688 - DNA, 185 bp, Homo sapiens
ctgagtcgtgctgttagcaaacctgatggtattcttggagtcgtgcatgggtgaacagggagtataggagtggattaatcacacacccctgaggggccccagtgttgatggtcagcatggtggatatgttgttgcctaccctcaccacctgggatgtcgacgcggccgcgaatttagtagtagta

SEQ ID NO: 626689 - DNA, 401 bp, Homo sapiens
caaacaatgccttctgggagggagggaaagaattggatgcacctggcactcaatccactcagtgcctggctgctgctgcggtcctggggctggaaggaactcccactggggacacatctacaaaggagtgcgtggcgcagcgaggacggctactgctggagccgccacacagcgaactacatacttttagaaagagcctctgtcgcatgggttgaacaacaccaccaccccagaaaacccccacaaaacctggggaaaaaatatctaaatctctgatagggctcttagctagcagggagttcagtatgacagcccagagtctaaaaatattaattaaaaataaattgctttgggtagcatttaaacctttcccattcaataaaagaattctgtaatgagga

SEQ ID NO: 626690 - DNA, 683 bp, Homo sapiens
cctggtacggcccgggaattatgggatcggtgcggatagcatgtggtgctggaagctctgtaggccgggagctcgatgagagctaacggactatccggttggacatctggaccgctggatccggaggtggcgaccccggcctgacccgtaccctaaatccgtccccggccctagtgtggcggaggcgcgctgctctatttccccctagagctgcggggccgcctgtttacgtcatgcagatctccatgtggagcccaccatgcctatttcaacagtggccttcggaatacattgccaatgctggtagatgacacgttgccaagactcaggtggccgggtgacagctgagtttctatggtaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacctaagcgacaacgcattcgggcccgacggtgtgcaaggcttcgaggccctg

SEQ ID NO: 626691 - DNA, 383 bp, Homo sapiens
  misc_feature (22)..(22): n is a, c, g, or t
  misc_feature (24)..(24): n is a, c, g, or t
  misc_feature (40)..(40): n is a, c, g, or t
gctctagaggatccacccgcgngncgaccttctgatatgnggtgaatatcccttcattcttgaggcatattcttgctgcatacacaattcagggtaatctgttttgtttttttctttaagcagttgaaaaatgatgggatacttcctgtctgccatactttctgatgagaaacctgttactcaaattgctgacacagctaatgtgttaatgtcctctagctaccttcaagatttcttctttggctttaattttcagaatttggactatgatgtgtctgagtatagatttctttggggttttcccatttggagttcactaagcttcccgaatgtaaaacacttatgtcttccgccaaactggaaaatttcagccattatttctt

SEQ ID NO: 626692 - DNA, 168 bp, Homo sapiens
acacacttcagccgggcatggtggcgcacgcgtataactcccacgttacttggcgcgcgctgaggcaggagaactcgtttgaacctgggacggcggaggttacagtgacgccgaggtcgcgtcgttgcacttacagactgggcaacaagaacgaacctccgttgcgca

SEQ ID NO: 626693 - DNA, 374 bp, Homo sapiens
tgcaagctgtagaaacccaggaacgatctgcaggaaacctctttccctttgtcaaccaacgtagttaggaagcagctttggatttgagtcaggccaattgggaatgtgactccacactcctccccctgagaagtctgcagattttcacttcctgctggaagttgtgggcagggaaagcagtgaatctggtccaggcaccttggggaaaagcaaagagagggaaaaacggtgcccagggaaaaggaatgctgctaaataatgaactaggatgcctccgccatcattccagaatcaggtggtatttgccaaagctctgattttcctcaccggaaaccctcggcaagggcactgcctgcggtgtagccattcctttt

SEQ ID NO: 626694 - DNA, 295 bp, Homo sapiens
tctggggtgacggggtacaagtaataccgtcgaaagaataccgcaagtggcgaagcggccttgtcatagactccgagatgtgctatcgcgcgcggcgggaagaggagagggatgtcagaatcgaacttgggatcaggaaggtggcagcagcgcctccatgtgctctgcgcggctgtcacgattgccacagcgcgctcctccccgcttcggcggtctaggatgtcctctccacacagtcacagggagagtgcggcctggcgcgccacaactgttctgggagaagtgcgcttgggtg

SEQ ID NO: 626695 - DNA, 508 bp, Homo sapiens
atggccttctcagccttgaaagggagccacttagggtcggtgtctgtgtaggagacaccaaggctgagatgcagacacccagtaggcgcgaggcaaatgcgtcccatttgaagaggcttgtatatatgagctctttgcttcctccctcccattaactttaaagaatggctctccatctccttgggcaaagttccttggccctttgtcttatttgggtgaacccctccagggtatttccagtccattggcatccaatctggcatcttaacggagagcggtctcatatgctatggtggtaaacgtgaactagtatttatgtgtggagaacactggctgttggacaggaaaggtgtgccaaaacaaagagtacggccggccctggaattgcatcagcaaaacccatttccccggtgcactcatgctgagctaccttccttcatttctgtcattactgctgagaacgtggactgtgcccagttgacctttcccttcctatgcctcatctggg

SEQ ID NO: 626696 - DNA, 143 bp, Homo sapiens
gcgggctgcacaaaggcaagtgcttcgctagttgccttccagttcatttcacctatgaatagatgtgtgaaaactgttcaacagtcctatacgctgcacatagtttggacgtgtcaaaccctgtagggtgattcagatggcga

SEQ ID NO: 626697 - DNA, 960 bp, Homo sapiens
  misc_feature (827)..(827): n is a, c, g, or t
tggcacatggaatatcgtcctccgatgccccgtccagaaggacctaggagagtaggtgagctttccaaagtatagagacgaatctttctttacttttgatatattaaatgggcaggatgggtatgcttagggctttctccttctgtggccccggaggcaaggagaggatctcgcaggcaacggctaacagtgattagtcactagtgagaactatgaaccggataacacccatggcaactgttccagcaaatctctagtagagaaatctgcattctctatcgatggaaagatataattgaactgatcataaagatgcttctgaaagagagaagtgtgccaaagcaagccgttatgtgttcaatgctttagtaagagactcagtagtcatagttttgcctactttgcagttcccaatagctagggacgtctcctggtattgaaactctcttcgtggagggcagagagggtgcctagagatgtgcactcagtaagtagctattgtagaggaccatgagagtatcgggtaacccaggtacgaagtacatgcttgacgcgtagtccgagggggacacgcgctttcttcatatactcttgtggcaactctaggtgagtggactatgtccttcccgaggatctattggccttggtcctgtatctctcgaggtccatgcgccgtttcaaaggtctataagcacctgacttaatggtgggggcccaggactatactccctttggacatacaagaagcaaggttgatttagggcgagaacttaagccgtaggagtttggggcaaagcgagaacagtatcgcaaggatctgggattcnttgctgtgagagaacgatggtttccccccacaggggaagttattcaatacaacgaaaggaaggcccaaggggactgtggtggcatgggaaggccacaaggaaaatcaagaaagttgccctggttgggaagtgg

SEQ ID NO: 626698 - DNA, 941 bp, Homo sapiens
  misc_feature (727)..(727): n is a, c, g, or t
  misc_feature (771)..(771): n is a, c, g, or t
tggacaaaagtaaaaatatttattttatcttaaaaatctgggtcccgcaaaagggccaacatttttttcagttcagggtcttgacctttcaaagaaagaaatctttcaactggagaggtgagttaataaagggattgtcagaggtgcttccagatttcttataaaccagtaaaccaagcaacccgggacttctagtttactggagctccttcttctagccattcacagttcctggaagggaagaaaaagaatgttggtttggcagataagggcgactttagaaaccaccaaagagaaaacccaagtctggccaggagctggcactggtgaactttgtgacgccgaagagggccaccagcagacagatgtggccaattcccaaaggttccatggacaacaggctatccaccttcctggccccaacatgtggtcccgttctgggtcttccagaacccgcctgggctctggggtggcctacctgggcctaagaatacttgggaaaccagacaactgggccagagatgaacactgttgcctgaagctcagggcagttgcccacaggggaggaatcccttcagaaggccccagtgtggggcacgccgagggagcagttcctttggcaaagcatgagtaaggggggatcagcactttagcaaagcaacatttttaacctatttttaaaagctggtaatccttccaatttccctcctgatggtagctcaagctngagctctaaacctgtgtaaaatcggcgagaacccctcctcgtgnagggcagatggactgaagtgggctcacagccagtggggcgtcaccggaaaagcctcccgctgaaactgtgatcatggtgaacactggaaacctgggaagggcagactgaatcctgggagaaatcaaccccttcttcgcggggggcagagtcaaacaggcatgcatggaga

SEQ ID NO: 626699 - DNA, 102 bp, Homo sapiens
gcctagtatcgagtctgtaatgtcgcggcggtgtaggtatgatgggcgttgaggggcgcatatgatcctaggctataatatcggagatacgtagcggtaatg

SEQ ID NO: 626700 - DNA, 433 bp, Homo sapiens
caggcagtgaagcgtcccaaagtgcggctgggattacatggcatgagccaccgtgccagccccagctagttatttttaaagacagggactcactatgttgctcaggctgatatctgaatccctggggtcaagcaatcctcctgcctcaggctcccaaagtgctgggattagaggcctgagccaagctgtctggcctatatcttagtcttaataatagtgaacacttactgagttattactcatataggggatcataactagcattttacatgttctgagttaatccttaaaacaactctgtgaggcaggtactattatccccatgttacagatgaggaatctgagctataggttaaatagtaagcagtcgatagcatttaacctcttgttgagatgagattttttttttacacagagtcttactctgtctccc

SEQ ID NO: 626701 - DNA, 173 bp, Homo sapiens
ggcagcgctggtagtcaactcctggctctagtgatctgcctgccttgctcccaaagtgctgggattacaggtgtgagccactgcaccctgcctcagtacctccatgcttcccacacaccctcctcatgtgctccttcctgacttctgggcccttccttccttttttttttttt

SEQ ID NO: 626702 - DNA, 269 bp, Homo sapiens
gagtttgcccaaagcttgctgtccgctgtgtagggctggtgagtggctgggtctgtctgagccatgaacaacttcaggtcctccatccttttttgggcagcggcagcatgttctaaatcatttcttgccttcgggagagatggacgaagttgcagttcaaaaatgcaggaatgccttgaaactacctgtcctggaagtcctacctggagggggctgggacaatctgcggatcgtgcacttgggacgagttatggcattgacttactcca

SEQ ID NO: 626703 - DNA, 356 bp, Homo sapiens
ctcgaggtcccatgcgcgacgcttccatcaagaatggggatcaagagacttcctccgagccggggagtttctttcctgccttcttcttttggctgttgtttctaaacaagaatcagtctatccacagagagtcccacgtgcctcagtgttcctatggcgtggccacgtgcacatgagctctccacgctccaatgacctgtttggttccaagtccctgtgagccagactgctgcgttttgggaggtggcacatttttcagtttgccgtattcccacacactccacaggttcaggtggcagggactcaggagtttcgtggagtctgttttccctttctcaccgcgagtcgtcgcgcat

SEQ ID NO: 626704 - DNA, 150 bp, Homo sapiens
  misc_feature (13)..(13): n is a, c, g, or t
  misc_feature (50)..(50): n is a, c, g, or t
  misc_feature (102)..(102): n is a, c, g, or t
  misc_feature (145)..(145): n is a, c, g, or t
actaattcgttgnacattcttgaagatgtaactggtatgactgtcaacanctggccctcttgggtttaggtggttgttccttgcacggagatccatgcctgnatctgcggtatactttttaggtgcctcattcgaccagttccgntggtt

SEQ ID NO: 626705 - DNA, 166 bp, Homo sapiens
catatctcttccagcctcatcatcgcatctggtgaaaagtctctcagaagtgcaaaagaggagaatcaataggaagagatgtgtcatggctcaggacttcaacgacactaaaacatctgggatttgaacgaaaactagaatcctgggttatccaagagactcatca

SEQ ID NO: 626706 - DNA, 343 bp, Homo sapiens
taatatcgatcttatgtctatctatgcggcagcgcatgcaggtgagctcgcagtaggaatgagtgtaagctgggctcgtgagatgctgcaggctctggtactcttcaaagtatatataactggtgaggcgaccctgacaggacttgagtggatggatggttttcctggagagggagactgaatacatgagaagtcaagggcagggcacactgagtgtagacaagtcctccagcacagcctatatagagctcactaggctgacatctgaggactctgctgtctaattctgtgctagaggggactactataggcgctactttgacttgtggggccaagggaccac

SEQ ID NO: 626707 - DNA, 932 bp, Homo sapiens
gacgacaatcgcccggaagcagatgggtggtgcgtggtgccccactaactcctgctatcaattggcagtggaccctcggggacctgttggatatgaagcccttcggtagatgatgctcttcgcgtgccgtccaactccacagttctggtgtacatggctgatcagctccgaggtaagccctggttccactggaaagtctgagccggcgtggagtgctgaggcactgctgtcatgctcaatggtgtgacttccatggtatcgagtgaaacgctactgatactagtacctgtgccattatgttgctcactggcttgcagagtgggcagcctaagcattggctactggatggaaccactgataggtagtagggtgcgtgacgtacaggagtcaccagttgttgaaagtgtcagtcaccttatcagcgtaccacatggacaatcacttgcccatcatctctgcgggcagcgaactgtgtctacagcaacctgtggagctggaaactgtgatctgccctagacgctctcttccagaagatgccctccaatcctttccaccctattccctaactctcgggacctcgtttgggagtgttctgtgggcttggacttgtgtcagagctgggagtagcattcggactctgggtcacatatccagctgagtgagagggtagacgtcaaaaagcctggagtgacgaatcctgcctctccccaaacattaatccatcaaacgtattacatgtacaacaaagtgtcaccccatcaccctggggaccatcacctggtgaccaccctaagtgcccattccccaaagaaaggatgaatcatatggtaagtgacaccaacggtcatgataggacacggcacagttgaacaagtcaacactcatggcaagggaagaccacaatcagacaacgtactatcagaggtaatccc

SEQ ID NO: 626708 - DNA, 1520 bp, Homo sapiens
actggcactatacagcctcttgacagcgtatgggctacaaacttggaatacgggagggaaattcaatagttaaacggctagcaggagtgtgtgaacaactagtgtgctgtgttctcgcaacggaagcagtctcgacaggatactggtgtattggtagggcacttaagagttaaggttcaccagggatagcatgtgcactggcataagctagagaacctgcggttaggctatgacacagtgtacctgcgtgcacattgagtctggcgctggtgagacgggaatacagctaagtcgtgggacttcggcctggtgggcagctacgcgaagttaggagagtgaaggacctcactaacggtgcaacacctatctagaaaccctgagtgacctcgactggtgcaaggagaacactgtgatcaacggtgacaatggactaatcttgcgtctctgctatcccgcctgtgtagtatctacgtgcctgaggtttgaatgtctggtaggccctcagaggtggaatgaagcaaatctatttcactccagccaagataacattagcggaccccgtgccccttaacgaaagactatggcacgcaggtctttggcatatacgacatctagtgcgttgcttcatgcaaccactaacaatcgagcagagtcgcctttccatcatctgtgatctaccccttggctctgggacaccatatcaagacaccagtatatcggtcaatcattgtatgtgaagcgtttgccatggtaattaggttcacacccaacacatatgtcttcaaggcaccaacttggaacttatttcttgaacagacacatttatgccccgtagtacggcgtgtgcgatgttatatagtccctgctagtgagtggaaacaaacgcgtggacgggcaccttgacaattttctcccagcaattactgcggttgcacgtaattcaagggcccaagacctaatttgtacccaccgtttttagggtattgaggtatacacttgtacgaaaggcagggaatttgcacacttttgcccttaaatatcccgagtagtgggtcctcacacagcttgtagcgcccaagaagatagcccaatggatctccaagacatctttgcctatgggccacctacaagcgccacaaacaagaaactttcccacactatgagtcccccacaattacaactgcaaaacacacagttcacaaacccagctcatatgaaacacacctccaataatgactcaacaatcgtcgtgtgatcacaacgtcatcctgctatccccctttaaatcctcaccaaatcaccctcatacacatgcagtcaaacaaaacacccacaaatacttcgccacccttcactccaataagcatttcaacaacccacaaaacaatatgataccaccaaaatattattgcttacattagtaacaaacttcctacgtcaaatcacacaactaatatcaaacctaacaaacaaatcaaacacacaaatacaacacaaaacaacatctaactaatcataaa

SEQ ID NO: 626709 - DNA, 321 bp, Homo sapiens
gaaattcccggaacccgttttgaaccggggaagggcccggggggtttttttcccccccaaaaaacccccggggaaaatttttctcctgaaaaaaaacgggggagaaattggttccccaaaatttttttttttttgggcaaaaacccccccccccccccggatttgtcccccccgggttttggtgttttttgtttcggaaaaaaggaaccaaagggggccaaaaattaatttttttaagaaacccaaggggtttggggtttgggatttgggggcccccattttaaaggcccccccttcccaaaaaaaattttttccccctta

SEQ ID NO: 626710 - DNA, 116 bp, Homo sapiens
gcggtttggtcgttcgttgggcggtgttggtttttcgctcgtcggctgcggctcttccccgggccgcagaaggaacgcggccggttcgcggagtaagctccccataaagcgttggt

SEQ ID NO: 626711 - DNA, 243 bp, Homo sapiens
cggcccgaattctaattacgggtgcgccccagtacagacgtctccatgcaaagcaggagtagcctgcaattagccagaagaattctgcagcaaatgtggttacaggctaaaggttgctctaaatttgacagctcgagctacagctataaatagtttattgggttgaaatttttttttgtctttgtcaggacatttttgcttcatctgaacattttctacaaaatagtgttacagctatggttg

SEQ ID NO: 626712 - DNA, 410 bp, Homo sapiens
ccagctacatcagcaatcatcgagcctcccctatcagtcagctatatgaccactctcaggagcccactactatcgctatgatgagcagttcaacctgtggcttgagcggctgagttctggcaaagacaagaataaaagcgttctgtagaaccaggattttcgatgttctgttagagctgaggtacgccatcttcgggagggtcctgtgttaccgcttgatgctaagaccctcaggatgttgcagcttccctttttgacaatgaagttcttccgtgatcacattacaatgaagcagatattgctctcccgctggttcggcaaggtaagccatggccacctctctgtgattacaccccctttaaaattccccacccgggtaccgaggcccaatttggtaatcttggcctatc

SEQ ID NO: 626713 - DNA, 121 bp, Homo sapiens
aatgacaagagaagagcaagtggagcctcaatcagctgtagttattgttgtagtctttgtttgagacagagtctcgcatctgtcgagggtaccagagacttcagtaattcagtaatcatgg

SEQ ID NO: 626714 - DNA, 151 bp, Homo sapiens
gctcagactcacgtcgcactcctagtcagttcagacttgtcggaactcggaacactcgagacccgaaatttctaaccgcacgcttacccatcagcggaccgtcgtacagatacctcgggattctgaagagcttaccataccaaggttaact

SEQ ID NO: 626715 - DNA, 667 bp, Homo sapiens
  misc_feature (1)..(1): n is a, c, g, or t
  misc_feature (93)..(94): n is a, c, g, or t
  misc_feature (207)..(207): n is a, c, g, or t
  misc_feature (229)..(229): n is a, c, g, or t
  misc_feature (233)..(233): n is a, c, g, or t
  misc_feature (241)..(241): n is a, c, g, or t
  misc_feature (252)..(252): n is a, c, g, or t
  misc_feature (255)..(255): n is a, c, g, or t
  misc_feature (271)..(271): n is a, c, g, or t
  misc_feature (311)..(311): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (324)..(324): n is a, c, g, or t
  misc_feature (357)..(357): n is a, c, g, or t
  misc_feature (376)..(377): n is a, c, g, or t
  misc_feature (392)..(392): n is a, c, g, or t
  misc_feature (397)..(398): n is a, c, g, or t
  misc_feature (410)..(410): n is a, c, g, or t
  misc_feature (416)..(416): n is a, c, g, or t
  misc_feature (461)..(461): n is a, c, g, or t
  misc_feature (490)..(490): n is a, c, g, or t
  misc_feature (504)..(504): n is a, c, g, or t
  misc_feature (568)..(569): n is a, c, g, or t
  misc_feature (573)..(573): n is a, c, g, or t
  misc_feature (595)..(595): n is a, c, g, or t
  misc_feature (663)..(663): n is a, c, g, or t
naagaaaacaaacaagcaaacaaaaacaattcaattcaattggatccagctccttaccctcttgtttgtagaaaaagagcatcatctcctaannaaactttcttcttcagattttgtttctgtattactccactcttattttctaaatacctctttaagccatcatttcataactgtagttagaaaaggctttgcgcattttttctnattattttttcatttttagatngacnacaagcantttcatggganaantcttcttttttgtatnttctttagatggtaggtcagttctgttcagggtactgtcngtttntnanccancacaaatagagaatcctattttttaaggaggtnttttgaaagtgctcccagnntctaagcatttatanaattnnaattgttgtttnaaagtntaaaatactaaaggtggcattattccaggagctactgtttaaaanaatgcaatgcccgttcagagaagaaaatnagtgtttgaaaatntgagtttgtttaaaaaataataactatgcgtccaaaaagaattcctgaagaagcacttatatgnnaggnacatgtttttaattttaataanattggtttacctaaataaatatgtagaacctaataattgttctctatatattcatactttaatactantcta

SEQ ID NO: 626716 - DNA, 1734 bp, Homo sapiens
  misc_feature (529)..(529): n is a, c, g, or t
  misc_feature (956)..(956): n is a, c, g, or t
  misc_feature (1095)..(1095): n is a, c, g, or t
  misc_feature (1427)..(1427): n is a, c, g, or t
  misc_feature (1447)..(1447): n is a, c, g, or t
ggaaacgctgcttctgctccctcgctgcgggtgtttgattggctccccgtacctttttgtttggtgagatgtttcctcaccaccacgcgtcgtgttgttatttatcataacgcgggagtgtcttatccacatgcgcccgccacgcctgcttgttggtgataggcgagacatagtttggtgtgattatatatcgccccgccccacacaggagtgggcccccccaggtttgcggccgcccctcttcttttcacagggtggtctcctcctgtgggtggtagttgtgggagacctccccgtctgtggcgcgccgcccctcttgttggggagagattttctcttctcaccacccaagccccggcgggcacaccaccccaccgccccccaccgatgagtcgtgcgcgccgaacgcttattttttttgtgcggcgcgccccacctagtagagcccccacaggagagaatgattgtttgtccgcctgtgggagagtgtgtgtgggcggcccctgtttgttctttcctccctcttcgntgtgagcccacatggccgccgggctccacacaggaagttgttggtgttccttcttctccgggagagttttcttctccgggacgggagattgtatgtgacacccctctgcgttgcccacaacgctccttcttttttggtggaagatttaatccccccctcggcggggctggttgtttggtgtggcgccccacacaagtagaaccgcagcacgtcgtgtgttccccacgcgggaatttgttggaggaggcgcccccccgccgtcctccaacgagaaaagttgtgtgtgttgtttttctctttttggtgtgtgttgccccgccccgcctttgttttttcggcgcgtccccctcaaggccacagggctactggtccgttcaaccccccgtcagttgtgcaagtattcgctgttcgtctcccccgtgtttgngtccctcggtggggaacccaccaaaagcttgggttccaccaaagggtttatttgggagaacacccctcgcgggccttatatacgtgtccacaccacgtcttggtagatagaggcccccacccacacccaccttgtgggncacacacaccacgcggccttatattcttgagaccacacgcgcgtgacacgtgtttctctctctccacgcgatggggagttcccccctctcgtgcttcttttcttgtggaaggccccacgggagtgtggcccccacgcgccccactcgttttatatgggattatttcttctccacccgcagagaggccacacacacacaccgtctgtacacacgcgcgctatagagatggtttgggggagcacttcactcacacaccccccctcgtggtctgttcaccgccctcttaccccgcgtatctctctggctctgtggttgtgctcgccacacacagngctcccaccgcactctctcnagagttctcgggagtattatagagagggagaaagagttactcttgtagaatgtaactgtaacacccagaaagattactccagtacccacccaccctagagccagaacccacccccagtgccaccctcccctggccctggtcttgtctgtatggcccagaacatcttgttttgcctggctacacaccggcaccacacactggtgcgagtttgcccggtgacccttggccaccccctagaaagatttatggccgaacctttcacccaattaaaaaaaaactggcttttc

SEQ ID NO: 626717 - DNA, 261 bp, Homo sapiens
gttttagatggaaataaggaagttattgggaactggaataaacgtcactcatgttacaccctagcaaagaactcctgcattgtgttcatgtaccaaggatctgtggaaggttgaatttaagagtggtaatttagggtctctggcagaagaaatttctaagcagcaaagcattcaagatgtggcctgactccttgtaacaacctgtgatcagatatgggagcaaagggaatgacttaaagtgggacctaatttccaaagggg

SEQ ID NO: 626718 - DNA, 393 bp, Homo sapiens
  misc_feature (58)..(58): n is a, c, g, or t
  misc_feature (66)..(66): n is a, c, g, or t
  misc_feature (210)..(210): n is a, c, g, or t
  misc_feature (226)..(226): n is a, c, g, or t
ttatttttaaaccaatctcagttgacctttttacccacccagtctgctggttatactnatgggctntcatagtgtctttccccaaagagaaactggcagctaattgttcctatgccttgagcaactctggtcatggactgttgggttgtctggccttagcataccagattaccccgtttgcctgccagtactggggtatccgggcccagntatgtgtgtgtttgtncagtggatgggagggaagcagccgcctggtggagggagtgttagggatggaagagatgccttactttctgtcaagagaaaggtgttttttctttaattgttcaaagtggacgtgtttactcaattcatttctttattaattcatttctttatttaaaaaaaacaaca

SEQ ID NO: 626719 - DNA, 701 bp, Homo sapiens
tcgttgttcttggtgttcctgggtgttctggggtgccggtgttgttcttgtccttcgctgatgtgcggttggcgctggttggtgcttgtgttgctgaatgtggtctatggtcctcggttagtgttggtggtttgggtgtgagtgggtcgttgaataggtgtgcggttctagtgtccgacggtttgttgcttgtgcggcctgatgggtattatggtggtgctcgggacagtgctgcacgcgcggatctcaatttgttggtggtatactctttcgtgttgctatagttctgttgttgccctggagtgtttgtggtcactttcttggtgtgtgatgtgtcgcagtgatgtatttggctgtgtatgacgctggtttcagtgagctggagatggcgtgagcgtctgtctgagtggttcgtgtcgccttgctcgctgtttgccggcgtgtgtgtgtgtggtgccctgtcgtcgggggtttcttgcgctatgcttcattgatgtccccctcgccgctctgacagcagttggttgtgtccggcgtttttcttgctttgaatgcatcttgatacacctctaatctcaatcattgttctgtatctatctaaaatagtgaataaatcattgagaggatcatatactttgatagtatcaatacgacctatcaatataataataacaacaatacataacaattatcccacaaac

SEQ ID NO: 626720 - DNA, 1162 bp, Homo sapiens
  misc_feature (115)..(115): n is a, c, g, or t
  misc_feature (120)..(121): n is a, c, g, or t
  misc_feature (124)..(124): n is a, c, g, or t
  misc_feature (146)..(146): n is a, c, g, or t
  misc_feature (153)..(154): n is a, c, g, or t
  misc_feature (161)..(161): n is a, c, g, or t
  misc_feature (164)..(164): n is a, c, g, or t
  misc_feature (171)..(172): n is a, c, g, or t
  misc_feature (175)..(175): n is a, c, g, or t
  misc_feature (185)..(185): n is a, c, g, or t
ccattattttggatttattgcattctgaagtactccggggggagggcctgagaacgatccgctttatcagcagttctaaagccttattacctgagatttatattctggggggaanaatcnnatnggattatcatacgtatttcacnggagatnngagtttnggncctgacnnganacacgtactnacctggaaaagaggctacggtggagaattaaagaagagaaaacgggtaaacaccaaatccggggtgagaagaagaacgtcgattctaaaaggccagccactcacgtggtagcggtgacaaagtcccctcggggggtagccaggagcagaagcggtgagccacgtggcagtggaagcggtgggccacaaagggccacactccccagggagcccacaagcaagcccaggggaggcctggggagcagcttggcctcaggccgaagtcacttctcatcatccgggccatagttaatcgtctgtaaggcctgagctatgagcatcggcatctcccgggtgctggccgcaaccacttcgtgcaagccatgaggtgcgaggggtccacccgaaggggctatcacgatgccgacgggattctcgtgatgatgacgggggcaagccgccagaatcccagaagtgcaggcaaacgggtaataggcatccggggccctgtaggcagggggcagaagtgccatgtgggagcttccaatcactcgggaccccatgcgcctgggaatgacaaagcgctccatgttacccaggaacaggtacgggacagcagggcacgttgggggccactctgtcaaacccaggccttgagaacctggtccccgggagaaccggggacggtgggcatgtgaaaaggggccggaaccccggcgccgtgtataagggccctgtgtggtggggaaaaaaaccgcgattaaaggcatgttgtaagaaaacaaatggtaggggggaagatggttctaaaggaggggggagaaaaatctggggggaagtagggcacgtttaaaggggaaagtgggattataaataggcggggacacaacaaggagaagctatgatggaccagggggtgacgacaaacaacttgtaggtgtctagtgtgtgacgttagttagtgtgttatttgtggttggaggatgatagagagagtgc

SEQ ID NO: 626721 - DNA, 1052 bp, Homo sapiens
gggcacagccaccgctcatgtggactcagcttgagtatcccattagtcccgagacgctcgacccactgcaagattcctttcccgtgcagacatggcctcatggcaccacacacacaccgccgctgaagatcggaatacattggtggaacaggcctggctgatccagcacttttagacaggaagaactgaaaaatatgtggatactccatttggcaagccatctgatgccttactacggggacgctcacaaaatgttgatagcatcctccttgcaaggcatgcaaggcagacacaccatcatgccttcaaaggtcaactaccaggcgaacatctgggacttcgaaggaagagggctgtacacaatgtcatagtgaccacagctagtggatccttgaaggaggagactacagcccggagaatattgtcattcatcgattcagtacattcaccagggacacaactatgaagaactcaagaccatacacatatgcatgcgacagtcaattcatatgttcccagacgaagatgtgccattcatccacatgtgcatacacccgatatagcctaaaacacgagacaaggatccctcgataacaaaacgagcacaccgacacgccacggcacaccagagatgccactcacaaagagcgcacacatcggacacacaaccccaagggacccacggtaataagaaaccgggagacccacacgatacacgaaccgcaaactcagaagaccacgaaataactaactccccatgggacaacaaaacccacagatgtggaaacgggcaaacacacagcgaagaacatagagaacaccaaacactccccaatagcgcaaccgataatgaaccactctgcaacaggtcagaccgaccacacaattatgtgaggacacggacttaaaacagccatagagacacaacacatcatactgcacacaactacaagacacacccaacaagaagaaatgttgccacagcagcctccaataccagactactcccaagacaataccgctatgttaaccaaccgcgaattaacggtcca

SEQ ID NO: 626722 - DNA, 929 bp, Homo sapiens
ccagcccatgacccctaacaagggccctctcagacctcctaatgacctccggctagccatgtgatttcacttccactccataagcgctcctcatactaggaactactagaccaacacagtaaccatataccaatgatggcgcgatgtaagacgagagaagcacataccaaggcacaccacgcaccacctgtccagagagaaggccttcgatatagggagtaactcctattgtattacctcagaaatgaaacttctatcgcaggattttatctgagacctgtatataccacatccaagcctagtcccctaccccaccaattgaggagggcacaaggtccccagcaggcatcaacccgctaaatcccctagaagttccactcacttaaagagtatccgtgttactcgcactctaggagtatcacatcacctgaggcgtgcaccatagtgctaaatagaaaacaatccgaaatcgaataatacaccgcactgttaattacaaggtgtaccgagtcgctgattgtaccgctgcctacaatgcctcgagagtacctgacgaagtctccgctatcagcattatccgacgggatgcgacggctcagcatggtggtagccacaggtcttccaacggagttcgcggcattatgggctcaattttgcatcactgatcgtgattcagtcacggcaactaaatatttcagttttgacaatccgaaagctgtgtacttgtgggtttcgaaaggcagccggctgagtactggaattttggtagaatggtgggtttggcctaattgcgtggatggtgcccgatcctaatggatgagggggtcttaaaaaaaaatgggcataaaggggatgggtggaaataaaaaaaaagagggggggggggtataaaaatataaccgtgagaggagcacaggttaaacagataa

SEQ ID NO: 626723 - DNA, 453 bp, Homo sapiens
ccagtcggtgctttataaactgcttatcccatttgtccactgaaaatacaacctagattccgttcagttaaatatctgttgaaggaggtcacatgaataagattgctccaactcattcttgctggtgtgctcccgagggttaatataatatagttcgtgtcttctcagtcgtgaggaacaccacttgtcacttaaatcttccctgggatgcttcgtacattctcagcctagatacaaatgggatgcgacagttgagggtctccaggtcataaacgaatatgtcaacttgcttagagatgattgcagtgatctgcgtccttgcatgagccctacgcactccttcggtgaggtacaagaagtggtagttggtcagactcaggatttcctggtctgctcacaggttaaaggaaagcactcagctttcccgtgtgctattcccacatctcctcatat

SEQ ID NO: 626724 - DNA, 550 bp, Homo sapiens
gggggggaaaagaaaaacccatagttttattctgatgctgaatgaaaataaatcatgtgtaatcattcagctggttattgtgaaaaaaattatgccaccttgtgggccgtttgggccaatgcattttaaacttcattcgcgttattgagcccggccaaagtttagcgtaagtggtaaaacttcccggatgtggagtgaatatacatacaacggcacgtttttttaaaatgtacgacgaccgagaaccctcgtgtaaccccaaattaatgtattgacagaaaatccctcttggaacacttttctgaaaacgaaataggccggcacgttcgcctttctaaaaatggacctcctgaatggaggggaaaattgttcgcgtattttccgataaaacccgcgtaaattttggtaaatagctaaattttaaaccaaagggcaaaaatcgtgaaatcctttttataaaaaagaattacaccgaatagggtttaggttgtttccctttgtgcaacaaaattcctttataaagaaccgtgggttccacgttaaaaggaaa

SEQ ID NO: 626725 - DNA, 146 bp, Homo sapiens
gacgatccaagaatacacgctggagtccctctacgggaggcgctgcgcttacgtgaggtgctgagcaaggccccacatggtggagggttgcagattctgagaggcgtttctgtggggtgagagcagagttgggtggtccgagcgga

SEQ ID NO: 626726 - DNA, 158 bp, Homo sapiens
  misc_feature (155)..(155): n is a, c, g, or t
acggggtacggacgtcaggtacgttacgtacttacggacggaggggtagttacgaggggatcggacggacaacaggttggggacaccacgctacacactacggttgttgtagactttggtatacacaacacactacgtacgacgggactgactgncta

SEQ ID NO: 626727 - DNA, 509 bp, Homo sapiens
  misc_feature (35)..(35): n is a, c, g, or t
  misc_feature (106)..(106): n is a, c, g, or t
  misc_feature (148)..(148): n is a, c, g, or t
aagaaagttttttcggtgttctgggaggaagaaanttaggtgtcacggggaaaggttccctggtgtgggcggcccaccccacctgccttccttcagcacctttagngggatttggaagccaggggttaacccattgccttatttatantaggatggtcatggcccacacatacccgtcatagaagaaaaaagggggggttttttttgatttttaggggggatttttttggctgcgggaggactaaaggggacttaatggtactaaggttaaaggcgggcccttttccctttatatatattttttaaagggggggggggggttttggccttttttaaaaaccccctttatattacattgggaaccctgaaactttaatcagagggttagccttgaaattggggacttttgggaagggtattagggaggtttgccactaaactaaaccgggaaaattttgatggttggttttaaaagattaatggaaaataaacatttttgtccccccgga

SEQ ID NO: 626728 - DNA, 157 bp, Homo sapiens
  misc_feature (28)..(28): n is a, c, g, or t
  misc_feature (35)..(35): n is a, c, g, or t
  misc_feature (68)..(68): n is a, c, g, or t
  misc_feature (112)..(112): n is a, c, g, or t
tttctcctacaagtgagattttagatantgttaancctgccagtctttctcttcaagccagggtgcancctcagaaacctactcaacacagcactctaggcagccactatcnatcaattgctagttgacactctgcattaaatctatttgccatttc

SEQ ID NO: 626729 - DNA, 1298 bp, Homo sapiens
  misc_feature (1043)..(1043): n is a, c, g, or t
gaacgtgctgcaggcgccggctgtgcgctgagaatggcggaaatggatcctggtatgccgagttcccccagtctcccaggtgctgcgcgctggggctgaggttatggctcgcttcgcggccatggctgtgcgcgcagggccggcggatgatgttggtaacgtcagggcggcaccagggtcccacttgataaggcgcaggtcggtggcggtttcctgggaacaattttcaggaagcgaggcgatcgctgattgcaacccttcgagccgaagggcctatcgataagcacggccgggataacggggggtccgtggtacgtaggtattcaggcggctacgggatctgggcctttatccgcgccttaatggccaaaacaggttttacacaagatcgccaagaaacttgggcgtagagaccgggaatgcttgggagggccataccggggcccccaagcccgtttttacaggagcttacgttagaggccctgggaaggccaggatggaaaaaattcggactttcgcgggaggcaatggggacagagaagggggccaccttgagagaagacgcgatacccaaaagggaagggtctagcagcgatatgaagcagggcacacacattcccttggggacagtaaaaaaggttccacacccaagtttggggcggaagcactaaattagcggtttcttggtaggcatgtcttagaagccacagggactcaaaatcccgcttaagaacccatttctgtgccaattgtttataacccgggacatcaagctggtcgcacggaatcccaatggaaccggtctccacacaattgctggagaacagaaatcagaccacttggggggccccacggcggataaccaacgcaacatgctgccacaagggtctcccatgcggaaaacagtgcgccccaaaagttaaaacccagatggggagaggacgcgattgataacgagcaggacaccggaagataaccacggggggggaaaacttggacagccggggttctgatcacagcgacacacgctgtggcggacaacngcgagcgagaagattctcccctcagcagacatccacgatcgttcctccctgtcagccgtctgcatctagatcaccaccgggacgagcaagacgcaagcgacagggagagagaagcaagcggccccacagtgacgagacgacagacgagaggcagacagtagcagcccgagaggagacaacacacaacaacaaccagacgagagacgcgagagacaagaccaagagtcagcacgagccagaggcggcaagagagca

SEQ ID NO: 626730 - DNA, 1360 bp, Homo sapiens
  misc_feature (332)..(332): n is a, c, g, or t
gctctggaaggttgtcctgtgatcgacgcacatgcttggtagcctgatacacacatgtccctggctaactgtgttgcatcactcaattggtgctgtttcgcgtgcttatgcctacgaccgactcgctgcatgaggttgcatgaatccactggaaatagtgtcgtgggcgcttgcgaactgacgcgtctatcagtttgactctcttacctagtagttgcttccacgatggtctctcatagaatggactatctcgagcgctctagtggacactatttctcactgggacaagcagatgctaggggttgtaagcaccagggaggactgactttgtncactctaactcgccagaaatccatcattctactccatcgttaacgcaagcatgtccgaagggatcgccatgcccagtatatctacatgtgtggcgtgctcgtatggacatagcgccgccctttatcttcaacgtgtttgtcgagaggttccccacatttgtctgataccttaccacacggaccatttggggagccaaagggggcgcctgggtgggcgacctattgtatggcacttggagccgtgggaaagtggcaccaaccaaaggggttgtttctattgccacttcgtcccattagacaacacgtgcatacaatagcccctaggaaggggccttctcgcgctagttgaatttgcgggcaacaatggggttggttttggtagatcccctcttggtaaacggctatatggtatccacaactacgttcccctcctagagggaatcctttttccatggccataccaggttccatttacgtgtgaccaccccaagccagaagctggcaattaaagaaatccccttacgtgtagaaacccattgggggtctcattcccaatgtaaccataagaatgtatgcgtctatttcgcgtgagaccttgcgctccttggggtaagaccactatgagcgttcacacaagtgtgcgcgaaatcgagcgttggtccaccccccaaaggaaagaaagcgttgtggggaagtattaggtacccctttacctggtggaacaaacgttgttgggccaggtagatatagcgctcgggagggcggtgtcgtactacacacgacaccttatttgacttctccctttgtccttctttactttgggtcgccttggccacattgggctttgtcgtgagggctaacgtggtcgagtgccacgtggcacgtcttgatacttggtggagatgcttcatcttggcgtcgttagggtccttttgccggttggtttgcggagcttgggcctacccgttgttcatgtcggttccggaggccgttgcacccttgaccggtcctcagttccaaaggccttg

SEQ ID NO: 626731 - DNA, 1293 bp, Homo sapiens
ggcggagctgaacgtggacagtctcatcacccggctgctggagcagccattgtggatgagaagatcttctgttgtcatggcggattgtcaccagacctgcaactctatggagcacgattcggcagaattatgagacctactgatgtccctgatacaggtccgctctgtgccattcgcgtatgcgtctgcatcccaccatcacggcatgtgccaaggctggcggcagcacacaatgccatcgctggtgctatccattctacctcttcggcacgctgatgctagtccagtcccacatctccatcgccacatccgtccatgcattctcagcattctgcatcttgctcggccagctcccatcccagcgctggcggtgggcacacgcatgcgcataatgccaattctatcactcgcctcacgcaccgcacccagcgccgcgctaccgccccgatctactgcttttccaatgccctcccgacacacgtctcaccctggttgtgccggcacgcctctctcgcaattcaccctagacctcggcctcgcgcaaccttggcactcgcagctggttcgcgcaccttgcacacacccttctctgacactaggctacggctcaccaaattctagaacacacgacccctactcttccggcacacacacctcaacctccgtcgggcacacaaaccgcgacacataggcctataacccagtaaccacccacacgcttaccttcgcgcatcggcgcacccctagcgccaccttcctcttggccacctcgacatcacccctgggctatcacacgctacccacaccccttacgcacacaccctagggctacttaaaccttcccccgggttccctgacaatcgcaaaaaacacaccgcgggattggtcaccggcaacaccacgcggcacaacgtttttcctgtgcgctatcaaccgtgcatcccagacctccaactctcccgcaggcacctacttatgggacttacacacgctggcacctccatgctacattgtgcacaggttacgacgcttacccgtctctctacagccagcttttcgttgtacgacaaccgttggctacatccaagcaccccgccattgtcgccacgtgcccccaagctcatcgacggacaaaccacccgccatttctacattggatatacggcatcttaccccacccgccccggttatctaaccacgctcttacacatgcggtagcgacaacggcgcgcgataaaaccacgcgcactatctcgtccacacacaaatttatgttcagtaactatctgacag

SEQ ID NO: 626732 - DNA, 895 bp, Homo sapiens
ggctaccaccgctgccgtcgccgccgccattttgatggcaggaagagtccggttctgggacagctggagacagtggtggtgactgaaataactttaccaagggaaagctattttgcgaactatcttctccagcggagatggcaattagaaacggggtttcaccatgtttggccaggctagacctcaggtaaatccaaccaccttctgctccctaagtgctgggatttaccaggccaatgagccaatgcaacccaggccaaggatttgaagaaatctccaacagggttaaaacggggtggcttttgtaaccacgagcccagaactggttttccctattctccccaggatttggctcttttaggtttaaacagggttgtccaaattcccaaaagcctttttgcgactggcaggatccaatccaggttcgggatgagtctcatgggttggctgctggcaaccttccaggatattattgctctcggaacaaggttgttggcctggattggaaactaatgggaaccctttgggaaccttccaaagaatcaggaagggttccaagctttccttggggaacaccattaggtctttggatttgttcaaccttcaatgggacttgctttcaccaggaaggaaaaaggcctggttccattaaaacttttgccctgatgtttctagcagaacctttttattcaaagtgaacagaccattgagtttggtgatgggccccactcattgttgaaatgacatttccagggtaattgatgcccctgtttgaaccaagaaattaaacagtgcaggaaactttcactttgaaagtgcccagcagttagaagtgtggcataccaaaccttgttccagaattggtgcgaaaaaggattttgaatccacggtttcc

SEQ ID NO: 626733 - DNA, 946 bp, Homo sapiens
  misc_feature (2)..(2): n is a, c, g, or t
  misc_feature (111)..(111): n is a, c, g, or t
  misc_feature (144)..(144): n is a, c, g, or t
  misc_feature (152)..(152): n is a, c, g, or t
  misc_feature (223)..(223): n is a, c, g, or t
  misc_feature (239)..(239): n is a, c, g, or t
  misc_feature (247)..(247): n is a, c, g, or t
  misc_feature (255)..(255): n is a, c, g, or t
  misc_feature (325)..(325): n is a, c, g, or t
  misc_feature (347)..(347): n is a, c, g, or t
  misc_feature (363)..(363): n is a, c, g, or t
  misc_feature (376)..(376): n is a, c, g, or t
  misc_feature (458)..(458): n is a, c, g, or t
  misc_feature (485)..(485): n is a, c, g, or t
  misc_feature (501)..(501): n is a, c, g, or t
  misc_feature (509)..(509): n is a, c, g, or t
  misc_feature (512)..(512): n is a, c, g, or t
  misc_feature (514)..(514): n is a, c, g, or t
  misc_feature (516)..(516): n is a, c, g, or t
  misc_feature (528)..(529): n is a, c, g, or t
  misc_feature (553)..(554): n is a, c, g, or t
  misc_feature (574)..(574): n is a, c, g, or t
  misc_feature (587)..(587): n is a, c, g, or t
  misc_feature (610)..(610): n is a, c, g, or t
  misc_feature (639)..(639): n is a, c, g, or t
  misc_feature (650)..(650): n is a, c, g, or t
  misc_feature (663)..(664): n is a, c, g, or t
  misc_feature (667)..(667): n is a, c, g, or t
  misc_feature (672)..(672): n is a, c, g, or t
  misc_feature (755)..(756): n is a, c, g, or t
  misc_feature (833)..(833): n is a, c, g, or t
  misc_feature (926)..(926): n is a, c, g, or t
tngggtaggaaaagccattgaggaggaactacaagagattgcctctgagcccacaaacaagcatctcttctatgccgaagacttcagcacaatggatgagataagtgaaanactcaagaaaggcatctgtgaagctctagaagnctcttttnaaagacaggactctccagcaggggaactgccaaaaacggtccaacagccaacagtgcaacacagatatctntttgaagaagacaatnttttacgntctacacnaaagctttcccattcaacaaaaccttcggagcccttgcgagcaaaaagcacgaccatgcaaatgtgaaanccttataatgttccagaacctngcaaacgaagaagtangaaaattaacacngcgcttagaagaaatgacacagaaaatggaagccctggaaaatcgcctgagatacagatgaagattagcaaatcgcgcagcngcattggtagtcattgtatcacggatnacaatgagaacgccgngcggggcnccnangntcaggctattgnnaaatcaataatgttgtgaagtaanncaatcaggactgagaaaccnggtttgccacagnacaaagacaagaagtatacactnacttgtataaatttatctaggaaaaaaanccctcagaatnctaagatgaattnnccnggtgngaatgaataagctatgcaaggtattttgtaatatactgtggacacaacttgcttctgcctcatcctgccttagtgtgcaatcnncatttgactatacgataaagtttgcacagtcttacttctgtagaacactggccataggaaatgctgtttttttgtantggactttaccttgatatatgtatatggatgtatgcataaaatcataggacatatgtacttgtggaacaagttggattttttatacaatattnaaattcaccacttgcagaaa

SEQ ID NO: 626734 - DNA, 467 bp, Homo sapiens
aaataacctgcggaagacgggtagtctgtgtaagacgtgtagcctgaggaagacggaaccattgacttcccggagttcctgaccatgatggccacaaaggggaagggcacagacagtgaggaggagatccgagagccgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctctttcaacactccccttgcgtacccggtttctagcaaacaccaattgattgactgagaatctgataaagcaacaaaagatt

SEQ ID NO: 626735 - DNA, 115 bp, Homo sapiens
atctggcctcagccgtgtcttctcaagtgcagcttctgcctggcagcttcctcctcctccaggctgttcttcaaggtccagcatcgtgtgggccatcttcttcctttcagacctg

SEQ ID NO: 626736 - DNA, 600 bp, Homo sapiens
atctctttagtaaagtggatgtttaaatctattgaccattatatagagttatttgtccttttatatattcatttattattaggagatggtgtctcactccctcttcacccaggctggcatgcagtggcatgatgctggctcactgcaacctctactggctgggttcaagcaattctcctgcttcagcctcccgagtagctaggattacaggcatgtgccaccagtgcctggctaagttttctattttatagtagaaatggggcttcaccacataggccagtctggtctcagactcattacctcaagtgatccacccgcctcggactcccaaagggctgggattacaggcgtgaaccaccattcctggccaggaaatgactttggagtgggaatattggaggttcctggcttcagagtgacaatagctctttaattagtaagagtctttttaataaaaggctcatatattcccttaaattggctgtcttacgtgcaaacattacagaaatggctttcagaccttcttagtcactttgaacccattgtttctttaacatcaaggagagtactcttcagtacggaaagagcacccagctctgc

SEQ ID NO: 626737 - DNA, 282 bp, Homo sapiens
taaatggtgtatggatactacaggaatggataacatttaactgtattttgcagccgtacttcttgggatacaattgtctaactttttatatttgggctggctgttgtggtgtgcaaaactccgtacattggtattttggcacactgcaacaccttacagatgtggcagatgtgcaatttgtccatccattattggataacctaaatactcagaggattatattcatcggattgggagaactggtgcgcggacccaaaaagggccaggcatataggtagggga

SEQ ID NO: 626738 - DNA, 1047 bp, Homo sapiens
  misc_feature (1027)..(1027): n is a, c, g, or t
aggaacgtggtggacggacgcgagcggtaagatgccagattgttctaacttcctacgtgatgaacgatctgtgtgacttcatcttagcatatgcgatgcggactacggagcagataggcaaagctactccaaagaacgtcgcttcgaccaggagtcgagatgaaagggagactatggtatcagtgtaccatctgaggcctgcaagggagctcctaccggaatcggcaagggcactgaggaccgggacgggagacgactacctatagggggggtcaacacagaggaccacgacgagagacaggcaactcgcaagagcacacgagatggaaagacctggtgccagcacaggatgcagaatgcatcattcctatcagacctatcagacaaccgacctggaacgaaggcttgcgcataaccggggctgcgagaggcgcgagggaagaggtgccctagtaggtagtgaacttgaaggagaatccctggattggggggacacgtaccaagggaacgtgccaagacggagaacttgaccgcgcgaaactcagagaggtgacgagattgaccgagcgaccttagtgagtgcggagagagatgagccaaatacagagagacgccacgaggagtcgctcgggaccgatgtgctgcgcggcgatccaacactgcgtcgattggcccgcgactgagcgggaggcgaggggtagtcgagtgaaacccgggtctccgacgttccataaacgtgcggggtccaggcaaacacggcaggggaaatttcaattcataaattccccagaaaagagaagaaattccagcagaggaagaatttactggagcaccggcaattcacagacttctttagggaagcgacccagaagtccaataagggctttgttcgggaattgacgaggggtcacgacaattgacaaggggggagaactgtccaacgcttggcaaaagcctatgaaatagggagcgctccctccagagcaatatgtcgggaagagattccccgcgagagggtggagagggnggagaattgggggggcggaa

SEQ ID NO: 626739 - DNA, 152 bp, Homo sapiens
ggccgctccgttattgcggtatccccaacgcgcgtattatgcgtacattgcgtcggcggttgcggccccctaatcccgttgcaaaacctgacctccagcctcgcataaggctccgcttgtatacacaaaatggcctattgggccaacagggg

SEQ ID NO: 626740 - DNA, 143 bp, Homo sapiens
  misc_feature (16)..(16): n is a, c, g, or t
gaccggtcacgcctgntatccagcactttgtggagttgtcaggatgatgtgagacatccgggctaacacagtgaaaccccgtctctactaaaaatacaaaaaattagccgggcgtggtgacgggtgcctgtagtcccagctcc

SEQ ID NO: 626741 - DNA, 559 bp, Homo sapiens
ggtccagtctgcacagagtccccagtgtcctgtaggggagtgatgggtgtggaggtgggcctctctctggctgtgggccttcctgggcttctagacaagtcgccccacagtgcctgtgttcatcttgttgcaaggtaatgtatgtacaggcaaggatacacagcgggggaggtgtcccctgttctctgcgaactcgttactaagctctcaacaatccagtgcaaggtagatcgcgtgagtcattagaaggttcctcgaggtggctgtgtgtatatggacccattcaagcgagtggatgagatgttgggtcggaaaagtatatgatatatacacttgttggagcgttagattacagagaaaactacagttggggaagctgctatttttgcaagattgaggattggtattctaggagatgatatagtagtgctctgagaaagtgctcgcgagggtagatggttcaatgtgtgctcaactgaggaagagaagtcgaggaagtgatgagctgatattgaggggagatagcgtagtgcgagtccatgtctgtctgtatatatat

SEQ ID NO: 626742 - DNA, 823 bp, Homo sapiens
gaccaggggctgtcgcccgaatgcaggaagaccgtgatgggagctgcagcacagtcgggggtgtaggttatggggacagtaacggatgtatcctggagccgctttccctgccagaaagtccaggtggcagcatcactttagaaggttctccatctgtgccttgctattttctgtggaagaacatttgcctgtggctgaacaagacaagacgttctgaagcacatgattattgagcatagagagtgtcatagcgtgatgtcgaagttggttgctgatgtccaaaggtacattttatattggaggaagaggttcactgaagcagtccatcacagatttgggtagtgtaataagaattaatgtccggtgctccattggaagaacaggagaagtaatggtgatgttatgtgacgtggtaccaggaagatgagaattcttagagaagagcttcagagacagagactgagagaagattctggaacaacagctagcaagaacgaagatgataccaattttcatggcgtttgtatgttttgcgatgaagagttccttggaaacagatctgttattttgaaccaggatggccagagaacatgcttttcaacattggattgccagagaacattgtaaactgcgatgaattttagtgtacatgacagaaaaggcttgacgatttgcagtgcttgtactgtgagaagagcgttcagggactaaatgtacacttacagatcacatgaggaagaaacagcagtcgtaagattaatcctaagaacagagaatatgacagatttatgtcatcgattatttgggacttggaaaatcgtgg

SEQ ID NO: 626743 - DNA, 1283 bp, Homo sapiens
ccagatccgaggtctgacagcgccggccagatcccacgcctgccagtgagcaagcctgagagccagccggcggctgcactccgactccgagcagtctctgtccttcggacccgagccccgtgccctttccgggacccctgccccgcgggcatgcgctgcaaacctgccggccatggatgaccccgtcccagcggccgcgccacccgacagcggggctgcaggccagctccactccgctgtcgcccacccggatcacccggctgcggacgaacggagtgacctgcacgcagctcagctgatcgcttggcggtctacatcgaccgtgtgcgctcgctgcgaccggcgaccgcagcggctgcgccctcgcatcaccgcagtctcgacgcaggtggtccagccgcgagcgctgtcccgcgcatcgacacgccggcctacgcaggccgagctcgcgggcatgccccgcaaagacccttgactccacgtcgcccaagggcagctgcgcccccgcccgtgccgcagcctgggcgccctagatccaccacgtcgcgtcgagcgacgctatacacgggctcctcgcaaggcgccggccagattacccaacgcacagcgcgcgccttgacccctgactcacgctgcctcccacgcgcccccggcctcgcaggcccacctgcgtcacgcctcctgccccgcacctcccacacgccatgcccgccccctgccaccactgcctctcccagctggcaccacagccgctacgccttgcccacgcgccccaccctcgcctggcatcatcccgcgcgccccacgctggcccccgccctaccacgccacccctcaccgccgaacgcccccccaccccctctcccccatcccacctgcacgacagcccacctgagcaatgcctctccaaccaagcgcctgcacgcacccactcaccggagccgaacccgcagcccttcacccacccaaacattccacaccgacagcacgccccctcgagcacccaccgtcccgtcaacgcagaccccaaatatccctcaccactatccacacacctatccaatcaaccctataactcctactccacacccacatgctcgcaacctacaccacccaaaccaaaacaccaccaccacccacacaaaacacacaaccaaccaccacaacacactacaacacaacacacacacacacacaacacccacacaaccacgcacaaaacacccaccaccaacccaacacacacccacacacaccaccacccaccacacacacactacccc

SEQ ID NO: 626744 - DNA, 431 bp, Homo sapiens
gctgcaggaattcggcacaaggcgatctctgctcactgcaacctctgcctcccaagttcatgcgattctcctgcctcatcttcccgagtagctgggattacggtcaccctccaccacgcccggctaatctgtctatttttagtagagactgggtttcaccatgttggccacagctggtcttcaactgctacccttactgatccgtcctcctcaggcttccaaagtgctgggattacaggcgtgagccactgtgccccacctataatatggttaatgttacgaatttggtagtttaaacatgttgccatgagcaattactgatatactaatggaatatcattttagtcagttagctattaatcctctatgcatgttagaccgactccattttggtatcgttgtggcaatattcattataccatgattctctt

SEQ ID NO: 626745 - DNA, 110 bp, Homo sapiens
tccacgtgacggtgctgtacccagtactgagtgttacccagacgctgacccttacaatctactgcaacagtgcaaggccaggcacaccactaccgtcttgtactgaaaca

SEQ ID NO: 626746 - DNA, 86 bp, Homo sapiens
  misc_feature (51)..(51): n is a, c, g, or t
ctagaagattcagcaaagtacttttgtgctcttggggaacgatgtataccnaacagggaggagggggccacaccgataaactcact

SEQ ID NO: 626747 - DNA, 409 bp, Homo sapiens
agggatactcgcgagtaggtgacacatggagcatatacttcacaagaatgtgaccttctatctgcgtcggatcacttatagtatggttaacccttcactagaataagcctctattctcgctctagactgactcgcagggatacctcttcaggtggatattctacaatgccttcaggtgagacattccattgcacacggagtccggctctacctttaagccttagaggactgtatggtggaatagagaatgatgctattacaatggctttattaatcccataagactgtatataggtttgtgtatgccagtcacgcactggcccatccttacactgacgtgatcctagggagagactcagctgttcgaacggagattactgcatacattctggcttcgctgggttacttt

SEQ ID NO: 626748 - DNA, 132 bp, Homo sapiens
ggttcaattcacccaggcggcagaggcatggggctcgactcactagctcggcggcagccgtccaactccgtgagctcaatcaattcctcccgagcctccagccgtctgggtgtagctggggaccacgaggca

SEQ ID NO: 626749 - DNA, 217 bp, Homo sapiens
tgaagatcaccagcagcaccgccggcttgccgttgaacaggccgaagttgcgcaggtcctcgacgtcctcgtggacgtagtccaggtcggcgatgcgcaccaggctgccgttgttctgcttgaccactaggtcggcgtagtcggcgctctggaacagctggtcgttggcaccgagcacatggttatgctggccgaggatgatcgagcccttgggcag

SEQ ID NO: 626750 - DNA, 609 bp, Homo sapiens
  misc_feature (17)..(17): n is a, c, g, or t
ttcctgcatgtgagttntgacttcttcctgtgctggtcagggctgcaaatggctgataatatcactgaagcctggactatcttcagagcccgactggcacaaaatgacatattaatgtagtatctcatttcctttgcattctggggacaagtgggattggctcgatgcccagggatatcctgtgaactcatggaataggactgggctaagcctggctagcacctgacagatcctgtctatggaactagggacattttttctcactgcttcaattggttggaacataaaactaagatggcatttgatctgtcttgcaaagatttggttcagaaaaatcttacaaatatgctgatagtaactaaaattttctctgtatctgttgcttagatgcaataattatgtgttgaaaattgtatatatatcatatttatatactttagcacctagaaatggaagtatttagtgttatggaaaaacagatggatagatgaataagctctctctctcctctatttttctttccccattttatactttttaaaagttaatttaataggtagattaaagacatctttaaatgactgtaaaaataaagttcatgtttagaca

SEQ ID NO: 626751 - DNA, 377 bp, Homo sapiens
  misc_feature (47)..(47): n is a, c, g, or t
taccaagacacatccactgtgttattaatttagaatacaaaagacanagaaacactggaagctcacattaacaaaaggcctggttccccccaccttcaaccagactggaaatcaaagccagcattcgggccaggtgcaggagctcacacctgtaatcccagccctttgggaggccaagccggggggaattgctggagcccaggagttcaggaccagcctgggcaacatggtgagaccctgtctccacaaaaaattaaaaatttagcagggcatttggtgcatggctgtggtccaaactaaattggtggctgaggcaggaggatcacttgagcccgggaggtcaaggctgcagtgagctgtattcatgcctaggtgaa

SEQ ID NO: 626752 - DNA, 576 bp, Homo sapiens
tattatactttaacttacgggcgtacatgtgtagaacgtgcagtttggttacataggtatatacgcgccagtggtggtttgctgcacccatcaactcgtcacctacattaggtatttctcctaagtgctatccctcccctagtcccccattccctacaggccccaggtgtgtgatgttcccctcccgtggtgtccatggtgttctcgtgtgttcaactctcacttatgagtgaaaacatgcagggttgggtataccgggtactggcgttagtttgctgacaaatgatggttcccagcttcatccagtttccccgcaaaggacatgaactcatccttttaatatggctgcataggtattccaggggtgtatatgtgccacattttctttatccagtctatcattgatggacattggggtgggtacagtttcctcgtcacaagggacaattagggaagcaatgaggataagtaggaactttataagttaggaaacaaaaataattagaatcgagtcaatacaagagctgtcgttagaaagtcctattcacatggataagccatgggccaagcaagaaa

SEQ ID NO: 626753 - DNA, 102 bp, Homo sapiens
ggaccttttgtactgagctcagcatagactaatactaccttatgttaaaatctgaatttcttttagcatttgcttaaaagcaatatgctatttgcttattcc

SEQ ID NO: 626754 - DNA, 269 bp, Homo sapiens
gtcctcttagttcatgccattctcctgccattaaaggagctgaacagctcctttaatggcaggtaggctgcttgagcccaggagttcgagatagcctggctaacatggagaaaccccgtttctactaaaaatacaaaaaaagagccaggcttggtggtgcacgcctgtaatctcagctatttgggaagctgaggcaggagaattgcttgaacctgggaggtggaggttgcatgtgagccatgttcatgccactgccattaacggagctg

SEQ ID NO: 626755 - DNA, 756 bp, Homo sapiens
cccatcgcgctcggggttgcttccaaaagctggagcccagcgcgtgcctaggggttgtctagagagccacacctgcaggggaacaggtacctccgagggtgagagtcgtggtctctgggagttgttttcgtcacctcgtgtgcttagaacgggtcaaggcagaaaccgactaggactgtgcgggtcacactctactggtcccacagtttgggaactctgtaaaaagtctccgattcagaaccatggttgttctcccatgtccctatgctatcttatcttcctaaatgactaatgaggaagcgggtgtacttttatctgcactttgattcgccatctgggttctgtagggtgctctgaaggtgtgatctgacgttctggcatgatgtggaggaagagcaagcgccttcccaggccactagctgctcacctctcggcgagatattccaggcaatgcatccgtgtgtcttcccatcttcaggagaacggtaaatgcaccctaagtgttcacttctggaccttttgcaagttgcacttgggactgtgtgacagaagggagttggagggaggatgggaatatgtttaacagttggtattcctgtgcagaaacataataccagtgtgcgcagaactgtgtctcaatctgtgactaccagagccctcctcagtccttccctcagagggacacatccgctgtttctcccgcaagcacgatgtcgtggatgacgggatagactccttggcacggaacgcaaggtg

SEQ ID NO: 626756 - DNA, 1214 bp, Homo sapiens
actcgttgactattctctacaaaccattaagagacattgtaaacactatagcctattattcgtgcgtcatgaactggaagtcctagtgcacagactctaagcacgtccattattcggagaccagatgctgggcgcagtccagggcaaagccttcgtatcgtaactgaacatcatcgtacagacgttatcggtcacagctcgcatgcatacgtaatgaatctgtcttcattatgttaatgacactcatacataagagtacggaagcgactttaggccaacgatgacataagttgtccccttagataatgctggtgcccccgaaatagtgagctgtatatccgccgcaatataacacatcgagtacagtcttactgactccttgactcacgcacgctctcgtccttatctccttgtcgtcggaagtctgcttattagctggacgtgccggcaacatgtgaatcagtgttgaacaggtcgtaaccctgcaccttagcagagggaacataacgtccccaataccgtggaagcacatcgcaggtagtaacctaacacattctatctccgttatcatcctacgcagagtgatctactatctaattcgttacgagggccatcgaattacatcacctaacaagttatcaagtatagaaactccccgtgtcataacccaagtaacaaaatcgcccctcttcgtctgatccgtgctaatcacagcaggtccgacttctgctaatctctcccagtactagctgtggcatcactatactactaacagaacgaatctcgaagcacattcttcgaccccgccggacgtgaggaaaacccattctataaccaaaatctattctgaatttacagggacaccctgaaggtatatatagcataaatctatcaaggctaggaataagctcgcactatggaagctaaaatacgggaaacaagagacactagagtacaaagtattgatagaaagagatccacagtgacccaaaggattatcggtatacacaacatatatttcacataaataacttaacaacacaaaattatacccataataacatacgatacacaaagaacaaaaaatagatatccacacatcaaacaaaaaataaaaaacataacaaaaaaatataaaaagaagaagaaatataaactaacacatataaaataacatacaacaaacataaatccagataaactcccttataagt

SEQ ID NO: 626757 - DNA, 503 bp, Homo sapiens
ccgcctgttgttctgtaccagtgaaggaagtgcttcatggcgaaacatggcagtgaactgctcctgatgatgcgcattgaagagctcctggatggctgtgctcttgccaatgaatgtgtgactgccatcttgaggccacgaggtgagatgtcacagagggctgtcttgacatttgttggggatccattccacaaagtagctgctagtactatgtactgcacgtaaaagcatctgcttcatcgacctccttcatggacatcctgaccatggaagacagcagccacggtgaggtatcggccgtggggagggtacaggcaagacatcatgtacttggcatcgaagacctgagggctaccaagcttgaacccactcactgggcggggtgcaccaggctcttggactgtgcactctccttatcagcaagatccgagaagaataccccgtgattcgcatcatgattaccttcagtgtggtgccttcacccaagatgtgtcttgacaccg

SEQ ID NO: 626758 - DNA, 950 bp, Homo sapiens
aatttcactgccaaccaacatctattgttctggtccctcctatagcagtcttgtggacacaccattatgctccatcgcgatgccgttgtttccaccacggtgttcaaccaccacgctgggtttgaagcacccacattcttctttgcaacaaaaagccctttgtttccccaacaggctgtctaaatctgtgtccccccgcctttataaagccctgtgaacacctgttggccccaaagattccgtcgcccgcccaagaaatttgccgacccctgtgcaaaacagtttttccccccccttgtgtggtcctatacagcataaactgcaacaaaactggttgctgaagcgatttaggggcaacgttttcgcgccatttaaccacaacaggggtttgagtaccctgctgggtcgcagaagcaccggaggagcccacacacctgttcgtggggaagctacacggcgaacacttgtgtgggggagaagccaccaactgccagccgcctctggggtaatgcctgtatgaagaacacccctcgcgcggtattctttatagtaggacggtggtacccctcctatagagggtgggacgccgccccagttctgggttgttcttactcatttccccctgtccatgaggatgtgtacaacccgcggtgtgtcctacatctcaagcgcgcactctccacattcgtgcacaagaactaatgaggggcgcgccccacggggggacactaaactgtccgggaaccgcagcagttaggaaatacgctcacctcaggggccaggtgaagtcccacaagcacttatctgcggtacaccacggacagataatgtttaaaattgcgagatgtgaagtaaaatcggatgcgaaatgagtacgcctccaggagaagcttgtcttttttttaaacttgcgaaaaaacaaaaatgattatttgcgccccaacatgaca

SEQ ID NO: 626759 - DNA, 912 bp, Homo sapiens
  misc_feature (912)..(912): n is a, c, g, or t
ggcgcttcttgctgccaacatgtgaagaaagacgtgtttgcttccccttccaccatgattgtaaaatcaacaaggaaggcgatgagcacagcagtgtgaaggtatacagaccaacggagcagaacagaggcctcagaaataacagcacacatctacaaccatctgatctttgacaaacctgacaaaaacaagaaatggggaaatgattccctatttaataaatggtgctgggaaaactggctagccataggtagaaagctgaaactggatcccttccttacaccttatataaaaattaattcaagatggattaaagacttaaatgtcagacctaaaaccataaaagccctagaagaaaacctaggcaataccattcaggacataggcatgggcaaggacttcatgattaaaacaccaaaagcaatggcaacaaaagccaaaatagacaaatgagatctaattaaactaaagagcttttgcacagcaaaagaaactaccatcagagtgaacaggcaacctacagaatgggagaaattttgcaatctacccatctgacaaagggctatatcagaatctacaaataactcaaaaaatttacaagaaaagaaacaaacgacccatgaaaaaggtgggcaacgacatgaacgacactctcaaagaagactctatgcggcacagacctgaaaattgtcttgtccggtctccgagatgcgatcaaccatggattccttcttgcgtagatggcacttcactcggacaccgtgtgggggtgtggacaagcttcacggggggagcaattccccacgggcaatggcgccgcttaaaatattgcccccctggttcacgaagctaaactgtctggtcaacagtcaccttttacccacagccttggctccgcgcacgagtacacgn

SEQ ID NO: 626760 - DNA, 339 bp, Homo sapiens
tatcagcggtcttagtacaatcgatccggcgttgcatgagctgtggtgtaggtgcagacgtggctcggatcccgcattgctgtggctctggcgtaggtctggaggacaaagtagataacgaaaacaacaaaacaacaagtaggacgtacccgtacgtggcgcaggtgattaacagaatctgaccagtaaaccatgaggttgcaggttcggtccctgcccttgctcagtgggttaacaatcgatccggcgttgccatgagctgtggtgtaggttgcagacgtggctcggatcccgcattgctgtggctctggcgtaggtcggaggagaccgctcttaccg

SEQ ID NO: 626761 - DNA, 291 bp, Homo sapiens
gaattggggggcccccccccaagattgggccccctttctcccccctcctttggtttcctcttggccttgggggtacttttaaattttgggggctcccccctttcccatgggtggggtttttggccggggttcccctccgaacccttctgggaattgtgcctggttttccctcccctgggttttggggttcccccccccccctttgggttttggggggtcccctttttttttcccccccccttcaagggctccttttttttttcccccaggagccccggatttttttgggga

SEQ ID NO: 626762 - DNA, 1046 bp, Homo sapiens
tatcctcatctgggcacaaaagcctggaggttccagatttcttaaggcacacacggtagcagcaaagggcacacacacatattctcgcatctctgggcgcattcaccacaccatggctcaaagcaaaacatgacagcacacacagcacacttccatactggctagctccaggatcaatgcacggcaggctcacttgggtgacccacattcccaactcgcgcaagcaccttccatcaactgtgtaagcctgtccctgtgtgtgctacgcaagcctggcttggctgacttacacgacggctgacacctgacatgacactctagctaccaactctcacttactattctcacttacatactgtcacctttatcctactctttatcatttcccatttcactatcacctagatcacattagcggagcacgttgaccagcttgagcacgcgtacagccagataacgtgctgtgctcgcttgtacgctggcacatatcaagatgtgtaccgacgatcccccgacttaacgtctacaccacggttgcacctggagtgacccgacggaccactggctcacgacgccaaccataacgtcacccctacccttggaccacactaacgtagggaactatactaaacccctacacttacctacggtggtcaggtacatgggtatcatacaccaagtccaacacaggcccacggatttaaacaacattatacactggtctatgggcatataccattcaactttcaatccttacactcactcagcctatgggccctgtttacgactcctttactattaaacttacattatcctcctaattgggatacttggacactcccccccacgggaactatgataacccctacaggggacactccagggtaacaccagagagaacaagctcgaagagaccgccaccaaggcttacagaacgaaaaagaagcaacaaataaatcccaaaacccacaccggctatcactgagggcactcctggcacaagcaaccggcaatacagtgcagccgacaaccatggcaactgagcc

SEQ ID NO: 626763 - DNA, 153 bp, Homo sapiens
gggcacactcatcacagcgctaagctcgcactccattttttaccttagtaggcctagaaataaacaaaccaacctttattccaattctaaccaaaaaaataaaccctcgttccaccaaaaggtgccatccaagtattttctctacggaagcaa

SEQ ID NO: 626764 - DNA, 223 bp, Homo sapiens
  misc_feature (115)..(116): n is a, c, g, or t
  misc_feature (129)..(130): n is a, c, g, or t
gagcggtctagtcagagtaagctcaagagaaaatgggttctaaggaaaacagttccctttacttcgaaccataggtttgtcatattttgaagggatattttcaagctcatttagnnttagtgaagctcnntcaacactgcacaggagatttcgtgggacacccccgtgtagaatcaggcagggagtgacctcttgtgaaatttcacaccataatcaggttgag

SEQ ID NO: 626765 - DNA, 614 bp, Homo sapiens
  misc_feature (148)..(148): n is a, c, g, or t
  misc_feature (174)..(175): n is a, c, g, or t
  misc_feature (346)..(346): n is a, c, g, or t
  misc_feature (350)..(350): n is a, c, g, or t
agcgcggaatgaatggcgtccgcaaggaaggtacggctctactgccacctcttccagctccaccgccggcgcagcagggaaaggcaaaggcaaaggcggctcgggagattcacgccgtgaagcaagtgcagatagatggccttgtggntattaaagataatcaaacattatcanngcaagaaggacaaggaactgaagtgtcaaggagtgctcttgggtctggcttgtagaaagatcggccttgaaacttaccaactgcttctcctttccctcagcacacagaggatgatgctgactttgatgaagtccaatatcagatggaaatgatgcggagccttcgcatgtnaacnttgatcatcttcacgtggcgctggtatcagtccacagtactatggcgtcagttcgtttacccgggcactcctgggactctcagtttagttaccagcgatgccagtttggaatgagatctgtcagttctcatccatgatcccagtaaagaactgcccaaggatctctctcactaaaggcagtacagactgactcctaaatctgagtggaagtttgtacagaaaaggatttttcccctgaagccttgaaacaagcacatatcacct

SEQ ID NO: 626766 - DNA, 109 bp, Homo sapiens
gacactcacgcttcttcagcccaaagaactcgaggatgcgctgattgtcggggtggactgctgcgatgaagatgagcaccatcttgcctttgaagctatcggctgctgt

SEQ ID NO: 626767 - DNA, 1547 bp, Homo sapiens
  misc_feature (1249)..(1249): n is a, c, g, or t
atatcgcgtctgcggtctgtgctatttgttgtactcgtgttgtcaaaccgttgttcgcctcccggttggtgttttttgtcgtccttttggcggcatctgttgctctgggtgctctttttgtctttgttcccttgtttgccgcagtaatgtctctccggtcgcctctgtggtttaccctcgattttttcttgcgcgtgatatgacctgttttctccccaggggtttcccggctcactgacagcggtgtgttactagtcgtcatcgtgttacaccctctgtggtttcacacatcctctggggtaatacatccttggggggttgttggggtttttcttccacccaagtggtattgctctttcttattgttggggctggtgtctgccaccccgccccagcgcccacacgatcttctgtgggcgccccttctttccccccttttggggattatcgccgccctgcgcccgtattacgcctcgcccgccccctcactgctgtattgctccttcctctttgggggctttccaaagagctacttggccgcctcgccccctctctttggggccacatggggtaccgccccacgggggggcacgggaacacaatatccctcgggtttcacttggggatacaccctgttcgaccaatagctctgttcaaccccaacttttggccccccccccgcgggtgtgcgtatagcccccccactctcccccgcggatatgttttctcacgaatatgcccgcgctgtgggcacacacacacctggggccccctctcataggggctctataggagacactttcccccccccgcgctgggagaccgcccccagcggctctcttggggggccacacaccacacaccgcgctcctcgcgaccacaccaccctcggagagatgtcctctctatctctctcggagacctctctctctcccacccttgggcacatgtccccccccccgagaggggcctcccactcttcgcgagttctctcccctcggggttcacacccacgcgttctctatttgtgcctctccgccctggtatataggcgtgggagacctctcctctccctctgatgatgtcccctcccctgtgaatacccctgggcccttccaccgagacccccacccctcattgggtacacccgccgcggggcctctcttccctctccacacccacgagacccacctctccccggccaccccgtgttcccccctctcgagaggcccacatcttcgagaggccnctctttctcctccacgtataaattcaccacactttcctcttcctccctcgttacactttttcccacacaattcttttttaatttcctctggagcccacttacagaaaatttctcgtaagctccctctggggccaaaggtatactaaatccctcttcacccacccccccactcccacttcccccttttaaatgtgaactttttcccccgcgagggtattttttttttaatgttggtcctgaggtatattttgccaaatgcccacgaggagaaaataaactaaactcccttggtttaaaa

SEQ ID NO: 626768 - DNA, 311 bp, Homo sapiens
  misc_feature (30)..(30): n is a, c, g, or t
  misc_feature (32)..(33): n is a, c, g, or t
  misc_feature (35)..(35): n is a, c, g, or t
  misc_feature (47)..(47): n is a, c, g, or t
  misc_feature (60)..(60): n is a, c, g, or t
  misc_feature (65)..(65): n is a, c, g, or t
cgtgtatcaagtgatcctccacatgtggcntnntncacatctaatcnacaggcaggtcantcgcngctgactctattcttctctgggctcctgggacgtataaatatgactctatgtaagaaaaccagaggctgggcgcagtttgctcatgcctgtaatcccagcactttgggaggccgaggcgggcggatcacgagttcaggagttccagaccagcctggccaacatggtgaaaccctgactctactaaaaccacaaaaattagccgggcgcggtggcgggcgcctatactcctagctactcgggaggct

SEQ ID NO: 626769 - DNA, 914 bp, Homo sapiens
  misc_feature (696)..(696): n is a, c, g, or t
ggctgaaaagcactagtttgatataaaattaaaatgaccaaaatcctccaactttgaagactaaagaaggtaaacccttcccattattgcattacatgttgttgtaatctctcgtagttgcgatagcactgacttagtacatctatcagtgctatagtctactgatagaactgtttcatgtgggggagtcgcgcaacttagttaaactatttgcctgaattgtaagaagtgtctgaggaaatcagatcttatgtactctcaggctgctgtggaacaacttcaccaggtttagggatttcctttcctgtcctttattaaacttgttcacgttaaactgtctccaggtgtaacttgcagatatggtaaatatgtaatgttgactattatgtacatctgctaatgtttctataaagcaattagtttacataaaatcacatgtggtgaggacgtatgaaattttgtgtaacctccctagggagtatacgttttttgaggagtgatataacacatctcttgtgtgtacagttctcgtacgttctcgactaaatcgttaaataaatgcttgaagattagttgcagtcttttaacatgagtgaattgccaggtccttagtgctgtcagccgttagagcacggaggtgtatggctgcgtcctctttgtttatgcggggacctgatgggcatttagatacagggncccaattattaggtacctattgcagccctttttgcgcaacgggccgtgtccggtttggcgtgagttgaacggggacctgtggtttcccccggttaccccgttgggtggttgtttcccccacgaaacaaaacggtgctctccttggaagaggcggccccactgacgcctttttgatcacgcgcccctatatccgggctcataactccctcacttactcc

SEQ ID NO: 626770 - DNA, 124 bp, Homo sapiens
  misc_feature (54)..(54): n is a, c, g, or t
cggcatgcttctcacagtagatttgatcctccacaaagaaatgggccttctgtntcaggttggtgccacagtcagtgcacacgttacactcaaggtggcggtgacggtcccgccgtcccaaagc

SEQ ID NO: 626771 - DNA, 917 bp, Homo sapiens
atgcacatgcagcgcaaagtaggtctacaagacgctattcccctatcatagaagagcttatcacctttcatgatcaccgccctcataatcatttccttatctgctccctagtcctgtatgccctttttcctaacattcacaagcaaaagtaactaatactaacatctcagacgctcaggaaattagaaaccgtcctgaactatcctgcccgccatcatcctagtcctcattgccctaccatccctacgcatcctttacataacagacgaggccaaggatccttcctttaccatcaaatcaattgggccaccaatggtaaactgaacctacgagtacaccgactagggggagacattaatctacaattcatagattactttccccccaattattccttaagaacccaggcgaccgcgactccctgggagcgttgacaattcgaagttagttatccccagatgaaggccccccatttcgtataaataattaacatcacaagaggttctgggaacatcaatgagctgtccccaaataggttaaaaaacagatgcacacttcccgggatgttctaaaccaaaccaattttcacaccgtacacgaccgggggtactacaccggtcaatggctctgcaattcgggggagcaaacaaagttccatgccatcgcctagaaatatccctaaaactttggaatagggccgtattaccaatagcacactcaaaccctctaaaaaaacacacaaaaaatgttggccgcggccatcaagcttaaaccccggggggcggccaggagaacaggccgtgcccagaacggcgaagggggcccaacaccggcggccgaaccgggggcccgcacagcgaaccccgcggcacagccagcccgccaacgagcacagaaaagagacgcgacgccacgac

SEQ ID NO: 626772 - DNA, 138 bp, Homo sapiens
gacgtattccaaggaactgcacagtagccctagacggaaaactgctcaccgtcatctaaaaaatggacgcgtcctgcaatggaatattactcagtagtaaaaaggacaccaactatggactatgatgataaatgggac

SEQ ID NO: 626773 - DNA, 313 bp, Homo sapiens
tgattatctgacggatgacattggagcaccaactacagcaaaattcagggtcaaggtagctggcaagtcagttctctggattgggcaattaccttccactattttcatctgtatggaagctgagatcttcagggcctattggttcaccatcaggaaaacgggaaggtgtatcttcatccgggggctgtgtcatgaccatggaggagtcgtgaaacccgcccacacgggtatgctcttcctgctcctcattctcagtgtcacattcaaggtcactgtcgctactcattccttcttcaggggcagcgggtaccga

SEQ ID NO: 626774 - DNA, 318 bp, Homo sapiens
  misc_feature (125)..(125): n is a, c, g, or t
  misc_feature (172)..(172): n is a, c, g, or t
  misc_feature (204)..(204): n is a, c, g, or t
  misc_feature (310)..(310): n is a, c, g, or t
ggatatagcttttacttttaaactgtgtacataactgaaaatgtgctatactgcatactttttaaatgtaaagatattcttatctttatatgaagaaactcacctaggaaatggcttcgtgattnaatctgtaaactgtgtactcaacgacatgtctgttctacatagatgnctagtcccctcatcggcaactcacattacgtngctccacaacagacttcgctcgaacattttcatatcgccttacccgatctacttttacacattttttcatcatcgcctgtccctgtccaaggtctacaacggctgnaccaataa

SEQ ID NO: 626775 - DNA, 134 bp, Homo sapiens
cagaatggatgaagataaatttgactgtgggctttttcaagtggagaatatgaatatccagaccaagaaaccaataactccaccctgtttgattccgtctgttttctaaataaagcccctatgcgctggaaata

SEQ ID NO: 626776 - DNA, 137 bp, Homo sapiens
ggcggacggacagcatagaatgacatttcagacccatgtagtattaccacatagatatcctgagcacaaagacaccgttctacatattacattaagatgatcatgcctaaaaatataaacagtcaacttctttatag

SEQ ID NO: 626777 - DNA, 813 bp, Homo sapiens
gggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaacaaaggccactgagtatgtccactccctccaggccgaggagcaccagctttcgctggcaaacaggaaaaattgcaggcaagacagcagcagttgctaacagacaaattgaacacgctcggacttgctagacgcttctcaaaactggacagtcactgccactatgcacatctcgattctccctccccctcaaacaaacatcgtgtcgacacttaacgaatgtcggctttactttcaaatcggtcccctgtcgagcttcggctctgggctgcggcagtaggaccaccagtgtgcgggttctgcctgggaccttggagcagcctgcatcccaggatgctgggtggccctgcaagcctcctccacctcaccatccatgacacgcgctaaaccgctcggtgacggtatgggagcctctggggctgttgaacgctcaccttgtgtgtcccaagtttccaaacaaccaggaaagtcattcccttctttaacaaatggtgcttacagttccacgcagatgccacataaggggctttgccatttgatacccctggggaacattcctggtaaataccattggacacaatccgcctttccgtatacatcctggcgtactgagaacgtcggcttcagccggccagtatcagactgcaagttcatacctaactactgttaacca

SEQ ID NO: 626778 - DNA, 250 bp, Homo sapiens
  misc_feature (54)..(54): n is a, c, g, or t
  misc_feature (173)..(173): n is a, c, g, or t
gatctcgtacgagcgccatcaagaatatgggctgagagattcagggagcagaanagctgagcacagagtagagacggggcaggcgagacaggaagacagcgagatgcagcctctgagcgtctcgtggctccggtctcttcagattgacttggcacagcagtcgatgagtccgncagtccgcacaccaggtcatgctccacgatgtcatgccacgagtcatcttcttcatggcttgtattgagcgctcagt

SEQ ID NO: 626779 - DNA, 300 bp, Homo sapiens
  misc_feature (120)..(121): n is a, c, g, or t
  misc_feature (136)..(137): n is a, c, g, or t
aatcattcaaacaactacataagtaaaatgggtatcatcacatacagtgcatagagactaactgaagtagatcacttataatttcccattcaagtgcttcataaatcctcctcagtgaanntagcatctggcagcnnaattatcatcttttgccttattaaaacatcaattaatttaactgttttcttgaaccctatcattaattctccttttgttttctagcttctgtttctgatttaacacttcaattttttgtgttcttcattgctatgtcttgttattttgctattcgtaactcag

SEQ ID NO: 626780 - DNA, 214 bp, Homo sapiens
cctcttgcacactgctcggtccgccctgaaggtaccgctcgaactgggcctatcatggcctgcaggttgagctccaaccgcagcttgagatctatcggtggcctgcagctcgtcctccagctcttccagctagcgtctatcatctcctccacctgctgctctagggcccgcttggactatctccagctcgtggacactcttgccccacatcatc

SEQ ID NO: 626781 - DNA, 926 bp, Homo sapiens
agcggtggagtttgcagtgagccaagatcgcgccactgcactccagcatgggcgacagagtgaggctccattaaaaaaaaaaaaaaaaaagaaagagcaaatgaatgctgggcataatatctagaatgatgggcatgactctgtgcagcaaaccacttatggcacatgttttacctatgttaacaaacctgcacatcctccacatgttaccccttaaaccttaagaagttgtggaaactcaacaacagaaaacagggtatttaacctcaaaattaaaaaccaggtggtgttactaattttctctaattcagccaaagtgttcattttaattttctcacctattaatttttagaagtcgataatcttgtggcctcgtgttccgcacagctcgtggcagttgccagggtggcattgaattagccttgtgaatttccgtgtttcaagttgattccttcccggcctcagtctccagaagtgtggctggggcctacgggcagtgtgctgccacaccgtggatacttcttcacacacttttttactacgaagtgggggatctggcctatgtttgcccaggcttgctctcggactccgtggccttaggtgatcctcctggcctctgtcttctgagtcgctggattgcgggtatgagccaccatgctcagcagaaaattaaactttttttttaacaagtcattagtcccggggaattctatttcacttccaaatccacctcatttcgcagtgccctgttcttagtagtccgtggttcacggaacgacgtcgctgtttcaccttgattcagggctagccaacacaatgaaccgttgaagttcccaggagctacttcacttcatctccgggtcccctccgagagtatctactaaccctcggggcccctcacaggagtaatggccattctcggtccc

SEQ ID NO: 626782 - DNA, 1035 bp, Homo sapiens
tgcgtcccctgtcagtgtgctagcgccataattctcaaggatggtccacctcgatgacccgcttgacgcgaccatacctctaggttcctcctcgctgcgggcccgcttattcgctccgacaagatgaaagagacaatcatgaaccatggaaacaactcggcgcaaacttgtcaggcgacaagtgcgcattggtggcgaagaggaactgctcgcagcaacgcaagaaggtggttcatagatacagccacagcagatgacaaaaaacttcagttctccttaagagaagttaggggtaaacaatatctcgggtattgaagaggtgaatatgtttacaaagccaaggaacagtgatccgagctttaacgaaccctaacagttcaggcgtctctggcagcgaacgcttgcaccattacaggccatgctgagacaaagcagctgagagaaatgctacccagcatcttagaccagcttggtgcggatagtctgactagtttaaggagactggccgaagctctgagacaaacaatctgtggatggaaaaggcaccatttgctactggaagaggatgatgatgatgaagttccagatctagtggagaatttgaatgaggttccaagaatgaggcaaactggaatggagtcaacttctgaaggattaaacctggagaaagtactggcagctgctatgtgctcattctgacgtgtttcacgaaaatttcaggtcaatggatccgatacaatcagatctctagaatgaaaggccaagcccttgaacactggagctctttgcgagaccggggctaatacccaagtcacgacactgacgcaacatagccgaggaagccggggcactaggtggcacaaggcaagagaaggggctggctagcacaagaacggacgacgacagaaggaaacaccgtgcccaggcgacgcccacgaaaccacacgggcgcaccgaacgcacagaatgagagccagcacagaacgagccaacggggccccacgacagggcacagtacaaaaggtgacactacac

SEQ ID NO: 626783 - DNA, 265 bp, Homo sapiens
taactcttttttctcctactttttccaggatttggtaaccaaaactttactttttacttttacaaaattaaaaattttagcttccatacataagggaaaacacgtagttatggggggtttatgtttctatgccaggcttatttcacctaacatagggccctccacttgcatttttgttgccacaaataacaggattttgttttttattatgactaaacaattttccattatatatgtatgtcacatttttttatccattcatctg

SEQ ID NO: 626784 - DNA, 549 bp, Homo sapiens
  misc_feature (147)..(147): n is a, c, g, or t
gctcgccaccggtgctctggtctcgtcggtcccctcctccgcccgtggtcctgatctctctccctcctttcctcagaggatgtccggcttccagatcaacctcaaccggctcaaggagccactcggtttcatcaaggtcctcgagtngatggcttcttatcttgtgctttgtgccacctgtggaggttttaagggccaaacagaaattcatgtgattgtgtcctcctgcagttactgagaataaaactgttacagctactttgtgttatccattcaggtgtgaatgaggcatcatttcagccacctccaggtgtaaccatatgtgcatgtaacatgtgcacaagattacggtcctcataaggcgaattactctttctttctgcacaatcctatggtacctttgtgcagtcttgtgtgtccctgtactgcatgtgttggcccttcttgctttatgtgtggctacacgagtctgtatctggatagtcgtaaacttcctatgatagacttgtgttggttacacttggttggccacttttgggtgggtaggtg

SEQ ID NO: 626785 - DNA, 208 bp, Homo sapiens
cccacacgcgtccgggctcctgctgtcctccactgaatgtgaactagcacacaaggtgtaatataatgttttgtaacctctgccgagatggctgtaacacataagtgtattgaaaagttatatttaagccccctgttgtacatttttgttcctagattggatgtgtgtgttttaagaagttgtcataaataaaacctggatggcccca

SEQ ID NO: 626786 - DNA, 341 bp, Homo sapiens
  misc_feature (87)..(87): n is a, c, g, or t
cctcctagccctcttaccagagtgagtgagactctgtctcagaaaaaaacaaaacaaacaaaaacagtggaatattgggctcagctnttaacacattatatttagagattgcaacacttcaatatttactggaatactcctataaaacggtctcttttgccttgttttattttggtaactaagtgaatgctgggttagccataaaggtagcttgctgcatttctatttcttgtgttctaaatcactgaataatttttcaaaaaagtagttctaaagcatttccagttaaaaaggaaggcgtaacatttattaggggaagtcaaggtaagagggctaggagg

SEQ ID NO: 626787 - DNA, 219 bp, Homo sapiens
ggtgtggctgtcttccgttctaatacggccgaggtgtctctccattcgtcgcgggtctctgtttcctccatttccacggctgaggagattttaccaatggtggatagtttccccgtttcttttacagggaggtgtttgggaacctgctgtggggccatctgagttggctatagaagcttggtccagtccgtcaacggggtggtccatgacgacagttgg

SEQ ID NO: 626788 - DNA, 1172 bp, Homo sapiens
acggcggggagcagttttgtctggttgcaggatagcagcgccctctactagtgcctcctgctgtctccttctgctctcgaatatgtgtgtgaacacccctcctagtttttgttggggccctcatcccttagatacagtgtttggggggtattactttgttggcgccaatattgtctcccttcgcaatggggccaccatccgccttttgtccgggggtattcccctcgtgggggtatttctcttgccaacaggggaatgcttctggggtctatggagatccccgtgtgctttgtgctactccctggcctgttctcccttgagggtttcggggctctgggagatgatggttcgggtaggtaagaaatggcacgttcctagggaaaggagtacgagcgacttcgcctgattctccgagaagcctccgagaagtgctttaacgctgtgctttgcatgcgccaggcggtgggctattcgggggcctgtccagccctctcccgccatccttccgccaatgtgacgtccactgccttgtcacctagcgacctgcctgtcatgccctaccccctgaggaagcatggggtacccttacaccctggtgccctggcacctagacaggccgtggtcaggccctaggccactcggccgggttctgccacagcttcccacgtgcttgctgaacatgcgtgtgcctgtgtgctggatgtctgttgctgtgtcgtgaaactgtgaccatcactcagtccaacaagtgagtggccctcgaggccacagttatgcaaactttcagtgtgtgtcatacgacgtcactgcttttttacactcgataactcatgtatatcttagtaaaatgcccaggagtctctggaagctatcgcggacttgacagaaggattattattcttttggccattagaaatcatgacaagaaacattaaggaggcaaccgatgcccaagcgacagcctagcatcaggacccaggatgtgcagatatttcactttagcggatatgtttataacagatgaatatataaatgattttatttctattgggcatttatgcttcttttttccccccctttctcaccgtcccatctcccggacgcccacgcctgccataaagctacttcttcatttacgcaggtgagtataaacagaaaaacccccccccaca

SEQ ID NO: 626789 - DNA, 784 bp, Homo sapiens
  misc_feature (62)..(62): n is a, c, g, or t
  misc_feature (186)..(186): n is a, c, g, or t
  misc_feature (201)..(203): n is a, c, g, or t
  misc_feature (222)..(222): n is a, c, g, or t
  misc_feature (227)..(227): n is a, c, g, or t
  misc_feature (237)..(237): n is a, c, g, or t
  misc_feature (239)..(239): n is a, c, g, or t
  misc_feature (267)..(268): n is a, c, g, or t
  misc_feature (270)..(270): n is a, c, g, or t
  misc_feature (336)..(336): n is a, c, g, or t
  misc_feature (377)..(377): n is a, c, g, or t
  misc_feature (387)..(387): n is a, c, g, or t
  misc_feature (397)..(397): n is a, c, g, or t
  misc_feature (413)..(413): n is a, c, g, or t
  misc_feature (485)..(485): n is a, c, g, or t
  misc_feature (538)..(538): n is a, c, g, or t
  misc_feature (557)..(557): n is a, c, g, or t
  misc_feature (687)..(687): n is a, c, g, or t
  misc_feature (691)..(691): n is a, c, g, or t
  misc_feature (767)..(767): n is a, c, g, or t
tgtctgactacaaaggaaaatatgttgttttcttcttttaccctcttgacttcacctttgtntgccccacggaaatcattgctttcagtgatagggcagaagaatttaaaaaactcaactgccaagttatttgttcttactgtggattctcacttctgtcatctagcatgggtcaatacacctaanaaacaaggaggactnnnacccatgaacattcctttngtatnaaacccgaancncaccattactcatgattatggggtcttnnangctgataaaggcatctctgttcagggtgtcctttttatcattaattataagggtattcttcggcanatcactgtaaataacctccctgttgtgccgctctatggatnaaactttganactagttcangccttccagttcactnacaaacatggggaagtgtgcccatctggctggaaaccttggcagtaataccatcaagcctgatgtccaaaanagcaaagaatatttctccaagcagaagtgagcgctgggctgttttagtgccangctgcattgggcatccatnaaaacaaaacctcttctgtattttttttttccattagtaaaacacaagacttcagattcagccgaattgtggtgtcttacaaggcaggcctttcctacagggggtggagagaccagcctttcttcctttngtangaatggcctgagttggcgttgtgggcaggctactggtttgtatgatgtattagtagagcaaccattaatcttttgnagtgtgtattaaacttg

SEQ ID NO: 626790 - DNA, 159 bp, Homo sapiens
agtcccttaatggggggccttgctctgggcatgttgggctcttcctccatccagaggtggcccaaggcccttataacccttagtgctggctaatgtcaatgctccttccccagcctgtgtattccaaatgaaaacagttaaaccaaaaaaaggaaaaaa

SEQ ID NO: 626791 - DNA, 903 bp, Homo sapiens
ggagaggaggcgtcgggagcagcaccatggctcaaccagaagaaccttgtaaggctatgtggtgatttgccaatctcccaaatcaagtatacagaaaatcggtgaagagaggttgtgaattcacgcttatggtagtgggtgaatctggatagggaaagtcgaaattaatcaagtcattattcctcacagatttggtattctccagagtatccaggtccttctcatagaattaaaaagactgtagcaggtggaacaatccaaaagttgttaatctaacaagaaggtggtgttcagttgctgctcacaagtagttgataccccaggattttggagatgcagtcggataatagtaattgctggctagcgctgttatcgactacacttgatagtagattgtgaggactacctaaatgctgaatcgcgattgaacagacgtcagatgcctgataacagggtgcggtgtcgtttatacttcatagctccttcaggactatggacttaaagccattggcataccttgagtttactgaagcgtctgcatgaaacaagtgaatatcatcccacttattgtcaaagcagacacactcacacagagagaatcggcaccagtttaagaacaccgatattgaaagaaatcccggaaacattaacattataggcgtttacgaacttttccgagacagaatgtgaggacgcccataactcggttgacaaagtgaggcgggtacccccttggggggggggggggagccacacttggagtgctggggcacggcgaaaaagaggaccttgggggtgtaactgaaagggagccccgcaccctacaatagttgaccccctcgcggaaatcacatccacgacagaaggcatggacacatttcagaaggcacccgcgaaggttat

SEQ ID NO: 626792 - DNA, 169 bp, Homo sapiens
  misc_feature (50)..(50): n is a, c, g, or t
ggagtactatctcaggctgcatactcttcgatgctcatgcacatgccgancaagacaccaggtcaagagcgagttgcccgagtcggttggcacatgtaccgaggcacaggcggccatcccacagtcgtacaggctgtgcacaatctgatcctggccattcacgtgcctc

SEQ ID NO: 626793 - DNA, 342 bp, Homo sapiens
  misc_feature (176)..(176): n is a, c, g, or t
tggggaaaaatttttttccccttttttccatttgaatttcccaaatggaatgtttccccttgggccaaaggaaaaggatttaatgggggaaaactagggtttttaaggcccgtttattgggggggggccaaaatggaaccattaggggtgtttttaaaattaaaaaccaaaagtgnattttgtgggttttttccggaacccccaaaggaaaaaaaattagctttggctgttccccaaaaaaagcctccttattttccgggttttaaaaaaaatttatggaaaaagttttccggcctttccctggttttgcctgccccaaaaaaaattttttgtcccccctta

SEQ ID NO: 626794 - DNA, 286 bp, Homo sapiens
  misc_feature (7)..(7): n is a, c, g, or t
  misc_feature (36)..(36): n is a, c, g, or t
  misc_feature (53)..(53): n is a, c, g, or t
  misc_feature (65)..(65): n is a, c, g, or t
  misc_feature (73)..(73): n is a, c, g, or t
  misc_feature (76)..(76): n is a, c, g, or t
  misc_feature (94)..(94): n is a, c, g, or t
  misc_feature (111)..(111): n is a, c, g, or t
  misc_feature (113)..(113): n is a, c, g, or t
  misc_feature (127)..(127): n is a, c, g, or t
  misc_feature (173)..(173): n is a, c, g, or t
  misc_feature (176)..(176): n is a, c, g, or t
  misc_feature (182)..(182): n is a, c, g, or t
  misc_feature (215)..(215): n is a, c, g, or t
  misc_feature (227)..(227): n is a, c, g, or t
  misc_feature (258)..(258): n is a, c, g, or t
  misc_feature (267)..(267): n is a, c, g, or t
  misc_feature (274)..(274): n is a, c, g, or t
ggcattnggatggcagagtttttcgataagcatgtnacctctgaacaggagtnggacaagtactnccactatnttnctgggctggtcggaattngcctttcccgtcttttntnagcctcagagtttnaagaccccttagttggtgaagatacagaacgtgcaactctatgggnctntttctnccgaaaacaaacatcatccgtgactatctgggngaccagcaaggnggaagagagttctggcctcaagaggtttggngcaggtatnttaagangttaggggattt

SEQ ID NO: 626795 - DNA, 285 bp, Homo sapiens
ctgagcccgcagtctggggctacagggtccattggggaccccaggcacggctggcggtaaggcggcacgaggaggagccacagactggccacttggtcctgttctgatattcacaggggaaggaggtggtttgactgggggtggccgcaggagcgtccctctcgacctagtgctgaagcctttgttcctaggcctctggtcgcaatgggtatctctctatttgtaagcagggggcttcgctgctgtgcatcggcagaggtgctggggggtgcgttggcacgccgc

SEQ ID NO: 626796 - DNA, 446 bp, Homo sapiens
  misc_feature (125)..(125): n is a, c, g, or t
  misc_feature (300)..(300): n is a, c, g, or t
  misc_feature (443)..(443): n is a, c, g, or t
ttgggcatcacgtaggtgcggagctcaatttgcccacctgctgcctccaggatcagcaccttgaaaaagtgtgtgggcactgccacgtggttcttgccgatgacctggtactttacgtaggattntcccatcaagcctctgtcctgtgggcagacccaagagcacaacgtgggcaagggggcctggatagaacccaaagcccaccctctttccagagcagcccttctcctgatcgtgtcctcttaacttctgtgcacacctgcaaggaccaccgccctcaactgtgagacttctgttagncctgcctggcctcctcccttgaggcgtggaactcttctccaggggtggtgtaacttctttctcctcttgtttttccttaatgcccaacacctgggtcaaggcagacgcgcccgaccaataaaccgctgctaggagaaaaaaanaaa

SEQ ID NO: 626797 - DNA, 1145 bp, Homo sapiens
  misc_feature (826)..(826): n is a, c, g, or t
gggacaggcttgaggggagcaaagtgggagacaaaagcaggaagcatgcaggggtgtgcacaggtgtaggagacaggggtagagaagactgggtgagggctgggtacagtggctcacgcctgtaatcccagcactttgggaggctgaggcaggcggattgtttgagcccaggagtttgagaccagcctgggcaacagagtgagactctgtctgtataatttttttttttgattagctgggcgtggtggcacattacctgtagttccccagctactctggggggtgtgggggtgttgacgcaggaggatggctgagtccaggcagtgaaggctgccatgagccatgattatgccactgcacaccagcctgagcaacagagcaaaaccctgtttaaaaaaaaaaaaaaattggggggctgggcgcaggggctcaccccttgtaatcccagcactttggggaggccaaggcgggcggatcacgaggtcaggagattgagaccatcctgactaacttggtgaaaccccgtctctactaaaaattccaaaaatttagctgggcatggtggcaggcccctgttagttcccagttactcaggaggctgaggcaggagaatggcgtgaacccaggaggcgaagctttgcagttgagccgagatcgaccaccaaatccagcctgggtgacagagcgagaatcctctaaaaaaacaaggacacctgtgttaggattaagatcctggggtaaaaacaacattataagattaagccagcgcatgtggggcatgccctatatgccaaaacaggaaaagaggggaaagatttgtaacccncggaagaatagcggtcactgtagcctgtagttagttgcaccgtggctcccaccagcgtgggcaacaaaggtaggaccaccgccctttattttaagaaacaaaaaggggcgcgtacaataaattcatcaggggggcacaccgatgagtacccccgttgtacaaggcctgcacgtggcgatatattaatgcgcccgcgcgcgcaatatcggagaaaacgagtgactgtatgacacaaagttgaagtgcagatccgacacactgcgctacatatcatgtactacaggggcgtaaataaccatcaaccatcggtacggctgac

SEQ ID NO: 626798 - DNA, 467 bp, Homo sapiens
attggacatcccgccacgtcattactgaccaccagtggcacatacacaaggtttcctggctgtggatcgtaagtacgcgtaaaaatgatcgttaccactatcactcatgaccatgggcccgtgagatcaacgcatacatttgaacgtttggccgaataatctgccatgtagtatatttaccatattaaccagatccacgatcggatctcatccaggacttcagtgggtagtcccctacctctaagatataagatcaactgtgccgcattaaacgtttctgtgcacgattctcgataatgacaatgcataatatccgtacgagtgtatttacattatcggctggcttgattcgaatggtattgctgaataactgaaatcctttgaggatccaccaaactgatctgccaccatgtgtggaaactaatcatcctcccacgaaccatattgcagtatgcccatcgagaagg

SEQ ID NO: 626799 - DNA, 646 bp, Homo sapiens
  misc_feature (454)..(454): n is a, c, g, or t
  misc_feature (510)..(510): n is a, c, g, or t
  misc_feature (579)..(579): n is a, c, g, or t
  misc_feature (601)..(601): n is a, c, g, or t
aaaacttaaaatatctatcctgcacatcttaatcaatttggagtaataagatacttttatagttgttctatgattgctattttccattgccattaaccaggagtaagcaaaaaccagcaagccgtgtggctggtggtaaccaagtgcccgcagtctggaaaatgccaggctcagagagtcagtggggagatacaaaatagcgagggtagaccctggggccccaggaccagggaatgctgaatggtagaagtcacccctctgagctggaccggcaggcaagcagcctggctgtgcacatggaacagcttcagccacttccgcccatggtcttttgttcagattctgccattcattaacagttaccacatttcacattaactactgccctgttagttcaggattttttttttttattttttattgtatttttcccctgaggtgggagtcttgctcngttgcccgggctggagtgcagtggtgcaatctttgggtcactgcaaactttgcctnccggggttcaagtgattctcctggctttaggcttcccaggtaggttggggttacaagggatggaaccancaaggcttgggtaatttttggnattttttaagtaggagatgggggttcaaccatgtttggccaggtt

SEQ ID NO: 626800 - DNA, 210 bp, Homo sapiens
  misc_feature (126)..(126): n is a, c, g, or t
aggatccccgcagctctctctgtggggtttcttccatggcctttcatttctcctcttcccagtgggcagttttgccaggctcttctcggtggcaaacttcacgcagcgttggctgggcctcggctntcgctggtagtgtactcccagggtgcaaggccagcagtgggatttgcagaccccaggttcaggcacgcaccccaggctgagcaa

SEQ ID NO: 626801 - DNA, 181 bp, Homo sapiens
cggccaaggatttttgcggagatggaatcgcggtgttaatcaaggggggaatagatcctgttacgggctttgcccggaacgcttaggggaaccgcaagtggtgagcaatgacaagcccaatgataccatttgggcgatagaggcacgcggtctggtcaagcggttcgatgggtttgtcgcg

SEQ ID NO: 626802 - DNA, 322 bp, Homo sapiens
gagacggagtctcactctgtcacccaggctggagtgcaatggcgcaatctcagctcactgcaacttctgcctcccgggttcaagcgattctcttgccccagcctcccgagtagctgggactaacgcgcacaccaccatgcccagctaatttttgtatttttagtagagatggggtttcactatgttggccaggctggtattgaattcctgacctcctgatccacccgccttggcctcccaaagtgccgggactgcaggcatgagccaccgtgcctggcagattggaacgttttaacatgagaggagcacttccccaatttat

SEQ ID NO: 626803 - DNA, 618 bp, Homo sapiens
  misc_feature (403)..(403): n is a, c, g, or t
  misc_feature (483)..(483): n is a, c, g, or t
cgccccgtccagtttctttgggcctcggggcggggatccccttttttgccctgggcggggggccacatccccccaagggggggtttttttttcccccgggggaaaatttgtggtgcccccccctagccaaagaaaaactttggtttttccctcccaaccccctttaccggggcccggggggaagggtgtttaaggggtttttaattttttttgccccctggggtcccccccccccccccccaatgggggagattttttttttttgggggggggccatccccccccgcccgccccgggtcctttaacccccaaaaggtggggttcccagccccccggggtttcccccttggtccctttccccacgggggggggggcccccccccttcccctgggttctttttgntgggggggtttaaccgggaaccccacccaagggcctttttcctttcccctttggggggttttccccccggggaaaccccnaccccttttccccccccgcccccgattttaaaatttttgggaaaaaaaacccccgggggtttaaagggttggggggttttttttcccccttttctgggacccggggggggcccccaattttttttttttaattta

SEQ ID NO: 626804 - DNA, 518 bp, Homo sapiens
tcactttaaaatagaagatacgagtgttccatgtatttagctaaaggtatacaagctgataatcatgttagactcatctactcttcaacatcagaagatccgaatgtgcctggtagaaccacggatatccaggaataagcgattccgtactgatacttcactatcatggagcttaatggaccacaggaacaagaagatgaagcttggccactagctatattcaacaaacatcttcaacagactggtcgctgtttgaaaaagaaaaaacttgcaaagaacactatctaagcctaagtgtgtgatacagtttgttactttaaagtacatcttaataatatcagacatctgcatataaattgaacagttgtctgtatctgacccatcatactactatacttctgggttgaacagaattatttatgcagaataatacaattgaatatccatcacttaaatacagtgacaggacagcaacttcagggatctgtaaagctcatttaactggagtgctcacctca

SEQ ID NO: 626805 - DNA, 425 bp, Homo sapiens
agcacactgcagcacgagcgatctatacatgctcattcaaatccatgggggagattaggacaattcaaacccggatgcaaagaaccatcaggagaatgagtgaaggccagccgggcacagtggctcacgcctgtaatcccagcactttgggaggccgaggaaggtggatcacgaggtcaggagttcaagaccagcctggccaacatggagaaacactgtctctattaaaaatacaaaaattagctgggcgtggtggtgggtgcctgtaattgcagctactccagaggctgaggcaggagaattgcttgaacctgagaagcggaggttgcagtgagctgagatcccgccactgcactccagcctgggcgatagagcaagactccatcaaaaaatgtgtatatatcttatgtgatagggaagatgaa

SEQ ID NO: 626806 - DNA, 1031 bp, Homo sapiens
gtgcttgacgaccttgcgcgcatgcgcctgggaggccgataccagcgactaggaggatcctacatgtggagtgcgcacagcatcttccctgccgatatcatactggctccgggaacaccagaaaccctcaagatagtcctcgtgcagtcaccttcatgtttacttatgccaagaggttacgcgacgctggactcgaggcccgtcgacctggcgtcctcactagaggccgacggtccttataagcgcctcgcgcggtaggctgtcatgctacattataggaagaagctgtcgtgagtaggacttgtgcctaaacaggtgacacgaggagactttgacggagatatggaagctatactgcatgactgtagtttgcacgtctatgatgtagataccgctgatgttgtccataatgagagacaataacccaagaattcacggtaagtccagacaatgtgagagccctgcgcacgaagctgaggcacatgctcgagcagtaacaaaggctgaaagcactacttacccatcgtgcagtcttgcgcgatcacagaatgacagatgtattccccgtatcgtccgttgtctgcctgaaagcacctggtagtatgcggcaatctccgggtaactagaacgaccttatacattgaggtctgatctacagctgtacactcatccagggacaagtctggaagccaggctgaaaccaagctgcgtggaccgtggattactgcattgagccagtgacatcctgaacatgaaggatatccattaatattgtcatgacccgtgcatgaagtgcgtgtgatggcttgtgaaacgcagttctacatgggccactcgatgcacacaaaggtttcatgaggagccaatccatagttgcaataagaggataccacgaatcgcgaattcagccagcaggttagaaggcagagggtttacccaacatcacagaaagacactcaaaagccaccgaattcctcctcgggtcaggagattggagcagcaagcttgggtgaactgggagtgtccctctg

SEQ ID NO: 626807 - DNA, 452 bp, Homo sapiens
  misc_feature (263)..(263): n is a, c, g, or t
tcctttttttagaaaaggaaatgtatgatcataaatagctgaaaagccctgttctaattacctctcccgacgcatggagccaccacaagaaactgaatagattcaggcgggaacgtggggctgcagacacggctctgccacctgacgccggcaccatctcctcgctgccacccgcctccccagagtcctctgcccactctttccccagaccccagtcaccagcctggacaggtctgctgtgaccccagcagcaagatcgcccnagacaggagaaggcctgctggacagaggctgggagaggcaggaggcctctctctggaaccctcatcccagctggtcgtttcccaaatgagcaggactctggcatccgtggggcccatcgagaacatgatgacaggcgaaagcggcagtaataagcgcctcggaggaccacgcgggtcagacagtcctgc

SEQ ID NO: 626808 - DNA, 530 bp, Homo sapiens
  misc_feature (1)..(1): n is a, c, g, or t
  misc_feature (79)..(79): n is a, c, g, or t
  misc_feature (86)..(86): n is a, c, g, or t
  misc_feature (93)..(93): n is a, c, g, or t
  misc_feature (120)..(120): n is a, c, g, or t
  misc_feature (130)..(130): n is a, c, g, or t
  misc_feature (136)..(136): n is a, c, g, or t
  misc_feature (158)..(159): n is a, c, g, or t
  misc_feature (273)..(274): n is a, c, g, or t
  misc_feature (278)..(278): n is a, c, g, or t
  misc_feature (292)..(292): n is a, c, g, or t
  misc_feature (303)..(303): n is a, c, g, or t
  misc_feature (308)..(308): n is a, c, g, or t
  misc_feature (320)..(320): n is a, c, g, or t
  misc_feature (342)..(342): n is a, c, g, or t
  misc_feature (344)..(344): n is a, c, g, or t
  misc_feature (469)..(469): n is a, c, g, or t
  misc_feature (530)..(530): n is a, c, g, or t
nctccctcccttcagtagtcttcagccatggccagtaagacaaggctggtccagtcgtggaaagggcggcagccatgcntcgcccntcgcggncactgttactgctcccaaagaaagcgngtaggctggnactggngccatacattgcgctaccacgnntggcacggtagctcaccgtggagtttggcagcccgagcctggtgaggaccctgccagatgcccatagtggtggggtgctcccaaagccaggtagttgacattgagccacacagnncccngccagtaggggggntgatgctctgnattgngctggccataanaggcgctggaggctgcaagggngngtgaaggcaaaggggctccagagatggcggctgtcggctagaatgtccaggagggggcaaggcgggatgaggtggggtccagcagtcgcagcaggaagggaaaaagactgacatagccaaggagnatctacatactgcagttgaggttggggccgacccaccacccgaacgagcccctgagggggn

SEQ ID NO: 626809 - DNA, 671 bp, Homo sapiens
  misc_feature (420)..(420): n is a, c, g, or t
gcatggtggctcacgcctataatcccagtactttgggagtcacagtactcaggatcatctgaggtcaggagttgaataccagcctggccaacgtgataaaaccctgtctctactaaaaatacaaaaattacctagaggtggtggcacacgcctgtaatcccagctactcacatggctgaggcaggagaattgcttgaacctgggcagcagaggttgcagtggcaccatctcggctcactgcaacttccgcctcccaggttcaagagatcctcctgcctcagccccacatagtagctgggattacatggaaatctattatgggatggcctggatatatcactttaaaaatcctgcttttaatgaacaaatgagaaaagaccaagaaattgagctacagtgaggtcacacagccgagaatcncacagtgaagagttgggatttgagcctggaatactctgacctcagagtctggatgctagtctcttgctgcctcccctgtgttatgaggtcatgtctaaatcacctccgttactgaaaatgcttgtgaaagacctattctgctggatagagcagtcaccttagtcaaatatgatccaaatgttgccattaggtcctacccaaccccatcaaagatcagaacctggaggtgtggtaactccctccagtccaaa

SEQ ID NO: 626810 - DNA, 145 bp, Homo sapiens
gccctgaaaccatgctgtgggttcctaggtatcctgtcttggtctttcttatccaggctgcaagcaatgattgaagcaaacattgtttctctggaacgtgatagagccctagagttcacctcatccccagaccagatccttattt

SEQ ID NO: 626811 - DNA, 1431 bp, Homo sapiens
gacgatggcgggcttctccgatcatgggtgtaatgcctgagattagcacagggctgtggaccgatgatggattcggctcctcccaagctgatatccatggctgaagtccactcgccactgatacttaccgacggaggtgatcgtacacttactggactggtccgaaaatagggaacagttggcatacaactgggtagcggaaaagtagttccaagtcttattccagataagttcatagaaagctactgaggaggaacagcatggtagccgggcgacagactacggtagacaaaatctagatcaagattcattagactggatcgcctgtcatgtagtgctgcagacggatatggatcagcatcgcagagccacattaactggacacgaagagagtctggctgtctgtgaacacatttttgggggttgcatggatcggctctataagtccagttccccaaagtcaggcaggaagctgacatacgcgacaattgggccgagtaggacgctggtcaagcaatgaatcacatgaaaatcggcggaagtgtcaaagtcgcaataacgggggagaaagcaccatagcggtacttgcactcggtatgtcgcttgactcttggataggacccccaaagaggggggctttgaaactggcgccaagcgaaggattccgttcagttctggggcatgcgataagcggccaatggccttagtgggtgggcctttcatatctcggtgggaacccctttaaacgccggattagcgttgggacctctgagtggctttacaggcggacctatttaggtgggcctttctccgtgcctgggggagaccctaaggtgcatagagcggacaccacattttgggccccaattaacacgccaaattaggcgaagatctaacggcaattaaagcagtggaaagtcggttgccaaaggaaatgcggaaaacttgtgggcggatctttaagtaggtcggctttgggattgagggccaatgttctggtgagacttgtactgtggagacaccatggggttaccttagttcagggcaaattatggacgggtgtgtgaagccaaatcggctatacataatggtatacgcccagggctgcggaaaagcacaggacactctcggagataggagcgacgagcacgtgcctccttatgtgcggccccgtgtgggagcttcacatcggtttcgagcaattaatcgctattaacccaaaggcgcaagcgcaatttttcacttttgacaacaagagaaagcaccttatatggacacgcccggatccgtatctaatgcaacgctcggaccggtctcgcgtagggatgtcgtcgtgatgaacagagaaaaacgtgtcgcactttggagaacccttggaaaggggactgcgtgaacgcctgttttcctaggcgggggaactagcacactggg

SEQ ID NO: 626812 - DNA, 128 bp, Homo sapiens
aacttgggacccccaagttgtaaaaatgtatgtttttacctgccagttataccccaggtagactgtcaagtttaaaaaagtgaatccataacttggatttgttttaaaaattaaattaatccttgata

SEQ ID NO: 626813 - DNA, 165 bp, Homo sapiens
attcgcggccgcgtcgacgtgaggaaacattgaactgcttttcacaaaagctgtaccattttactttcccagcggcgtatgagggttccaatttgtccacatccttgccatacttattttttgttttttttcattataggcaccctcccgtcctccacccctccc

SEQ ID NO: 626814 - DNA, 158 bp, Homo sapiens
  misc_feature (13)..(13): n is a, c, g, or t
  misc_feature (43)..(43): n is a, c, g, or t
  misc_feature (95)..(95): n is a, c, g, or t
  misc_feature (105)..(105): n is a, c, g, or t
  misc_feature (119)..(119): n is a, c, g, or t
tgcacctggccantccctgtcctgtctcctcagcctgcctcanagtggccatggggtgtcggggtgaagggtgtcccagctacttgtcctctgcnggaccctaancccctgcccgcaantccacatgccctctgtgatgagtggcgtctttcctgcct

SEQ ID NO: 626815 - DNA, 134 bp, Homo sapiens
ccctgctcaatatcctaagcatagtgaagttctaggtggtcctcataagggttcctcaaatcttcaaatcattcccttcaatctaaaatcctcaatggacactactgagtcctctaagaggtccagtcttccgg

SEQ ID NO: 626816 - DNA, 970 bp, Homo sapiens
gccgggtggtgctggcttccccactggcctcaagtggagcttcatgaataagccctcagatggcaggcccaagtatctggtggtgaatgctgacgagggagagccaggcacctgtaaggaccgagagatcatgcgtcatgaccctcacaagctggtggaaggctgccttgtgggaggccgggccatgggagcccgggccgcctatatctacatccgaggggaattctacaacgaggcctccaattgcaggtagctatccgagaggcctatgaagcaggtctgattggcaagaatgcttgtggctccgactatgatttgatgtgttgtggtgcgtggggctggggcctacatctgtggagaagagacggcacttattgaatccattgaaggcaagcagggaaagccacgcctgaagccgccctttccagcagatgtgggagtgttggatgccccacaactgtggccaatgtggagacagtggctgtgtcccccaccatttgccgtcgtgggggcacctggttgctggcttggccgagaacgcaattcaggtaccaaattgtttaacatctctggccatgtcaacacccctgcactgtggaggaagagatgtctgtgccactgaaagagctgattgagaacatgctggtggtgtcacaggtgggtgggacatctcctgctgtgatctggtggtcatctactccactgattcccaatctggggtgtgaacgtgctaatggactcgatggccggggcgggccagaacggctggacaggtgcacgttgtaatgaccgccgagaaatggaagcacccggtcatggattacagctggggtcgggcggttccccgcggggggtgaggaacaggggccccttggaggagcgcccatatccggggaaaagaaaaccacgtggggggggcgcaggtacaagaggagatggcgaggggcgcacacctcgagagaaatgcacc

SEQ ID NO: 626817 - DNA, 332 bp, Homo sapiens
cctagctccatatcacaaatcgcacaggatccaggactctttccatatcttcaccacgaacgctgctgtcagattgatcctcagtcctagctacatcaaacactggttcctggaatcctgtctgctgctgtcttcctagattcactgaatccacttctgtgtagcacctgggtcagctgtcaattaatgctagtcctcaggatttacaaaataatcttaactcaaagtccaatgcaaaaacattaagttggtaattactcttgatcttgaattacttccgttacgaaagtccttcacagtgggcaaactaagctactatatttaaggccttc

SEQ ID NO: 626818 - DNA, 186 bp, Homo sapiens
gaggaaatctgagggttgtctctgaccttaccaacagttgtcacaaaaggtcccttttatgatgtgtcagtacacatcatagaaggtaccctttagttacattttaaagttagctgttaacttatctgaaatatgtattgtggaacagcattgatactgtgtggaacaacgaagtgctttggaatg

SEQ ID NO: 626819 - DNA, 275 bp, Homo sapiens
aaagtatacagcgaattcaaacatcagtttatctgcaaacatgctggccactttaactgatatctcaatcaagcggtacagaaataaattaagaaatcccttcacggatatgccgtgatttacactgttcaaaggtacactgttcattaacatgtactcctggttcagaattacctttgagactccttgctcaaaatttggttaacagtaagaatcttccagaaatacaagttcttattaatcaataatttgtcagctaggatacagtagggaga

SEQ ID NO: 626820 - DNA, 554 bp, Homo sapiens
atacccaagaagacaggaaaacaggagagaacagtcaccagatcaagaagcacatgatcggtgtactttttaattttcttttataggagcctgtcgcccaggctggagtgcaatctcagctcactgcaagcgccatctcccgggttcacaccatcctccggcctcagcctcccaagtagctgggactacagtggtgtgcaagcatacctggctaattttggcatttttagtaaaggtggggtttcgccatgtgggccaagaggtctccaactccgggcctcaagtgatccgctcaccttggcttcctaaagtgtggggatggtaaacgtgaaccacagtgcccagcctgccccagttccttattaagcagacatatctccttccgggtggacctctagccgcactgtttcactacggggcagtgaaatcagatggtacactagtggcagcagtatttataggccttgaaacacaaatgggtaactgtgtaacaaatgtttagcgagccacatttcatgacctgcttggcaagacaacaattgcccgtgtgaccg

SEQ ID NO: 626821 - DNA, 315 bp, Homo sapiens
cttcgcgtccaattcctcatgccttccggttgatggctcctcctggtgcttcagcagtctcagctgtgggtgttgcagctaacgcctgtgtgatgtttgtcccatagaacttaggttctgtggggctgagctttctcgagggctgcacggagggagctgagggtgcaggcaaatggggcaggggctggaagctcataggctggtggtggctcccgggtctcaaaagggttgtagacgtcaagcgtggcatactgccggctgggtcggtgctggatcacagctgggtcctgaaaggggttgggacacgaatgttca

SEQ ID NO: 626822 - DNA, 351 bp, Homo sapiens
gtcgacggtcataccgaatatcacagtgtcacgtaggaagcccaagggaggtattcccgttaatctgcagccaaggccgggcgcggtactcatgcctgtaatcccagcactttgggaggccaaggcggatggatcatgaggtcaggagttcaagaccagcctggccgagatggtgaaaccccgtttctactaaaaatacaaaaattagccgggcgtggtggcggacgctgtaatcccagctactcgggaggctgaggcagagaactgcttgaacctgggaggcagaggttgcagtgagctgtgatcatgccactgcactccagcctgggtgacagaacgagactccatctc

SEQ ID NO: 626823 - DNA, 137 bp, Homo sapiens
ccggcggctaagaacttccctaccccaaagtgagtgagttcttggaccagaccagactgttctattgtgagagactttggtgatgttgagtacctatgaatacttggttggtaggcctcctaagtcacttacccata

SEQ ID NO: 626824 - DNA, 436 bp, Homo sapiens
cgggtgcattcaattaatttagtaccccagtggtcatgcaagtgcctgcacagtttcaaaggcatggtacagaatatatcagtgttgatgtagtctgttacagaaacagctatagataacattatccagtgaagagcaaaattcaagctatagagagatattcatgcatgcgattgttgagatatcgtaaaaataggtatttgtctatttatggtgggaggtggtcgggaacttagaagcaaaatggggtgttaatttttgtacagtctgtgggcatttacacatataaaatgtattaaaattcggtaattatgtgtacattaaattaataaaagttacttctagttatgattggtgaattccctaagagcttggatttttttaagtaactttatatcagaaatgatactgcatctttatatttttaaaattgtgt

SEQ ID NO: 626825 - DNA, 197 bp, Homo sapiens
ctttggggggtggggttttgcccccccccccccccgaaagggccttttctttttcccggggtttttggggggggggggggggggcccccccttcccggggttttttggttggggggggggggttgggggggcccccctttttttttttttccgggcccccgggggggtttttggccccccccccccccctgggggga

SEQ ID NO: 626826 - DNA, 185 bp, Homo sapiens
tctcaaagcgcgagagagagggggggtgggtggggagagaggagagagagggaagtaagggccattttttatgagtcactcggggccagcacaggggctcaggctggcagtctcaacacttggggaggccaaagggggaggatggctggagcccaggaattcaagaccatccggggcaacacaag

SEQ ID NO: 626827 - DNA, 338 bp, Homo sapiens
tatcccaacgcgagccgccagctgtcacactctacatattcttggtgtatgataatctgtataatttgccccgctctatccaccttatatattgtgggctactttccatgtccataagtcatttatttgttaaagccatgttattaagtaccttctacttgctggtcactgttgtgtaccattatgcttagtaggtacatgcaattccatcttatgattcacctaacacttattaggcagtgtctatcatcctccacgccctccctctaaaatgcctgataggcaggagacttcttccatgtcttcctaccttgtgtgacccataccgtgccggctcg

SEQ ID NO: 626828 - DNA, 429 bp, Homo sapiens
cacaggtgcataccaacatacccagctaatttttttaaattatgtgttgtagagacagggtctccctatgttgcccaggctggtcttgaactcctgggctcaagcaattttcccacctccttaaatgctgggattacaggcatgagccaccacactcagctcttactttatgctttacactgaacaactcaaagttccttaaagatgtgatgctgaattgttttcctggcaccacactctcagcctaactaaaaagttagtcattactttcaaagacccctccataatcgagatatttatctacatctattactgtggtttatcatattatatcagacatattattaatacgtctttctcatctattgtaagtatccttcctgagagcagggccctgtgcctagcagagtgtgaggttcaagtcgacgc

SEQ ID NO: 626829 - DNA, 117 bp, Homo sapiens
gatagcgcacgatgcgcgtccctggcatggctggagaatcgtggggacctcccactcctcccagccgggcccgagctccagttgtagcccctggtgtcagcagcgagagagcagtgg

SEQ ID NO: 626830 - DNA, 481 bp, Homo sapiens
ggatatacacgacactgtgtcatagggtgggcatcaccaagagaagtcgcaggtgcatgaatcccacaacgattcataagagtgttctaggaggcaaattcggtgtgcatacagagaggcaggactccgcagctgtggggtttgattacaaggagaagctggccaagcacgagtcccagcaagactactccaaaggcatcggcgggcagtatggggtgcagaaggctcggatggctaagaatgcgtcaacctttgaggatgtcacccaggtgtcctctgcctaccagaagacagtacctgtcgaagctgtgaccagcaaaccaagtcacatcagagctcaacttagaaaccctcgctaaggacaaagcagcaggaggacaggcggaaggcggaggcggcacacgcccagcggatggccacggagcggcaggcagcaagaagcggcaggaggaactggaggacaagccacaacacaacttcg

SEQ ID NO: 626831 - DNA, 467 bp, Homo sapiens
tggagggggtacctttctgggtttatgcagtttattgactggctgtgaaagtacagaagaggctcttagaaatggcatccaacaggtgatagcacacaagctgacaagctggtccgtgatatttatggaggagattatgaaagatttggtttgccaggttgggctgtagcatctaagtttggggaaatatgatttataaggagaagcgagaatctgttagtaacagaagatctgggcaaggagctactttagtttactaatcaccaataaccatgtggttctggtgggcaccgaatggtgtcgctggttacatgacgaaaactaaaccagacgtggtcttgtgtgggaaacctttttacgttgttcaataccctctcaatgaaactttgtggcatatgcactggattactgggtcaaacaggttcaactacaaagccattggtcttcttagaaaccattgacgggga

SEQ ID NO: 626832 - DNA, 1296 bp, Homo sapiens
  misc_feature (1296)..(1296): n is a, c, g, or t
ggccacacttgaagaggctgagggaggcggtgtcgtccggcgtgagtgctgtcatggatgctagcgcaggaagcgcgggaactgggttgctggcgcggtcgaatgagatgggggtgcccgtggtcagggccggggcgccggaatcgacgctcgggcatgcgctgtgtctcgggcctagtggggctgacatctggggcctaggatcttgcgagcatgtgcacagtcgagtaggggactgtcgaagcaatgatcctggtgagtaaaccgtactctgagtcatggtggcaaccaggacctagggtccaccagggatccgcttcggtagaggttacggaggcatgggaaagcctgcttgttggaactccgacgctggcggggcgagcagagaatcctagcgcacttacgtacccaagaagactctagtgaagacctggaattggaatgccagtacgaacgacttcgaacgcgactccacgggaaaccacctgggcgtccactgggaaagaccacgtgccatgcgaatcgaagaccacgactatcgataggacgagccacaggcgttatcagaggcgatcgtctcctcgcgtcgcgggtgcaccgaagggccttggcgtggctcgagtggactgcacatggaacaatgagacggggacatagccggccatccggggagaatgtcgcacgaagtgttcaaagaccgtagcacgtgggccaggcaaaggtgcaaattttggacaggaggccgtcctgttgacacaccgggaaaccaggtgtggtaggcaagggcaaattgtacgagccaatgagggataagtacagtggcctgaaaccccttatatgggggatctacaccacagtcaacctgtttcggatgttgaagcacttgtcagtggtggtgtccccttgggtaacgactccaccggaagtgaggggtcgcctggacagcctgcgaaactggattggcgggataaccaaggccccttttgataaacccccgttcccctggaggtgggccccagggtgatacccgcttggccaagaaaaaacctaattcactttggcaatttgccgcccccaatggggacccgataagacaaggggggagtacaatggacattaccggtcgtaaaattcgcccccgttccagttgggaattgaacaccgaactttatgtataggtgaccagcatattgactggttgagaacgccagaagataggtggtggggcaattggaagagcttgcccacggtttggagcaagagacctgggcatgcgtgtctggatacaaaaaagcn

SEQ ID NO: 626833 - DNA, 1392 bp, Homo sapiens
gacacgaggagccagatagtggtgagtgtatacattcaccacaccgatgctgtccaggaattaggacggaagtgcccttgacatgaatgcctggtgctgcaagcctgtgttacgcatgccatgggacggacacacacgacgtatgcatgtgcatcatccattggcaaacaattgccatcttttgaattgttgatgcagatcaaacctcagtttacagcaatgtcctagcaagcagtagaacccagtaacatccagtgcgttaattacccaactatgtgcacagcctaccttcaacatgccttgttgtgctgctgtgccacacccaatttccccagtgcacgtacaacatcacatcacattgtatgtcccagcattgctcttgttcgcacgttgcgcacattgctcttggccccacaattgcactctcaattgcacacgcattcattcccactgagcacagcacatcaagtccaacacaataaccccaacatgcaacacacgtgccatcatctcctagacacagcccaccgtatcccacatctcccaatctgcacggcagtctatgttctggcacgcccagcctggcacacgcaacaggcatacatcgcttcctttgtacaacacaatacatcggacggctcgcacccagtcggcacttccccgatgccaccgcaatacttcactaacactcgacacgtctcggctcctctccctccttcacgcatctcaattcatattatgggcatacacacacccccctgaactacaccgggccctcatctccatcggctatgcattctctatacagttaagtttacacaacgggcttcttcaccttcatctctctccacccagcgccttaaccctttgtccgaccaccttgtggcgcctcaagcccttacaagttgtacaccttactccaagcgcccataccaatgcaacgcgctcatcaacaacgcataacccctggcccacagcttcggcggcacccacctgccacggacacccaaaccaaaccagaggaacagcgggatctaaaacccgccaccccgcaaggccatggcgcgccacgcgcacacacccaaatacaccttacggttgccacaaactaatcgctaatcccacacccaattggctaggcaacattgctgtctagggagcctcgaccccccccgcgagtcaaaaaaccccactactgtaggcgacctatctcctccaacctctctgtgacaactcaaacattgtatcccccattaacagacgaggtgacgtatgatcccggcgccgctgcattgtccactgtacaacgtattgtgccactatctacaatctacacactaacgctttgcaccgcaggcgtgccgctagcacatacccgtcgtgctacctcca

SEQ ID NO: 626834 - DNA, 214 bp, Homo sapiens
gtcagagggagggaatatgacggatgatctcaggggaggagtgtccacactcgacagctgggaacactgaatgtagtgggatgggagtacacgtgattagggccatcttggaaaatacaatctgccatacatgattctacttcaattgttgttgtaattttttcactattacagaagaagtagaatcatgtatggcagattgtattttccaaag

SEQ ID NO: 626835 - DNA, 156 bp, Homo sapiens
agtagcgtcaacatcatcccacttgaacatattcaaaataaaacaggtttactcaggatgctgaggcaggatagcttgagctcaggagtttgaggctgcagtgagctatgatcacgccactgcagtccagcctaggtgacagagcaaaaccctgtc

SEQ ID NO: 626836 - DNA, 249 bp, Homo sapiens
cggggtaatttttttaatttttggagaaaagggatctcccttttttccccaggggggttttaaattttgggccccaaaggatcccccccccccccccccccaaaggggggggattaaaggggtgggcccccccgccggggcccccttttccaaatgcccccaaaaaaatgtccctggggaggagcccgccccccccccgtccctggggttttgggggcccaaaaaatttccccccattgggttttccca

SEQ ID NO: 626837 - DNA, 324 bp, Homo sapiens
ctatttgtctttccataactcgctgtttccgttatgtaatgtctttcaaggtaactccacattgcatcatatatcagaatttcctaccttttataggctgaataatattctgttatttgtgtaaagccacattttctttatccattcaggacatttgggttactttcaccttttggttattgtaaaattttgctgcccttaacataggtgtgcagatcccacttcaagaccctgctttcagttcttttgcatatttacctagaagtagggttgctggatcatatggtaattctctttttaatatgtttagtgtatccgtgaggg

SEQ ID NO: 626838 - DNA, 330 bp, Homo sapiens
  misc_feature (211)..(211): n is a, c, g, or t
  misc_feature (315)..(315): n is a, c, g, or t
gttgaggctgcagggagccatgttcaccccactgcactacagccagggtgacaacaagaacctttctcggcgtgaacccagggggcggagttgcagtgagccaagatcgtgccactgcactccaccagcctgggtgacagagcaagactccgtctcaaaaaaaagtttactactcggctttaattatttcgtttcggttttgggtgaaatnattttattactgactggttccttagttgtacagaagcctattatctttagagagactcttcatggtaattaactcagattcttattttgcctgggtgaaagganggcaagtggatctaa

SEQ ID NO: 626839 - DNA, 152 bp, Homo sapiens
  misc_feature (8)..(8): n is a, c, g, or t
  misc_feature (16)..(16): n is a, c, g, or t
  misc_feature (65)..(65): n is a, c, g, or t
  misc_feature (133)..(133): n is a, c, g, or t
ccgctacnaattgggnaacaaaagagtagctttgccaatgccgcctaaacttgctgcctcgaaangtgggctcccctcttcctcttgaccctgcaacctcctagggcattgtatctgtctttccactctggantcagccttctttttctgga

SEQ ID NO: 626840 - DNA, 151 bp, Homo sapiens
ttaaaatgctaagagatcttactgtagagatgaggagagtaattgtatgacctgtatcttccccccgtcttttttttcctttaacagtattctgtttcagcataaagcatcactttctgaagaggttcctgttggagactgtaatctctga

SEQ ID NO: 626841 - DNA, 169 bp, Homo sapiens
cggctcttctactacgagcgcactcttgccagcagtgccaacggggccagggcacaggagcacaggagcaccagggggtccagcggggccggtctcaccacggtcaccctggcgggagagcaggggaatatgggtcagccccggggtgacacggccagagatgaggcag

SEQ ID NO: 626842 - DNA, 240 bp, Homo sapiens
cttcttccgcaccccaccaatgccaggactttacccatggtatcctagttctcaaataatttccaaagaagattaaacaagcaaccgccaggcggttggaagaggttcgtgcaacattattatttttttgagataacgtcatcagcgcggggcatttattctattgcctgttatcgcaatggtagttattgggtattactggattgcataatcatttgcattctgcagctacatatgtca

SEQ ID NO: 626843 - DNA, 117 bp, Homo sapiens
tcctagccgcgccagtggatgaaggtggttccatcattgtggatgtggtaaatgaggtggtggtagtgggtgatggggtgctgtgggcctggttatgcactggcgaggcgaggacgg

SEQ ID NO: 626844 - DNA, 124 bp, Homo sapiens
  misc_feature (10)..(10): n is a, c, g, or t
ggatcttagnagcaggaaccgaggcaggtgtcatgtggtggagcgctgtgacccggggaactccatctgactggtcaggttcgtgcggtacggaaggtcagacccttgagttctggtggctctg

SEQ ID NO: 626845 - DNA, 329 bp, Homo sapiens
cacgaggcctcgtgccgtgacgatgctcggcgtatcgaggccggcggcgcgcatcagcagcggcgtcagcccggcatgccagtcgtgggcatgcacggcggcgggcaccggcagcggcgttcggcccgccgcgatcgcggtggcggcgtgcgccagcgcggcgaagcgctgcgggttgtcggcaaagtcgcgcccggtgggatcggtgtagggcgtgcccgcgcgatcgtagaacgacgggcagtcgagcagggcgacctgcacgttgctgcccggcaggcggccgagcatcagccgcatctgactgtggccgggcggcagctccagcc

SEQ ID NO: 626846 - DNA, 343 bp, Homo sapiens
ggtgttacacgctggcactggtcatgaactcctagactcaagcgatacctgcccctcgtgctccaaagtgcttggattacaggcgtgagaacacgccagggtggtttggttttgatttgtaagtccaggcatttttagagtcctggaggtctagtttacttgcccaaatacatctatggttttaggtaaactttctggggaattatttcatgagtattaaggcaaaggccatcagtgggcataagaagtcaatcaagggggaaaaagtacctcagggcctcatgcgtgggatatattagttaaggattacttatttcctgagagcccgtcttcacagggtacc

SEQ ID NO: 626847 - DNA, 806 bp, Homo sapiens
tggaaaaaacaggttcttaaatggtacggagtctcacaaggcaacgaaggaccctcaccaggaccaaataaaataatctcccagcggttgcatgaaaggcgcggcctggggggaggatgtgcggcatctcgtgaggcctcctcccgagggccgtggtgtgggcgagcccgggggtctctgcagctcgtggtgaggggccctcctggggtgtgtgtgctccgggcccctcatagaagccgggctccagctcctccgaggagtgggagaactcgcttccactcacttcctccggaggtcggagagtgtattgtcccggccactgagtgggggagtgtgacgccagaagatctggcagggtgtgtcgcccgctgttgtacggcgaggtgtgtgtacacgtgtgtgcgcatccccttggggggaaggagagcgtctcttgtcttgtgggcagacccgtgggggggcgcctattggtccctgaggaacgggggtctctccctatttctctgttggccgcccccctttcggtgggtctgttggccgttgccccactgttgggggggggggctcctacacgcgtgtggtccctccccggagaggcacacaatgtctcccgcggggagactttgggcgccggagtcctctggggcaacgcctctctctgtggtcaccccggcggtgttccccccaaagactcgtgggggtttcgtctggcccgacatgcttgagggggggccctccggggagactgtccccagagaaccttccgccggaagagatgcccaattgtcccccggaccggttgattg

SEQ ID NO: 626848 - DNA, 203 bp, Homo sapiens
  misc_feature (168)..(168): n is a, c, g, or t
  misc_feature (186)..(186): n is a, c, g, or t
agagagagagagagagagagagagagagagagagagagagagagagagagagagagagagagagagagagagagagagagcggatgtcatctttgtatttggagttcagaactcatttttggggggggggaagacaactggctttggcatgatttatgattccccggnttatgcaaagaaaaatgnacccaaacatagacttt

SEQ ID NO: 626849 - DNA, 423 bp, Homo sapiens
attgctcccagatctgactctactctggcattctttatattaataggctataaatttccctctacacactgctttaaatgtgtcccagagattctggtatgttgtgtctttgttctcattggtttcaaagaacatctttatttctgccttcatttagttatgtacccagtagtcattcaggagcaggttattcaatttccatgtagttttgcggttttgagtgagtttcttaatcctgagttctaatttgattgcactatggtctgagagacagtttgttataatttctgtacttttacgtttgctgaggagtgctttacttccaactatgtggtcaattttggaataagtgcagtgtggtgctgagaagaatgtatatattctgttgatttggggtggagagttctgtagatgtctattagg

SEQ ID NO: 626850 - DNA, 219 bp, Homo sapiens
gtcgacctttccatgattagctatattcctttgactacaagacaagtcaaaaccttctttgaaattgctgtttgttgggtatttgatcatagcattcttaattttcgatgtacttgtatctgggatgctctatctggtttgtaataggcacatcaggatggcccatatgaggcaggatgatttttgtgcattcaaggccagcctgggatacatagcaag

SEQ ID NO: 626851 - DNA, 1408 bp, Homo sapiens
ggccgcgcggggcatcacggccctggtcgtgccaggcctgcggtggcaacctcggctttccctgctcaggagcctcgtgtctttctccgcagcgctttgccagccggccggctttccccttccaccacacacctccacctggtcacagcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttcattttctataagaaaaaggaaaagttgagggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcgtaatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaacc

SEQ ID NO: 626852 - DNA, 950 bp, Homo sapiens
atgaaagtcttcctgaagcagtgaggaatgtgccaggcatgcaccccaagacctgccctgtggtgctgccccctgagacccgcccatctcaggctggcctagggccccctagcagccccgctccgatcaccgaggggtaccagtccctgtcagacaggcccccggggtcccgagtcttcactgagtcagagatgaggccactcagacatcgcaacgtagcgacgcgtgtcgtgggaggtgtccccagatggtgcccccggacccgggctcccggcttggttcggagatcctgtgtactctgggtggtgtgagagctgacttctcgatgtaggactgctgctcctggctttcagggtgctgtgaatgctctggtaagagtggtcaactggtaccttcctcctccgctcttgcgtctttcgttggtaacacggaccgtgggtgcccggtccttggggtaggccttgggtgaccaagctggtcactgactgctcttccagctgcaaatgtaagcgaacgtctctcttaccgatcccagacaacaccgaaattagctcgatggaacccagtacggtcctggtccaatatatgggggcctgtcctaggttggtgcgaacagtgctcctttatgtaagtcggagcccctttgttttacaccccagttcgccttgtgtacacttaaatgagacgggagagataggcatggcattgagtgacacgggtgctccagttcatggtctcccatgtgtgctggggctgtcatcccactggggttgctaggaccgcgttgggcccctcaccatgttggctttttaccttccgattattccgtggccccggttggcctggtcactggagatttcggcccgtgggttgcgtggtttccttggcggtacccgatgttttggtccgcggtccccccccgggcgctggttttgccgggccacacggtg

SEQ ID NO: 626853 - DNA, 434 bp, Homo sapiens
  misc_feature (323)..(323): n is a, c, g, or t
  misc_feature (330)..(331): n is a, c, g, or t
  misc_feature (334)..(334): n is a, c, g, or t
cactttgggaggctgaggcaggtggatcactggaggtcaggagtttgagaccagcctggccaacatggtgaaaccctgtctctactaaaaatacaattagccaggtgtgggggcgtattccagttggcctgtaattccagcttcttgggaggctgaggcagaactgcttgaacccaggaggtggaggttgcagtgagccgttatcgcgccactaagccaagattgggccactgcacttcagcctgggcgacagagccagactgtttcaaattaataaatatgagataatgcagtcgggagaagggagggagagaattttattnaatgtgnnggnctggcccccccccccccccccagcaggagagcagcaaaatttatgcaaatctttgaccggtgtcccttgtcctgccagattaaaagccatgaggttctgt

SEQ ID NO: 626854 - DNA, 408 bp, Homo sapiens
acgccgagagtgaagtctggtgattcccagcatcacaacctcgaagggaaacgtacaggggccatgaagaggcagcactgagtgttgctagttgtaaaagcaaggtgcctcctcttggaccctataataccaggtgccctgtcaggcatgagtcctgtcctctaagccccctgggtactaggctctaagatgaggaagtgagtcacaggggtctggattctgttaggcgctggggcactcaagatcctggcagtgtctatctagttccgaggatgagaatgactggccccccgattataaatggatccctgtgaaaagatgctgtgccccaaatactgtcctggcaaaaacatgcagaaggaagtcaacataactggtatccagttcctaggggtaagatatttcaac

SEQ ID NO: 626855 - DNA, 1592 bp, Homo sapiens
  misc_feature (1424)..(1424): n is a, c, g, or t
  misc_feature (1453)..(1453): n is a, c, g, or t
  misc_feature (1467)..(1467): n is a, c, g, or t
  misc_feature (1474)..(1474): n is a, c, g, or t
  misc_feature (1482)..(1482): n is a, c, g, or t
  misc_feature (1563)..(1563): n is a, c, g, or t
ggccgcgcggggcatcacggccctggtcgtgccaggcctgcggtggcaacctcggctttccctgctcaggagcctcgtgtctttctccgcagcgctttgccagccggccggctttccccttccaccacacacctccacctggtcacagcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttcattttctataagaaaaaggaaaagttgagggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcgtaatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaacccgccattgggctactngtagatttgtatcccttgatgaatctggnggtttccatcaganctgaacnttacactngtatattttgcgaatagttaccctcaaggcgctactgacccaaatgttgtggtgagatgatcatttacactttttgccaanataaaactatatcgattccttttcctatt

SEQ ID NO: 626856 - DNA, 687 bp, Homo sapiens
ctcctccaggacattgatattctcaaagaggaggcacatgactgtgtcttgtgcagagctactgacaacagagggaacgacttgtgctggtagcccctgcaggcatcacactgaaggaggcaacatgaaattctgcagcgcagcacgaagggaaagttgcccatatgtaaatgaagatgatgagcttgtgtggcatacatatgcccggacagacctgaagaagaatcgggactaaccactagacctccaaagatgccaacgaaaacagcgtgctgtggtggtgggcaagccaatagtggcactccctgagtgattgacaacgtataggcttggacttgtcgtcgcgccaggctaggtgtggatgtagatcggtatctttgggagactctatcccagagggaaaattccatcttaccagaatacaatatgatcaagtacatcaaagacaaataccctaatctccacagtcattggaggccaaatgtgggtcccaccatgaggtagcgcccatggcctccacaagaaatcctcacttggagatgccaagagttgatcggcgactctgcgccccatggccatgtgcagcttgtcgagcacctgccgcgaaacaggcttggcgacatacccccacaatcatcggcgcagtcttacctggccacggcgcacacagatcggctttgggaccct

SEQ ID NO: 626857 - DNA, 236 bp, Homo sapiens
aagtgatcagccggtaccgtagacgctgaactatgtgaacaaaggtctctggttttcctaggcagaggaccctgaggccttccgcagtgtttgtgtccctgggtacttgagattagggagtgatgatgactcttaacgagcatgctgccttcaagcatctgtttaacaaagcacatcttgcaccgcccttaatccatttaaccctgagtggacacagcacatagttcagcgtctga

SEQ ID NO: 626858 - DNA, 891 bp, Homo sapiens
cgatgtctttgagctatgcgtgtactctgtccgggcacccgaggttgtcggtcgccccgcccccctttgaggcttttccggacgcttcacacaggccgcacaaaccgtggttgtagcctccctttcgccgcttccaactttatacggcgtggaccacccgagcggttgtacttaatctcgccagggatactgtctcttcacggtttaataccagcgtgaaagcgctgaatgaccccgcgtgcctccgcctggtattcaaagacgtgtttcaaaggcctggcgccacccaacccccggcggagtcaacgaggacaaaccagtcacactcgcgcgcataattcgcccccgcgtcacaaaaattggcatctgggtcgcccctaacacctaatggggagcagcgtccttccatatcgcccgcctgtggtgtccccccgctatgccccccgcgtttctttccaccacggagaacagagtcttcacccgggacgtgggcacgaagacccggcacccccgggacactgtcgggcgccctatattcttagtcgtgaatgggtcctttcccccctgcgctctcatcaggcgttacaatcctttgcccccccgtcatgacttgccccctaatagggtccagggggaggcgcccatacttcacacgcgtagcggctcgttaataaggcgaaagcgccctttctttataaagaaggatcacacccggatctcaggggcccgtgatgtccacgagctctatcggggcagcgtacacatcccccatgtcttattgctacccccaagggttgtcctcaaatatgagtgacaccagatccataggagccaccatctgggtccctaaaggggcacccccctacccccccccagccccaacaaacagac

SEQ ID NO: 626859 - DNA, 519 bp, Homo sapiens
ttccagggctcgctcatcatgcagcgggaacccctgcagcgagggctcgacccgctcgcggcgaaggcgccagccgcccttgcgcgtgctgtcgcacaggctgcccacgctgcggcggaagtcctcgcggctgctggccgatttgccatccttgtcatggaagaactccatgtcttcggtggtcatcgcggcggccttgtcggcgtcgcaggcctcgaagaccatggcgaatagttgggtatcggcctggcggatctgctcgcccaggtcatcaggcggcgcgggcgcggcaaccaggccggcggccagcaggggcagggtgagcagcagcatggcgaaactccaggggacggtgcgcgaaggctggcatgccggtgaccgcggcggtacggccctgcgacgaaaccgcctgggcgcggtgcgaaggccggccaggccggtgcggcttcgcgtggcggcatgtgcaggcgatgtcatgagggggcgtgattccctcacggctgccacagggcgcggccg

SEQ ID NO: 626860 - DNA, 138 bp, Homo sapiens
tcccctctcaagacagtttgcatggctctgttgattgtcactccttgtattagcttgtattttgatttagttttatatactggttattatgtatactgtgtacttatatatatgaaagcactaaatgcggacagaggt

SEQ ID NO: 626861 - DNA, 134 bp, Homo sapiens
ttagaagaaggaatgaaaaaaacccattttgaattttttcaaatttagacttctttttaactgaagttccaaattaaaaaattttaaataaataaccaaaaagcccaaagaaaggtttaaaaaaggaatttttt

SEQ ID NO: 626862 - DNA, 880 bp, Homo sapiens
  misc_feature (313)..(313): n is a, c, g, or t
agcgggccgttgacctcgggttctccccgggacagtcgaatccaagccaggtcctcagggcggtagctgtccgtgcgagtccgagcggagctgtgacctcgggcagctggaaggcctgtgggctgtggcttctccaggcaggcggcggaaggatgcaggcaggatgagcggcggatcccttcgaccgccagccggagaaccgcggcgtggtgcccttgaaggccactgggatgcctgggtagggtgggtgggtgaacgatgaagccctgagatgagtgagagtgtgatgggcgagagtcaccactcgcatgancattcaatattcaaggccaagtcagttactgtcgatggttttgaatacttgcacacagccgacctcacccgtcctgtcgaatgtctgacacatgttgatagcccatggaggacctgcgacgctgtcggtgaggtgcaatggcatggagatgggagcgtgtacaccacggagggagtgctcgcagaataagtcccggagatcggacacagcgctgagggcggcttgaagtttagcagacctccggaatgcctgcgacaccacgacccgtgcagatccaacgggattatccgagggaaggggacatcaggaggggcttgcaccgttgtcacggataacggatgacttgaacaacaaaggaggaaagattttgaattgaggtacatggtgataagttcattgtgatttccagaattctcagaacccatcaacatgagttcacacagaagtaaagccaaacccggaagagggaggcaggcacgcgcgccctacccgaaggcgcggccgaggcagggcatcaggcgcgaacagcatcacacgagggcccgggaggccgccacgagccagacg

SEQ ID NO: 626863 - DNA, 225 bp, Homo sapiens
cacgctttatacattcctcaacgctttatacttctcatttcattacccgggtatgaagtatcacgttgagaagtataaagcgttgaggaagtataacgcgttgaggagtataaagcgatgagaagtataaagcgttgcgaaagtataaagcgttgagaagaataaagcgtagagaaagtataaagcgtagagaacgtatacagcgtagagcagtatcccgcgtcg

SEQ ID NO: 626864 - DNA, 181 bp, Homo sapiens
cccccccccccctccccctttttaaatttttttgttttggggggggggttttttaaaaattttggggttgggtttggggttttttttcccccaacccccttccccctttaatttccccccgggttgcctcccggggggggtttaaatttggaaaaaaaaaaatttttgtttttttgtttta

SEQ ID NO: 626865 - DNA, 373 bp, Homo sapiens
actttcttgtctctagtccaggaggcagctggcgcggcggacacggctggtgaggagaagcatggcagtgaggtctgacctcctgggatagaccttagccctcataccccagcacaaggagagtacggccgttcccagaggaactccaagcgactcatgatggggatctacggaggacgaggggatcctctttgcttgggccgcccagcgtgccggccacgacccatccctgttgccctttggtctgtaatactccggtgaggtccctcagtggagaacacgtccaccacctccatggcccccgggctggcattgctgactactggagtgagccggcagcttgtcctccggctggtgatgaccttgtccactc

SEQ ID NO: 626866 - DNA, 348 bp, Homo sapiens
  misc_feature (44)..(44): n is a, c, g, or t
  misc_feature (47)..(47): n is a, c, g, or t
accctgggggttccccccccttttgtgcccccttaggactttgntgntggtattgcccttcccccagggttgggtttggccccaggacccccagtttcccctcccccccttgtgtcctgtggggggggggtccccccctgctttgttcaaaacccccggaactgatgggtttataactttttaatgtggggtttgttccccctttcctggttttcccctaattccccccccccccctttttttccccccccgttcccgttttttactgggctgggtagggttgccccgtttttggggggggtttggggcttttcctgggcttgtaaataaataaggtcctgcctttta

SEQ ID NO: 626867 - DNA, 280 bp, Homo sapiens
gtatgccggtctttttattggcttatgatttcggtgcgtgtaagactaagccgtgttcaggaggtgcgggcatttaattcacgattattcttctacgcggaaaatacgtgttaattgctctgtagtgaagagttttttcttttccgcattttgtcggagtgatttaccggcgcgtagggattctttggcattctttagccgcttcttgatacccgataatgggcgccattgctgtggcacggctaggctgagagatcactatctcgagacacgcgcgcct

SEQ ID NO: 626868 - DNA, 136 bp, Homo sapiens
  misc_feature (51)..(51): n is a, c, g, or t
gatatcgccgtctttgttggtcatctggaacttggacaagttaagccagcnttaagttgcagtgttgagttaggaccttctcgcacaagctaagtgccggcctgtgcaggtctctcttccttcccacagatttcag

SEQ ID NO: 626869 - DNA, 797 bp, Homo sapiens
aatcccacccctcaggcggacgaattaaagtgttcaacctgtcgacgatgtgtccgtcatgcactttgaccatggccagttggcaggccgagacaccacccatgcggttggccgtctcaaaatccaccgcgacgaaaccgctttcagcaatctgggtgggagaggggaccaacaaggaccgacaccgagtcctgcgggtcggtgctgagcctgcagtgttgcgtacaccctcatgttcccgcatctgtgcctcctcatgcgactggcgccacgatagttcccgcctgcgacaccgaggactcgtgcacatggtggtagcgcttagggggtagagagttacgcactcgaaggatgctcgctagccaacctgcttgcgtgcctcccgcctcaccatgattgcccctagcagaccgatcaacaggaacagcgacgacaatccgatcgaccacgctgctgcatgcgcgaaaccagtttcaaggctatggatgacggcgtcgcgggaatccccgagtggtcggatgaaaggggcatcagtagccgcattgcgaagccccggaatggccgatcccgccgagttttcggtggcgaaaacgagtttgttgagaaccttggcaggtgctccgctgaccgaggccacagcgtcaggaatagtgtggttcatggtcgatcccagtgccgaccggcgatggtggcaccgagagccgagcctagctgacgtaccgtcgactggggtggctgaacgcgcccggactggttagtgggaatgtcgtgcaacaccgtccgaggtgaagctgggc

SEQ ID NO: 626870 - DNA, 420 bp, Homo sapiens
  misc_feature (4)..(4): n is a, c, g, or t
  misc_feature (272)..(272): n is a, c, g, or t
  misc_feature (414)..(415): n is a, c, g, or t
ttcnatgtgaacaagccaaatcacaaatgtgttcctcctacctcaggaagtttaagcctcaagtattatggattaaacacgtgttccctacttgtgtgatatttccttatgacaacccacagaaaacatatggggctgggcacaagtggcttatgcctgtaatccccagaactttgggaggccaaggcgggtggatcacttgagcgcagtaatttgacaccagcctgggcagcatgtcgaaactgcgtctctacaaaaaataccaaaattanccaggtgtggcggcacatgcctgtaatcccagctcctcgagaggctgaggtgggaggattacctgagccggggaggtcaaggttgcggtgagccgtgatatgccactgcactcaagcctgggtgacagagtgagaccctgannaaaaa

SEQ ID NO: 626871 - DNA, 402 bp, Homo sapiens
atctagagatccccttggggctcattcaggacttttaaccggaagcgtctcagagacgggctcaggtatttctggagaagacggtacagggcttctcatcatacacaacccctccacagcccacggctccaacccacagcacctccggcagtccttttatgcttctggtttcttctccatcaataatatgtcagtcaacggctggtcagagacacttagctgcggacaggtcctcataacctgactcaggtaaacggccaagagatgcttgcactcgggggagatgatggcgtcgaatctgatgtcagagaacacagctttagatctggagggggttggggtccaatccggtctctgccagtggagatacacttagggcacatcagttacgagggtgggggt

SEQ ID NO: 626872 - DNA, 486 bp, Homo sapiens
aagttattttaaatattgactttttagcataacaggtaattgctcacaatatatattgaataacttttgaatattatgaaactatatactacatagtggttacttgaaagacatacggatgactaaagaggggaggtaacgtagcatactataaaagaagggatgcaggtggggcaatttcacaaagggaatcacagcatgagaactggacatgtttgttctattcagaaattgtatcttcagctaaggatatatcagaaatgctgccaaagcactgtcagtagtctttatgccatgcataacctggaacatccttttatccgagctaattggaatacttacatatgtgaagctaggtccacatgaaaggtatagcctgagagagacattcctttctaacaaatgacatcgtgtatttacagtaacagcagtcttaaccgtgatcaatgtataatagtcgcagtagatatgagctacccatgtcat

SEQ ID NO: 626873 - DNA, 506 bp, Homo sapiens
  misc_feature (113)..(113): n is a, c, g, or t
cccttagcacatttccttccctcccagtccttaaaaacccggggcccagcctcgttagagggcaccactttcagacacctatctctgcgggcaaagagcttcctctctctggnctctcttaaatctttcactcccaaccttcacctttggtggtttacactccctttattctctcttagagggtagaacaacaaaactcgggaaggtaatctcaagactacgaagagactggtaacatctgtggtgcactggctgagactatgacactgggttcctttggagttggactaaatatttaacatgagtgtaataatacagcttcccttttggacggtctaatttaacttaacagaaggtttggaatttttggtccttatggtagtacttttcaagattcccttattttaagggctgattgctatcccagtgatggtacgtgcccggttggctgaatctactcatccttaggggtacattggctcccaggtaacaggttggtgagtaat

SEQ ID NO: 626874 - DNA, 841 bp, Homo sapiens
gtcaggtcatcctcggccgcccctccggtccgcctccccctcccgcgctcgcggggctgcgcgggccgctgcccccgatgcgctacatatactcgaggtgcgccccacctgtccgcccgcacctgctggctcacctccgaggcacactctgctgcgcaccggagcctcggagctacagcccaggatacttagggacttgccggcgctcagaaacgcgcccagacggcccatccaccttaggtggcctagggtcgccgagagcgcccggagggaaccgcctggccttcggggaccaccaatttgtctggaaccaccctcccggcgtatcctactccctgtgaccgcgaggccatcgcttcactggaggggtcgatattgtagtgtaacgttggtgacaagcattgcattcacctggagccaaacgcctttatagtctcttagggtgaccggaacaacatccacctcaagttatacttacagttggggactgacaccccaaagtgtcgatcaggataactgtagggtctccaccgaccggcgccccacagatgataactgagggcggaaatggccaattcgggcctgcagatgctgggcatactcccaaggacctgcaggagacagggaggagtctggtggccatgcaacgaacatcccgcagtggcagatgagctcctatgcggggtgacaaacaagtaatcacgggcccaaggacatggtacaaaggggggctgtggcatggacctgcgtacacgcaagaagcacggggatgatgaagctgacacgggaccgactcggggcacgcccaggacagggcctgcagggcactcaacctcacggg

SEQ ID NO: 626875 - DNA, 124 bp, Homo sapiens
ccccccccccccccgggcccctggggggttgggttccccctttccttttgggtccgggcaaagggggggggctttttaggggggggggggttttttcctttaaaagaacccccggccccgttga

SEQ ID NO: 626876 - DNA, 624 bp, Homo sapiens
  misc_feature (346)..(346): n is a, c, g, or t
aagagatctttccaaagagagcaggacaaacaggacaataaactgcagctagagaatctaaatttagaaaaaactattattttgataggagcagatgaataggaagtagttgaggtagatttaaaaactgaggcattctcggccgggcacttggctcacgcctgtaatcccggcactttgggaggccgaggcgggcggatcacgaggtcaggagatcgagaccatcctggctaacacggtgaaaccccgtctctactaaaaatacaaaaaaattagccgggcaaggtggcgggtgcctgtagtcccagctactcgggaggctgaggcaggagaatggcatgaaccngggaggcagagcttgcagtgagccaagatcgtgccactgtactccagcctgggcaacagagcgagactcggtctcaaaaacaaacaaacaaaaaacaggcattctctgtatcagaaagttaaagttccccttttttggagtgacctaaaaagtttatgttggctgagcatgctcacgcctgtaatctgaacactttgagaggccgaggtgggaggatcacttgagtccaggagttagcttgaccagtctggtcaacatagcaagacccaggctctaca

SEQ ID NO: 626877 - DNA, 157 bp, Homo sapiens
ctcagcactcgcatgttcctgcctctgcatgtgacatggtgacgtctgcggtgctctccagcactccatgtcgccggctcttcatgtgacatggtggcatccggggttcctctccagcaatcgcatgtcgcctgcctcttccatgtgaactggtggc

SEQ ID NO: 626878 - DNA, 754 bp, Homo sapiens
ggagagacgtagagctgagcgacccagcccgcgagcgagatgccggtggccgtgggtccctagtggacagtcccaggccaagctgcttcgaccgtgtcaaaatgtcgcttcgtgatgggttgcgccgtgggcatggcggcgtgggcgctcttcggcaccttttcctgtctcaggatcggaatgcggggtcgagagctgatgggcggcatgggaaaaccatgatgcagagtggcggcacctttgcacattcatggccattgggatgggcatccgatgctaaccatggttgccaactacatctgtcccttcccattcaatcccagacccaagtggttaacaaaagaaagacagagaagatagaaaaataataactaaaagatcctttgtgtgggcgccgccttaggccccttgtgaaacattctttttacaagccaatcctgtgttggggcgacgggaggccccaatatgttaagatggaactttgggccccaacgggctgtgtgtcgcccttagggaaacccctcggggcgacttcgcgcttcacggcgtcgtggggctctggctcccacgtgggtttacatcatagcccgccggggggcgcggccacccccgggatcgtgttccttgggaaaaaatttctctccacgagtggggggtccccggggcggtcccttactcggggcggcctttatccccgcaggggaggttcaagggcggcgttctcagtatttcaattttgccccccgccccggtg

SEQ ID NO: 626879 - DNA, 293 bp, Homo sapiens
gaggctgaggtggcagatagtgagcgctggtggcggagttaatgtcaaacaggagagtaattatgaatacgacggattccaactagacgcgcgacgggtctcaatagggaatttcgagaagcagcgcctcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttact

SEQ ID NO: 626880 - DNA, 399 bp, Homo sapiens
tcacctatttaaatgaagagagagaagcaataaaataaacaaaaaaaaaaacactcttgtgatttattcctcactcgtatgctctggaaaaataacacatattagaaatggggcagagaggccaggcatggtggctcacacttgtaatcccagcactttgggagggcaaagctgggggatcatgaggccagaagactgagaccatcctggccaacatggtgaaaccctgtctctactaaaaacacaaaaattagccaggtgtggtggcacgtgcctgtagtctcagctactcgggaggctgaggcagaagaattgcttgaacccaggaggcagaggttgcagtgagccaagatcatgccacggcactccagcctgggcaacagagtaagactccatccc

SEQ ID NO: 626881 - DNA, 654 bp, Homo sapiens
aggcaacccataattcactttttggctttatgaaatggttaatctaaatattttacataagggagaacatacaatatttggctttttggatttgggccaatttgcttaacataatggtttcagggggcattcaaggtatagcataatttagaacttcggtcttttttacaggtaaataggattccatttgatggatatacaatttgctttttcattcatcaagtggtatacatttggggtggttctatcttttggctattatgaataaaggtggcatggatggtcatgtgctagggtatatggggacatatggttttaattctggtcagaagatacctaagaagtaaattgctgggccctatgttatttggagaaatattgatgtttttaaagtggcttcagcattttacattctacccacccatatttagaggtccatttttttcacattcttaacaaatcttggttggatggcttttggatctggcccccccagtgggcgggaaaaggctattaattttaaaattggcttttttggatggacaggggatgccgaaaatcttcttaaatgcccggtggccattttcacggggcctattagcccttaattgccatccccttgaagattcttgagacccctggcccatctatccg

SEQ ID NO: 626882 - DNA, 736 bp, Homo sapiens
gcagactctacgctctcccagctctcggacagcggtcagactctaagcgaggcatcagtggtgtggatgctggcgaggcagtagtgctcagcgtccccaggccgaggaaggcagctcggtcgtccaccaagagcaggagtagcagaggagctgcctcgtgaaacgagaggcccacagatggggccaagcataactcggctggatcttcgtgtggagcccacagtccactcatgcgtccggtgtgaacgaagaagtgcaggccagcaccatgtggcagtcgccgatcgaggggtggcgcgcatagcatgcgcgccagcccctgtcctaggattgtcgactattcagagaggcggctcagactcacaactgtgcggcagctcaaggtgggccacgtgattctggaagtgaatggtgctgacagcttcgtgggctaacggagcgaccgtggaggccgcccgtcggattatcgccgagtgccttcaatgactaatggaccgtgagtacattgactttctggtcactgagtttcaattgtgattgctctaggaggccacaggcctgagtggtcctcccaaccactgcgtcgagacctccgtggtcccagtccctttccgacctgttggcttcgatcaacgcttccttgcggggttggggctgcatggccagggtggccggaggacatgcccccgtccatgccaggccactggacagaactgggagaggaagagagcaggac

SEQ ID NO: 626883 - DNA, 784 bp, Homo sapiens
  misc_feature (34)..(34): n is a, c, g, or t
  misc_feature (62)..(62): n is a, c, g, or t
  misc_feature (79)..(79): n is a, c, g, or t
  misc_feature (93)..(93): n is a, c, g, or t
  misc_feature (95)..(95): n is a, c, g, or t
  misc_feature (108)..(108): n is a, c, g, or t
  misc_feature (115)..(116): n is a, c, g, or t
  misc_feature (124)..(124): n is a, c, g, or t
  misc_feature (126)..(126): n is a, c, g, or t
  misc_feature (129)..(129): n is a, c, g, or t
  misc_feature (131)..(131): n is a, c, g, or t
  misc_feature (143)..(143): n is a, c, g, or t
  misc_feature (148)..(148): n is a, c, g, or t
  misc_feature (158)..(158): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (203)..(203): n is a, c, g, or t
  misc_feature (207)..(207): n is a, c, g, or t
  misc_feature (294)..(294): n is a, c, g, or t
  misc_feature (463)..(463): n is a, c, g, or t
  misc_feature (503)..(503): n is a, c, g, or t
  misc_feature (679)..(679): n is a, c, g, or t
  misc_feature (765)..(765): n is a, c, g, or t
ttttcccaactgttttgactacagataaatagtnacaaccacttcatagaaattgtactgtntttcctaaattaacatncatatctgggtacncncaacatgtttgantattttnnttcctggncngcncntcccagcccacncctcncaccccagcnctngncgcngccgaggtgggtagatcacgaggtcaggagttcganaccngcctggccaacacggtgaaaccccatctctactaaaaataaaaaattagccaggcatggtggtgggcgcctataatcccagctactngggaggctgaggcaggagaatcgtttgaacccaggaggcagaggttgcagtgagccgagatcgcgccactgcactccagcctgggtgacagagcgagactccgtctccaaaaaaaaaaacaaaaaaaaaaaccacacatttaatccctaagcataaaagattaactggnggcaaactaagattgagccgtcaatctgaagtattttacncaataagggtaaccccctattgggctgtcactagcgtgtcacctcagccgagaccagcatgaaggtcaaaggcgaacacctctgtagacccacctcacctgcccctcccccatccagtcacctgtgcacgccggctagtccctcggcccctaaagacctaatcaagttggtgagtncagacccaacatcatcaggaaatctgtaaatttggagaaacttgttttcaaagcaaaaacccagatgaagaaaaaaaaattttttnggccaggcacgatggctca

SEQ ID NO: 626884 - DNA, 156 bp, Homo sapiens
aaggcaggcctttcctacagggggtgtagagaccagccttttttcctttggtaagaatggcctcagttggcgttgtgggcaggctcctggtttgtatgatgtattagtagagcaaccccttaatcttttgtagtttgtattaaacttgaactgaga

SEQ ID NO: 626885 - DNA, 80 bp, Homo sapiens
  misc_feature (71)..(71): n is a, c, g, or t
  misc_feature (75)..(75): n is a, c, g, or t
tacacaccttcgaggtgaccggccaggaaacggtcgcccagattaaggctcatgtagcctcacttgaaggnattncccgg

SEQ ID NO: 626886 - DNA, 127 bp, Homo sapiens
agcttagtcaggctcacaagacataatcacgtaactccatctcagcacaccctcatcgcggatcagacacgtcatcattacctctgccacagacacagtgtcccgcagctgaggcggtgacagcctt

SEQ ID NO: 626887 - DNA, 191 bp, Homo sapiens
ggggaaaaatatcacgccaatagacatgacagaaaagcaggagtcacaacactcatatcagacaaaatagactttaaaacaaaagacacaaagaaagataaagaaggacactatttaatgattaagggatccatccaaggagaggatgttactatcgtcaacatatatgccccaaatacaggccatgtgct

SEQ ID NO: 626888 - DNA, 864 bp, Homo sapiens
  misc_feature (864)..(864): n is a, c, g, or t
ctgcaggtcaagcaattctcctgcctcagctcctgggtagctgagactacaggcatgcacacacaagcagtaattttgtattagtagagatggggtttccccatgatggcaggctggtctcgaactcctgacctcaagtgatccacccgcctcagaaccaaagtgctggaattacaggcatgagccactgcgcctcgcctgaattctgttttaaaatcaagacaagtaagcgctggtggttagttgaagatctgtattttttaaagttcctgtgacttggttgacagttttacttgtgaccttaatatgtatatcagttaaacaagtacaagttaaacatattgaaagaacgtttatggaaagggaataattttagggtctttacatatatacaatacaagaaaaagtttctttagcaagtatctgcttccttatagagaatatcaaaatcacacttagtgacatgtgacagaattaattgtgatttagaaatttattcttatttccagacatgtgtattccctttcctcttaaagatactggattaaatacttataagtactgctactgttgtcattttcacttcgaataccaggctttaggaattcgttaggtgcctgggatgtattcgacggaactacatacgggtggaataatgaattgatattggtatagacagcaaattgtgtaaggataaaatctacaacgatttgatacccttgtactggtatatccgggaagattaaacatgggatatgagaagattaaaattaacagtgaaaatgagagagtacggaaaagacaacgtaagaacaggggtagagtagaaacaaaaaaacagaaaaaaataatagacttcattan

SEQ ID NO: 626889 - DNA, 394 bp, Homo sapiens
gaggagcactctggttggtgatggtgctgaaaggactgtgaccagccggtatccgtgggctgcggcacgctgacctggcattgagccgagcgcgagctgtcgtactgaatggtgttgaggtccacgtcgatgaaggggatgccggcgaacatcacgaccacgatggcgacgaacacccggttctcaatgcgtgcggccgagagcacgcccttattgccttcgtctgcaccctccccacgggccttgagccattcctgcgcgatgatcgccacgaagggcagtgcgaataccccgctggataccagtaccgcccagatgccgttgttgacgatccaggaaaccagggtcaggtagtactccaggtagtcggtcgcgaaaagcgtcatggctcgga

SEQ ID NO: 626890 - DNA, 706 bp, Homo sapiens
tctctgccgcatacgtgttttaagcgcgatctgcgagatcatggctagcatggcctacgataaggagcgtttgcccatgaccaagtcgtgccgtttgatcgaggtcattaagatcaaatccatgacggtgatctatctcttgtccatgcccattagtgaaatagactttatcgatgacttcgtgtgtccctttgtcacggataagcttaggatcagtatcccagtgctgacacattcccagtcaggccagggcaccagtttcagggcatttgttgctctcgctgactacaatgtccacgtggatactgggcgttaacagatccaaggagcatgacatcgtcatgcgttgaaccgatatgcatggcaggatatctagggtcacaatcgcagaatctactgtctaagcatgataatgcagtgtgacactatccctagtagggtgacgagacgctgcgattatgtgattgtacgcatcattgctgcagcaagtgcactagaatgctcatcgtacctttgcctaaggagctcgtgatgatgaatgctatagaagactggttcaactcagtccgcatctgcattgccactcttggtaaaattcgtcaaggtcagctttgatgccattgtctaacgactttaccctgattccaaatctctgacagtgttctaagttaccgttgccttatatgggctcacttgccccttgtcg

SEQ ID NO: 626891 - DNA, 760 bp, Homo sapiens
  misc_feature (205)..(205): n is a, c, g, or t
  misc_feature (210)..(210): n is a, c, g, or t
  misc_feature (237)..(237): n is a, c, g, or t
  misc_feature (253)..(253): n is a, c, g, or t
  misc_feature (271)..(271): n is a, c, g, or t
  misc_feature (279)..(279): n is a, c, g, or t
  misc_feature (284)..(285): n is a, c, g, or t
  misc_feature (291)..(291): n is a, c, g, or t
  misc_feature (295)..(295): n is a, c, g, or t
  misc_feature (318)..(318): n is a, c, g, or t
  misc_feature (320)..(320): n is a, c, g, or t
  misc_feature (325)..(325): n is a, c, g, or t
  misc_feature (329)..(332): n is a, c, g, or t
  misc_feature (335)..(335): n is a, c, g, or t
  misc_feature (354)..(354): n is a, c, g, or t
  misc_feature (363)..(364): n is a, c, g, or t
  misc_feature (366)..(366): n is a, c, g, or t
  misc_feature (371)..(371): n is a, c, g, or t
  misc_feature (374)..(374): n is a, c, g, or t
  misc_feature (415)..(415): n is a, c, g, or t
  misc_feature (418)..(418): n is a, c, g, or t
  misc_feature (434)..(435): n is a, c, g, or t
  misc_feature (437)..(437): n is a, c, g, or t
  misc_feature (547)..(547): n is a, c, g, or t
  misc_feature (676)..(676): n is a, c, g, or t
agataagaagtgatggtgataaaacatcaaaaagtgaatggaacaccttgattggggaagatatgcaaatactttgatctaagaattgaaatgtatcaaaaatttatattttgcctgcaggaaaattcaaaagctactcatcctctctataatttggagtcatcttactaatgaaaataatgttttcccatatattattaaaaancatanaatctaaataataaacagttgtaaaanaataaaggtaaaaatnataacactagggaaaaanttaaagcngatgnnaaagtnaaangcaaatgtaaacataagggaaangnactgncatnnnnttnagaaaaaaataataaaatncatcattanntngcctncancttatataaaagacaaaaaattccctaacaagagggcaaanaanagagataccaatttannantccacaagagaacaaaaagggttgatacgtcaggctaaaaaaagcagccatgcattttattatttaaacatttttctacccgacaagggcactgtggctagagtactgtnaatcctacccataaagtaaggtaaggtatttctttccacttgtaaaatcatagggggtttgctgtttttatgtgagttaagcctctttcccctttgtcttgagcattcctcagggggaggtcacctgtngaggttcccagaactgtagtttttttttaccagggtgttgtatttggagggggaggaggactcggctcaaaagagctagctggc

SEQ ID NO: 626892 - DNA, 124 bp, Homo sapiens
gtttggcgtgaggccaactgggaggacaagtcccaagaccagctttctcctgatgccgggactgtgtgctgggcagtccatgcctgcccaaggcctgaggcccacaaagttcccagagaaagag

SEQ ID NO: 626893 - DNA, 116 bp, Homo sapiens
gtctcggaatgtcctggaaatccacggatggcacttttcggaattacttaagaagtttattggcgaacagaatcacgtgtcatgggggcccacaggttgtctacgatggggtaccg

SEQ ID NO: 626894 - DNA, 402 bp, Homo sapiens
gaaatagagtctcactctgtcgccagtctgcagtacagtggcgccatctcagctcactgcaacctccgactccccggttcaagcgattctcctgcctgggaggcagagggtgcagtgagccgagattgcaccactgcattccagcctgggcgactgagcgggactctacctcaaaagaaagaaagagagagaaagagagagagagagagagagaaaggaaaagaaagagaaagaaagaaagagagagagagagagaaagaactccaagaacagtttttatattttattttcacattggaaatcagtcagatttgtttcagcctcaaagagcatgcttatgtaaaattaaatgactgctgggcgagctgcactttttccttccaaacaggaaaagcgttaaaa

SEQ ID NO: 626895 - DNA, 547 bp, Homo sapiens
  misc_feature (12)..(12): n is a, c, g, or t
  misc_feature (49)..(49): n is a, c, g, or t
  misc_feature (89)..(89): n is a, c, g, or t
  misc_feature (220)..(220): n is a, c, g, or t
  misc_feature (304)..(304): n is a, c, g, or t
  misc_feature (359)..(359): n is a, c, g, or t
  misc_feature (367)..(367): n is a, c, g, or t
  misc_feature (371)..(371): n is a, c, g, or t
taaggcccattngagtatttggtttccaattagggagatagtgggtatnaggattaggatggtggtgaagtatagtacggatgctactngtccaatgatggtaaaagggtagcttacgggtggtcctccgattcaggttagaatgaggaggtctgcggctaggagtcaataaagtgatgggcttagggggcgaaatattatgcttggttgttgggatatntggaggatggggattatggctaggatgaggatggatagtaatagggcaaggacgcctcctagtttggttagggacggatcgganaattggtgtaggcgaataggaaatatcattcgggcttgatgtggggaggggtgtnaaggggtnggcnagggtataatggtctggggtcgcctaggaggtctgggtgagaaatagggtttaatgttcattaaggagagaaaggaagcagaagttaagcccgaggggcgtcttggatgtggtgtagtaaggggtggcaagggtgattttatcggcaagtgggagggtgattcctaggggggtagg

SEQ ID NO: 626896 - DNA, 290 bp, Homo sapiens
  misc_feature (6)..(6): n is a, c, g, or t
  misc_feature (42)..(42): n is a, c, g, or t
  misc_feature (45)..(45): n is a, c, g, or t
  misc_feature (183)..(183): n is a, c, g, or t
  misc_feature (191)..(191): n is a, c, g, or t
  misc_feature (211)..(212): n is a, c, g, or t
gtgggngtccaaggcccccccccccccccaggggccggctgntcncaaggagggccccaaccccctgggtggccccccccccctaccccggtgcagaggccagcccccgagtcatatcagggtaaggccccggggaaggaatgccccccccgccccctcgggggccggccccccccccccccngggcccanggccatgggccccccccccnnccccccccataaaggtaaaggactgattgatatatttaagagttaataaatttgtgatttctgctgaaaaaaaaaaaa

SEQ ID NO: 626897 - DNA, 1236 bp, Homo sapiens
ggtggtggtcaccgagtgagctccctgaaccgtgtgcacgctcattctgttcagattcaggtcggtgtggatttcctgccatcatgtttccaccattactacctggtcgtttctattatcagtctgacctcactacgcagttgctatgatgcacttccctgtttcccgctatacactttatttacgactccgtgttgattgtgccttgatgactgtgtgtgggcgcgtagagttagtgttcggtggatactcttttcttggtatttcgtcgctagtatttctcctatggcgtactttgtggcgtgatgtgtgatagaagcctacattctcctttggtatattaggatggcagtatcttcatatagcgtttttctgttaatgtctcgttgtgtttagtccatttgagttatgtatcttctgcgtcttatttggttatgtcgtggtgttttttatgtgtttgttccgttcttatgtttctatgtttcctccttgtattgctgttatgtgttgctatgactatcggtcttttcttctggtgttcaacaattgtgtttgttttatgggttaattggcccttgattggttgtttgacctgttgttcttcatccttctgtcttttgttgcatgtcctcgtttttatcttgttaggtctgttcttggtttattgggctcaatctttcggttgttagtctctttggtggcggtgtcatgtcccatcgtattgcgctaggtctccttgttctatctgatcgctccctgggtgtgtttctatgtctattgtcggagctctaagcttccatacctgtttcatagtgtctcgtgtattgtattggggtggtcggtttctatagttttgtactatctgtggtctctagtgagtcttcccttggtgtccttctggcacataactacgtctatcttggtctcgtccgcttcctccgcggtctcccgagagtggtgcagcgcaccggttgtcactgcttgtgacgctgtcccagtggactccgtggaacttgcattctctttgttccttgttgctcttgtggtctgatatatttatgcatttttttttttttcctaggtaaactaaaacctgaaagctgagctaacaaaacatacatctttgtcagagaagaaaaataatgccttaagtataaataagcggagaaatggaaacatatcacttcaagggggatgctgtggaaacctggcttatttattgctaagccaccagca

SEQ ID NO: 626898 - DNA, 917 bp, Homo sapiens
  misc_feature (625)..(625): n is a, c, g, or t
  misc_feature (643)..(643): n is a, c, g, or t
  misc_feature (645)..(646): n is a, c, g, or t
  misc_feature (666)..(666): n is a, c, g, or t
  misc_feature (672)..(672): n is a, c, g, or t
  misc_feature (674)..(674): n is a, c, g, or t
agcctgagtgagctgctgctggagccctgagcctggagccctgagcccgaagaggagcctgccccggccccgcgcccccccgtgtgtagctcctgtggccctgtgtgcctgtgttcgggatgccccctgtgcagccaatgatggatgtgatgtgatgtgatgcctgtgtgacattggtctgatggtgtgaccctggtgtgtgactgtgctgccatctgagtgaccctggagcttgtgaagctatcaaatgctcgatgtcatgtggcagattggatgtgaaatgaagcttgagcaagctaacatgtgagctacatgaacgagtgtagcagaagcatgattgaatattgagtccacctccagtgcaattgcttggcccgtggttgatcaatgtccaatctgagtgacgaagatggagtgcttgatgccctgttccatctattgtttggcacatgtgtgacttattggttgccaacaggcaggaagagcttggaagctcactttcattggcttgtgtgttcaggttcaaccgtgttaccaatacttgtgttgacaaatttagtggccatcccaaagggtttgcgtatatagagttctcagacaaagagtcagtgaggacttccttggncttagatgagtccctatntnnaggaaggcaaatcaaggtgntcccanancgaaccaacagaccaggcatctgcacaacagaccggggttttcctcgagcccgattgcgcgcctggatcaccatatacaacagctaccgctagtgattgtacagtggttttattagcaggcgcaggggtcgggtttacaggggccgggttagagcgcatcatggtattccccttctaaaaaaagtgtgtgttaggagtagagaaagtgcccacacaggacaggagggataataagggaaggtt

SEQ ID NO: 626899 - DNA, 213 bp, Homo sapiens
  misc_feature (91)..(91): n is a, c, g, or t
ctgtaatgtcgggccgcgagtagcgtatgatggcgcagttgagggggctgcatatgcatcctaggctataaatattccggagtatacgtangcgtgtaatgttaacaaccggtacctctagaactatagctagcatgcgcaaatttaaagcgctgatatcgatcgcgcgcagattctgtcatgcatgctcattgcaacttggatccactatat

SEQ ID NO: 626900 - DNA, 331 bp, Homo sapiens
cagtgtatgacatgagcatctgcaggcgaccaaaactgaataatttctgtgtatggtatgagcgtaaagttgaggttcatttggatcactattgtgactattcagtcgtggtcgtaccatgccttggagcatagatagaaactatctttctcctttatgaaagtccgttagtatcctttaagatcagctggccttatgtattcacattatttatagacaatgactattgatttattcttttaaattcatacaccttttgtttcccaaattaaatttctttcatagatacagaacaacatagatcaaaaaaatcttgagtcatttttggtaa

SEQ ID NO: 626901 - DNA, 102 bp, Homo sapiens
gtacctagttatgccatgaatacatagggaataggtccagcagctcaggctccttcccatgggcttctcacaagggtgtgctatctctgggatggagcaggc

SEQ ID NO: 626902 - DNA, 256 bp, Homo sapiens
tcccgcttctctccctggcccaccgtcagttcccgtgcgttcctcagcttcccacactcgtccacagcacttgccattttccagggctggctgggcaggttatggggctggcagggcctggcagtttggggtcccccaggctgcagggtccatgttttgtgtcgtctgtctcctgccggcgccacaccagtggtccgtggtcatcctcacagggtgcttgcgctggcagcgtagcacaggagggcatcctcgtcag

SEQ ID NO: 626903 - DNA, 121 bp, Homo sapiens
agctagggcatatatactcttagaggcgaaagcctcatcatcactgcgcccgactcataaggggatgaccatggctaggtatataaatagttgggtggttggtgtaaatgagtgaggcaag

SEQ ID NO: 626904 - DNA, 154 bp, Homo sapiens
gcctcgatcatgtgcttgaattgtggcggttggttatttttcaacatattttgagcaattaccgaatggattgcgtacaatagtaatatgaaaaatattacgaaaatcgcaacccaaaagcaagcaggacgctatagtattgacttagacaacg

SEQ ID NO: 626905 - DNA, 451 bp, Homo sapiens
  misc_feature (403)..(403): n is a, c, g, or t
  misc_feature (449)..(449): n is a, c, g, or t
cttgcccgacaaatgggcaaaaaaatctgcgttttgtttatcgactgggaggcgcaattctcttgcaccattaactatgttcagtccctgcgcgagttgtacaccgatgtcatcgaagagttttactgggttgcgctcccgcttacgacgcaaaattccctttcacaataccaacccgaatggcagtgctgggaacctgatgtcgaatgggtacgtcaacctccccaagatgcgataaccgaccctgactttttctgcttttaccagccaggcatgaccttcggaacaaatttgtacgtgagttttgcccgaatgggttttcacaaaaaacggtccggcggcgaatgatgatcggcatccgtgcggatgaagtcctacaaccggttttgtcgccatcgccagntttaaataaacaaacggttttgccgacgataaaaccctgggactangg

SEQ ID NO: 626906 - DNA, 443 bp, Homo sapiens
acacataggattattgtgagaattaaatttgataagacatgtgaaatgcctggatttagtaagcgctgcatcctgcctggactcaaggctggatgccaaggggagaagatggtcaggcaagaccccctcagctcctcccaggcagtaccttggatcccgctcctgacaggagagccctttctaatgcctgtgagccatccaaatgattaagggtggtattacctagggctctgctagaggccctgcaaatttaggggtgagtttatgcagaatacagattaggaatggctcaagggaactgtatcccagagaagtgaattggacaggaaaaaggcaccttggggctcttattcatcaagcatacatagggtacttgtctactggatgttagtgctctgttactagttttactgaggagtctgcctgtatctacttccctacct

SEQ ID NO: 626907 - DNA, 162 bp, Homo sapiens
gcggctccagaggataaccactcggtaatagcaggcagccagaaacatcagtatcagcagcgtcgccaagcaaggagaatatgcagcgccagagccgaggagaacccccgacaccctgaggaggacctgtccaaaaacttcatacaaccacacacacacata

SEQ ID NO: 626908 - DNA, 878 bp, Homo sapiens
  misc_feature (496)..(496): n is a, c, g, or t
gccctccatcgtccaccgcaaatgcttctaaaccggactcaccagatgcgtagatttggctgcatgggtactggacgattagaatttttggccctgtggaaatgttgcacacacctaatgctagcctcagagacatgctggaataaggcttttcggaaaagaatctttgtcctttgaacagctgtgtattcttgatactcacgcagctggtcatttggtacacacacgttgtgagctaggatttggggaccccgtttgtattcggccacgttcacccttgggttcccccccttgttgagagttaatcacagccggtgtgtcaagcggcctttagatagttggtgtcccgggggagaatttacccttctcaagagcgcgcttgcgacaaaagaacaccccaaagtagtggatcgacgggtcctctaggcacggcggaccttcggacaaggggagttcggcacaacacaggtttcacaagaagtgccgcggttaaganacaccccccaataggttatcccatatatacatataaaggcgtatggacttgtatttcgttgtgtcgcgacccaaaaggaaaaaccacgccccgggttgggcgtcgttgggaacacactgttgtgccgtttgtaggcagtgtttgtgcaacaacacgagccggtattgctgatgccacaattttagtacacccggcacgccgtgggctcacacacgctttgcttatactattactacaggttggcttattaaacaaatatactaacgtcgcataacacacagcgcatacataatcgtagtccgtagctaccgccgcacaacaatttatccatccaaggaaacttctcgttgtaaagcacacccgacacgtacttgtgcaccaa

SEQ ID NO: 626909 - DNA, 163 bp, Homo sapiens
tggaaatttaatccagaggcctgttgctgccccaaaccctgggaaagtcacagaaaccccagacacggcgtcacagcattcctgaaccatcactgactgcaggtccagacacccacaggcaccgtcagaaaacccttctgagaccaccagagcagaaggtcga

SEQ ID NO: 626910 - DNA, 187 bp, Homo sapiens
tactcgtacgtgagagtgaaccaggactttatatagactgagctcctcagattgcttcagctgctctgcaagcttctcctccttgaactgtcgctcattcctcagcataaattttatgaggtctttacactcttcatacttgtatttcttctgtcggtaggccaggaagccggaagaagaaaatgat

SEQ ID NO: 626911 - DNA, 491 bp, Homo sapiens
gtcttgctctgtcacccaggctggagtgcagtggcgcgatctcagctcactgcaagctctgcctcctgggttcacgccattctcctgcctcagcctcccgagtaggtgggaccacaggcacccgccaccaggcctgctaatttttcgtatttttagtagagacggggtttcaccgtgttagccaggatggtctcgatctcctgaccttgtgatctgcctgccttggcgtcccaaagtgctgggattacaggtgtgagccaccacgcccggcctaatttttgtatttttagtagagatgagatttcactgtgttggccagactggtctcgaacccctgacctcaggtgatccacctgcctcggcctccaaagtgctgggattagaggtgtgagccaccacacctggcctataatttttaaaagtagaatcacctgaatgcctagcaatatggaaatggtaaaatattttatgtaaacattacaactttttta

SEQ ID NO: 626912 - DNA, 196 bp, Homo sapiens
cggcacgaggcattcctgtgcatctgattcacctggagagtttattaaaacatagatggctgagccccaatctcaaagattctgattcagtaggtttggatgggtcctgagaatcctcatttctaacaagttcccaggtggcactaatatgggtccccttaaagggatcacactttaaaaaaaacatttgcggccg

SEQ ID NO: 626913 - DNA, 192 bp, Homo sapiens
accagacaccccacctgaggctatccaggttttagtgctgctgctttcactgctgcacccggccctcgggccccccgagcagcctttgtactctgcttgcggagggctgggagacctcaggacattcccaccctcccccatgctgccaagttgtagctatagctagactcaaaaaaaaaccttgttttccag

SEQ ID NO: 626914 - DNA, 359 bp, Homo sapiens
acttgaatagggggtaaactaaggcaggagattgtcacaaaggatcaactgtacacttatacttcaccaggcaaccagatggatgatctgaaataataaatcaaggttgggcatggtggctcatacctgtaatcccaacacttatgggaagtcgaggcagaaggatcacttaagctcaggagtttgaggctggcctgagcaacacagttaatttttgtctctacaaaaataaaaactaattagccgggcttggtggtgcacacctgtggtcccaggtacttgggaggctgaggtgggagaatcacttgagcccaggaggttgaggctgcaacctgggcaatagagcaagaccccatctc

SEQ ID NO: 626915 - DNA, 204 bp, Homo sapiens
  misc_feature (14)..(14): n is a, c, g, or t
ttttttttgcccgnttttttttttgggccccccggttcccttgggggggggggggggcccggggtttttttttggttcttaactgggcttttggttcccaacccaaaaaaaagggggggggggggggggggttgttttttttgttcccgggggtggggggttttttttttttttggttttgaaataaacgggtctttgccccga

SEQ ID NO: 626916 - DNA, 110 bp, Homo sapiens
atcatggacaccagccgtgtagcctatcaagctggccagtgtcaccaaggtcctgggcaggaccggttctcaggcacagtgcacgcaggtgcgcgtggaattcatggacg

SEQ ID NO: 626917 - DNA, 450 bp, Homo sapiens
  misc_feature (97)..(98): n is a, c, g, or t
  misc_feature (103)..(103): n is a, c, g, or t
  misc_feature (291)..(291): n is a, c, g, or t
ccagagaagcagacttagctaaagttaaaaaaacactcgctctggaaatcattaatttcaaacaaccgcagtctcatgaaacagcactgcactgtgnngtggnctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaaggtgaggcacacacctgagcagagtgccagantcagcactgagcagccagctgctcttaacactgcttctctctctccgatttttctgaagaaactaattttataaaggactattagttcgtacttaaattcatggattctcctataaagctgatttagatcttgtttctaataaaaataattacccgtga

SEQ ID NO: 626918 - DNA, 483 bp, Homo sapiens
  misc_feature (7)..(7): n is a, c, g, or t
ttctttngggagggagagagttgaggcaggatgggtgagggtagggcagagggggcacagataggccgtgtggtgaaatcctcccgtggcccggacctgaaactgagttgtgatgctgatgctgagctgattcgcccgtgtgtcgaatgcaccaacggccaccgttctacagaaaggcagagtatggtttccctcctggttgtaacctggtggagagctttcccttatcagattggcagctaaacagttgtattagataatcttcaaatctgacatccagcctgttatgcttgctctagggctcgctgcttggcctgcatctcccttctcctgtgtattcatttccctcctaaggtgtgctcctaaatgaaggtttctatgtacgcggatgatgatttacctgtcaataccagcactgtattactaacatgcaaaatactgcagatttattttgacaaattaaagttaaccagtcacaactgt

SEQ ID NO: 626919 - DNA, 125 bp, Homo sapiens
cttagtccacttcttcgatggcgggtcccccggaggctcctgaaccggcgccgccgctgccgccgccaggaccaccttggtaaagtttcgctgatgatggggttgcaaactctttctagctgctc

SEQ ID NO: 626920 - DNA, 917 bp, Homo sapiens
gtttgtttggcagacgccactgccgaggaaaaccgtgtactattagccatggtacaacccgcaccgtgttcttcgacatttgccgtcgatcggcgagcccttgtggccaggtctcctttgagtctggtttgcagcacaagtgtcccgaaagaccagctagcaaaatttgcggtgctcctgagcactggcgagcagcaaaggcattgggtctcataagggtatcctgcgtttcaacgagcaatctattccgaggggttctatgtgtacagggatggtgaccttcatagcgccatacatgtgcactgtgtgcgcacagtcccatcatatgggcgagaacatttgcacagatgcagaaccttcatctaagcatacggtctgcatcttgtcatgcaatgctggcccagacaaatggtcccagttttcatctgcatggcaagactggtggtggatggcacgcctgtgttgttgcaaagtgaagcaggcatgaatatctggaggcatggacgctggggtcaggaatgcaagccagcaagagtcacatgctgactgtggacaactcgatagttgctgtgttatcttaacaccagatatccttctgtagctcaggaagcacccttcaacccattgtgttccgagtatccaagaatctttgtgctctcggtgaagaccctttgggttcagtatgccttggtcctccatgcctaagtggatgggagagacagttatggttatagaccacagcaacacaacacaaaaagtgtggcgcgcgccagaaactataaacccttgggccggccgaaagcaacagtgccacgtcaagaacaggcgacaggtggtaccaaaaacgcgggagcgttaaacccggttggggagggtaaagcgcgacacccgcgcgaaagaacgccacgaaagccaga

SEQ ID NO: 626921 - DNA, 1098 bp, Homo sapiens
  misc_feature (320)..(320): n is a, c, g, or t
ggactcggcgtggattggcgagtcccggacggtaatgtcatgtattgttgggccgggttctgcgggcgcttggcttctcttgtgactttgtcctcttctatggtcctacgatgctcgcatgtagcagaggctgggaggcagttcatgcctgtcgctgccgtagaagcctttgatcgtcgctgcatcgctattgacaggctctgtgtggttgtcaggtattggcattctgtatgggaacattgtgtgttagatgtaaccagatgatttagttatgtatgaggtgtgataccctatcagatgcaatggctcgaaggattgtncaatgaagatgtgacgaacatttcaccaggtcgaatgtatatgcgaacttatggtgaggcaaaggaagtaccgcatatgttacgcatggaaagagtagagtgacatgggttttgagaatggaagacctttagtacgatgtaatctttagggaaggtgaagaatagtcttttggagcttaagagtagaacgtgtacggggagtcacgagaagatacttttattgttaaacttaacagttgcggcgtagttctacatgcaaaacgctttacgacgggtgcactttgtgatccgttacctttcatataccttgtccctagtgtaacctttttacggacgaagcctcacggtgaactgcacacccttgggttttgcaacgcctagaacaacggcccatatgagtctaaaccatcatggcgcaacacgttcggagaccacatcgacaacttgccattccgtggtccttttaaggaaactgtggggaataatttcaacttttggatggttcgagggttaagaaacagggttaatttgtggtattacatcttgtgcgccgggaatatgtggtatgtcatgttacctcttcggcacaactgtggaggcattattcccgcggcacgttaaacccaatttgtgtggttaaatatttaaggttcccagttcgcttttctttgtacacactggaccatcttcacattggtgacccatgaggggtcagaatccatggttatcctgtggaagcattacaccggtttgcacgggtggtgaccgccaggaatat

SEQ ID NO: 626922 - DNA, 243 bp, Homo sapiens
gccgaggtcgcacgcgtgagacttctccgccgcagacgccgccgcgatgcgctacgtcgcctcctacctgctggtctgccctagggggaaattttctccccaggcgacaagggatatcagggaggattttggcacagcgtggtatatcgagcgcggacgacgaccggtctcaacagggtatatgagtgatgctgtatgagaaacacataggaggcgtcatctcccagttttgagcatgttcta

SEQ ID NO: 626923 - DNA, 314 bp, Homo sapiens
tgcacctcccgccggggcccgggccaacggaaacttctggtggcccatcccccgggacgccaaccgagttagccctgccccgcccggtcctgcaaaggttgacggagcaaccgcaaccgagggccccggcacgccttgccgggacccaatccctggggagaacccccagcccacaaaaaataggggcgaaatttccgtgatccccggcgggctccgggtttccccaacggcccgggcatccctatccctttttgcctgatttgggtgaagacccaccgtccccagtaggggcctaataaatactgactgggtga

SEQ ID NO: 626924 - DNA, 378 bp, Homo sapiens
tgcttatacctccgtaaaacagacgaggctaccttagaaacagtcttaatacgtagcacactcgtctatgttgcataatagtgggaagatttataggtacgaggcgacatacctaccgagcctggtgatatctgtttgtccagcataaaatctatagttcaccgttcacatttgcccacagcaaccctcttaagtcccttctctgtatttaattgttatccaccgtaaagggaacagctcttgtggacacgtaaggaaagaaacctagtgaagagaggttaaaaaatctaacacccatagttggccttatccgagctcgatgagggccaatcatcggtatccccaccggagtcaaagtatttagctgactcgccagac

SEQ ID NO: 626925 - DNA, 124 bp, Homo sapiens
caaaactggagaaaatttatgaaacgagtcatgcctttgatacggtattgcatttccaagagccaccaatccatttggtggatgattctgtgtctgtggcttaataatcatagtaacaacaata

SEQ ID NO: 626926 - DNA, 1015 bp, Homo sapiens
ttcgaggtgcggcaactgctccgagtcctcccctgcaaccacgagttccatgccaagtgtgttgacaagtggttgaaggccaaccggacctgtcccatttgccgggcggatgcctccgaggtgcccagggaggccgagtgaggctccacagccacccacgagatccctgcccaaagctccggaattgggtgggggggagcagggcgtggcccggggaggactgtgagggcggggccaggcctgtcagcgttcccacctgccactccagagctggtgccagggtcagtctggagaagcccctgcaataagcccctgcattgccaagctccaaagactccttccccagtctgcctgcctgcctgcctgcccgccacggagctgcctgagtttccccaactcagtctgcttcttatctgcccctgggtccttcttcctgctggctctgggaggcaggagtccattccccaagtgtggtggctggtgtgatttccccagaccccagacggacaaaggaatagccaccctgggtcaactggtctcctgtactgaaatgacgtgtccttccctgccctagtggggttgccaggtgtgtgggcaggagtagccagagaccatttcctgagttctcctgtatggttccagacagacataggcagtcagctctgctccaatgctgtgtggtgtgggtctgactccccaggaacctttacgccagggaaagcgtcaagccaccccaaggctggaagaagtatccaagccaggtccatgagcaaatgggccaggaccaagctggatcctctgcgttacttgcaaatatccctcaaacgaatctggggccatggtcccaggagtcccgggcgtgactggaccctcccacaaggataccgagtccaaccccgtgcatggaaactcacaccctggaactatcgcgcagatgtcaacgaacacacctgactagggaacgaacatcgtcgccacaaaggtcgtaaacgcgtatcacaactcaacagcgcgt

SEQ ID NO: 626927 - DNA, 226 bp, Homo sapiens
tgcataattaggatatatggcagggctaaatatttcaaattgcgattgatagggtgaatgttggaaatactggatcagcagattatctttgcctataacaaatgcattagcctacctgctagaagaggagtagttaactaggaaaataactattagaaggaaatattatgtgtgaatagcaacaagcatagctatagatgccaatattaactgagcacttactttg

SEQ ID NO: 626928 - DNA, 121 bp, Homo sapiens
cacaaacaggaataacggcttcgaaaagaacattgttcttgcaagcttgtatctgataacagcactgcgcttgtacaacttgtatgctgattttgacctatgtattgaagttaactgtatc

SEQ ID NO: 626929 - DNA, 183 bp, Homo sapiens
ggtcaccgagaagggcccgaggggagaggagcgcgtgaagcaaaaggacctgctggatggcgagtatggctacgagtattaccccatggcccctggaacctatatcgtcaccatcacgtgtggcgttcagaacatcgctcgcagtcccttcgaagagaaggctggcaccgagtgtggcaatca

SEQ ID NO: 626930 - DNA, 335 bp, Homo sapiens
cttgatgatgactttgaagaaacatatttctctttaagaaaatggccattaaggccgggtggggtggcacatgcctgtaatcccagcactttgggaggccaaggctggtggatcacctgaggtcaggagttcgagaccagcctggccagcacggtgaaaccccgcctctactaaaaatacaaaaaatagccgggtgtggtggtgggcacctgtgatcccagcttcctgggaggctgaggcaggagaatcgcttgaatctgggaggcggaggttgcagtgagccgggatcgcgccattgctgtccagcctgggtgacagagcaagactgcgtttca

SEQ ID NO: 626931 - DNA, 470 bp, Homo sapiens
aaagtgcaaaaagtgtactacattgaaaataaagctgaacatctttctgattttgaaacaacatttgaattacaacctcttgaacgtggttttgctaacacattaggaaattcgctaagaagaacaattctatcatctgttccttcagtagcggtttttggtgttaaaattgagggtgtagaacacgaattttcagtaatagataaagttcgtgaagatgttgttacaattttaaataatcttaaaaaattacgttttagcttcaaaaaagaagtatttttacaaaatgaaattcaagtagcttcctttgatggaagaaaagttggaaaaattacaggagctgatattttagtaaattcagcacttgaaattgttaacaaagaccaagtcgttgcaaatacttccgaagttggagctttaaaatttgaaatgtttttaacttatggtcgtggttttgttgattttgaaac

SEQ ID NO: 626932 - DNA, 103 bp, Homo sapiens
gtcgctggcacagtcagttctctccgtggctagtgtcgaggcgacagtccggcacagtccttccgctgggcacagtccttccgcgggcacagtccttccgctg

SEQ ID NO: 626933 - DNA, 1408 bp, Homo sapiens
  misc_feature (412)..(412): n is a, c, g, or t
ggtgaggagccgttggtctcccagtcccgccgcgatgagcctcgtgccgtctttgcgcgcctactgaaagccgggcgctgctctgtgtgggctctggcctgcgcctggggctggtcctgggatccattgtcgctgtcggtcccgggacgcactgtgcgcttgtgcgcgctcctatgcatctgacgttatcgcgccagaggcactactcagtacaggaggcgaacaatggttgtaagcgctgtcatcatagttactcgaggtcctttcagtagtggcactcggtcaaccaagactgttgtggccttcgccaagttgcagtgcccaagtatcgctgtaacgctatatacataaacacctctaggcttgcgttgctcaagcttggtcaactgactcccgtactaagggcatagtngcttgtgggctattaggcggggcattgccgtgtggcacatttccctcggctggtatagcccaagctttgcggaggcacaagctacgggaaagtcccgacgtggggacgctgacatctgcaaacgtacgattgcagaacgaaggtttcccgctccagccgaaggacatacccaagcgggatcgacacaattttcagaggtagttgctatcagggccaaatcgattcgtttgcggtttagacatcgaggcggcacctgagcggctcgcaacccactgcaatggttgtgcaatacagttggaactttggcacaaggtaatcccaataagactctaaaaggggtgcacaccatgggcgcaaattctcgctggggtgggaaagaattgcacaaactcagaaaagttgtcgtgcacactctttccaaccccataaagtgttcgccgtccaaatctggaaccaaatgaaacacaggtggcttggccggattgcggataggagaggcggctttaacgtggaacggcgccgagttggtgcactggaatgggtcccgccttggcggtttggacttcggaacgaacagggggaacacctttggccctcgagagcttaaagttgttcctgaagggccttacccaactaaatggttgcttgtttggggcccaccccgcccctccgaaggaccgctcttgtcgccccaatgggactcctttgtgggaaggcccttactcccagacgattgcatctgtccatatggagaccgttggccttcgacccttgagagaaaaagcccttgggcttggggttggtgtgtggccaaagaaacgcccgaagaggaaattccccaaggcgagtgggaaaccccccccggaccggctgcagagggcacagagtggttcccgccattgggcgggccttgcctgtgaggggctttgagggtttcgggagtgcaccccaccatagccccgtgtggcgtaaaccttttgttgtgtggcaaattac

SEQ ID NO: 626934 - DNA, 323 bp, Homo sapiens
  misc_feature (46)..(46): n is a, c, g, or t
  misc_feature (127)..(127): n is a, c, g, or t
  misc_feature (164)..(164): n is a, c, g, or t
  misc_feature (231)..(231): n is a, c, g, or t
  misc_feature (269)..(269): n is a, c, g, or t
  misc_feature (283)..(283): n is a, c, g, or t
gctcactgcaccctccgtctctcgggttcaagcaattgtctgcctnagcctcccgagtagctgggattacaggtgcgcactaccacgccaagctaatttttgtattttttagtagagatggggtttnaccatcttggccaggctggtcttgaattcctgacctnaggtgatccacccaccttggcctcccaaagtgctagtattatgggcgtgaaccaccatgcccagccngcttttgaggggctgacttcaatccatgtaggaaagtnaaatggaaggttgngtgcatttctaggacttttctaacatatgtctattatgtg

SEQ ID NO: 626935 - DNA, 124 bp, Homo sapiens
cgtatcagacaccagacacgcagagcgcttcacaggtgcgtatcagacaccaggatagcagagagcttcacacggtgcgtatcagacaccagcacgcagagtgcttcacacggtgcgtatcaga

SEQ ID NO: 626936 - DNA, 185 bp, Homo sapiens
ggtggggcgtgaggcaacttctcctagtaatctcaatctcagctcgatgccgccaagagcgatgcccagagacagagcgatgagcttgccctggtcaggcagcagttgagtgaaatgaggagccacgttgaggatggtgtcttatctgtggcccctgtttcctccccagaggcgccccctgccga

SEQ ID NO: 626937 - DNA, 321 bp, Homo sapiens
agcccgtctatttgccgtttttttctctctagcgttcagcataacaaacgtgtgacctcactggaggctcacatgagttgggaggctcttgtgggtgcatagctttaacaaacctcctgctccttgtgggaccgtctttggtaggacattcaacttcaggagtttagaatgactgtggaatcaggaacacaagcctctggattgtcctaacacaatggtgaaaggagtttggcgattattcctagatctcggacctttctggagacataacaagccatgggttattcttcatgtcctattacttgaggctgtgtgctgtcc

SEQ ID NO: 626938 - DNA, 261 bp, Homo sapiens
caggaaggaaatttggggccttaatgggaaaggccatagtgtgaaaatgttttataaattgagtgcaatacgacatggagtatgatgaatggccctcccctgcttcctaaaatccaaccctttttttgatacctccctttcatttttttttgcctgggtttcaatttcattttttaattacctcattgtccttcccccttttttttttctttttgtccagcctgggacctaatagcaaatataaacatgatttttctggga

SEQ ID NO: 626939 - DNA, 927 bp, Homo sapiens
  misc_feature (3)..(3): n is a, c, g, or t
ccntgtccttttgtggggtggctatcgtgtggggtctgcgaccactagtctgcttgacaacttcgtccgagtgttccatttggtgcccgtctccggtctacggaccggctggtcgacctatcagctgcccgtggtctgtccccgatctcctcccgggggcgcattagccccaccagagtctggagggaaactggttttcctggcgccaatttcctttctccttgtcggcatggcgtttgcacctctgggttgtaccctgcctctttgctctataatctctagcgttggctccctgtcccacacctgatgccttaaggttttaacggtaaatcctaacctctcgctattgtccccggtagggagtccaaaactagagcgtgtgtgacaacactaggcgcaactctcatagtgaccgtctttatacaggggttaaaccatgtccttggccccatcatatctagtcacgagtaataactcgcttcccggggatggaaaccctcacatatgggcactaatgttcaatccttttaccacacaggctgtacattattccgcccccacaacgtctgggtaaatttataaaagtcaaggctgcggacaagagaccgaccgcgtaacaccacggtctattccagcacaccccggacccgcggcgccctacaagtcccccggatccacggcctccgcggacccctcctgcgcgcaacacaccccgagtgcccgcgcgtacacggcaaatccaacaccacgcccgggcgaatatggcaccagacccgtaagggacccgccgccgctcggcaggcacccgagagacaccacgccgttagatccccccaggaggcgccaaaaggtcatgctcaggccgccacgacccaccaccccccaaaccctttggggcaaaaaaaacaccccacccccaacaaaaca

SEQ ID NO: 626940 - DNA, 219 bp, Homo sapiens
cagtgcctagctgagatttccgcctccccgcccgccccgccatatgctggagtacagtggcgcaatctcgactcactgcaacctctaccttccgggttcaagtgattctcatgcctcaggtgcctgccaccagcctaatttttgtatttttagtagagatggggttttgccgtgttggccaggctggtctcaaactcctggcttcaggtgatccgcctg

SEQ ID NO: 626941 - DNA, 134 bp, Homo sapiens
catcccccacccccatcctgctaccccgagtccgtgaaaaattgtcttccgtgaaaccggtccctggtaccagaaaggttggggaccactggcttaaaataccaataaatttttgaaccttaaaaacttaaaaa

SEQ ID NO: 626942 - DNA, 1179 bp, Homo sapiens
  misc_feature (146)..(146): n is a, c, g, or t
  misc_feature (150)..(150): n is a, c, g, or t
  misc_feature (158)..(158): n is a, c, g, or t
tgagtttaaaatccactttattaaaatgcttagcagaatatcaggttcccaggaatcacagttcatcttgatcagggagaaacagccatgggggtttgatcatccaattcaggggtaagagcttggtgtgcctgttgtcacagcantggnaaatctangcattgagggagggtggggctgctgggacggtcagtgcttgcagctcacagattctggggttctggttaatgagttccagtccacagtagagctttttcttgcagactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatgatatttaaaaagcttttcttcataaatggaaattcaccatcttgttacctagaaagcaggatacaaaattacatgacacatagtaatctctaaggtgcaaaacacacgtggaaaaaagacagaagggaaatatgctgaaacgttgccaggagttttctctgaatggttgtaattgtcattttattctgttactttttgttattttctataattgatagaattttttatcagaaaaaagtaaacatttaaaattagccaggcatggtggtgtgcgcctgtaatcccagctactctggaggctgagacagaattgcttgaacccgggaggcagagatagcagtgaactgagatcacaccactgtactccagcctgagtgacaaagtgagactctgtctcaaaaaaaaaa

SEQ ID NO: 626943 - DNA, 343 bp, Homo sapiens
gcctaattattatttgtgagacaggtctgctgtgtcacccaggtaggagtgcagtggtgtgatcacggctcactgcagcttcaacctcccaggctcaagccagtcctcccaccttggcctcccaagtaacttggactacaggcatgtgccacaacacctagctaattaaacaattttttttttttttggtagagatggggtctcaactttgtggtgcaggctgatcttgaactccggggctcaagtgatcctcctgcttctgccttgcaaaatgttgagattacaggcatgagccaccatgcccagactatattaactccttaaaggtgggtcagaacataag

SEQ ID NO: 626944 - DNA, 623 bp, Homo sapiens
  misc_feature (300)..(301): n is a, c, g, or t
gggagaagggcgagatcctcgctccaaccgtggcctgtgttctctccttttgtccccatagtgtgactccgccaggaacttggaatggctgaagactgtgaatgagagtcatgggtctgtggaacgctcatccctgaccctggccacggccatcaaccaaagaggcatctatgtgatccaggcacccaaaggtggccaaaagatttccccagacacggttctgcacttgatccttcctgagagccctggcagccacgaggagtcacgagagtactctttagaggaggtgaggagcttttnnacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcccatggcctactgctcccccaagcagagtgtgtccctccaaatggactttggcttggacctggtgacggagcttaaagaaggtggagatgtcactgagctgctggcagccctctgcaggcagatggagcacttccctgacagctggaagagatttcgtacccagcccacggcataa

SEQ ID NO: 626945 - DNA, 320 bp, Homo sapiens
ctgtgactaccagggatctgtatatctggcccgtctgtgactacccacttggttcttaaatactagatgttgccaaataagtgatgctacttttactaggtgtggttaggaggcacagcatccaaagcaaggacatgagattgtaatacaaggaaggtgatgacttgctccattgtctgtggctttcttatgttgtaatgggagcttatcagtgtgcaccatgatcaggttacagcatcaggaggagctctacaacctattttagattcacagttaatattgtctgcttttttctttgttcttgtcattttcttttctct

SEQ ID NO: 626946 - DNA, 364 bp, Homo sapiens
agatactttgatgtgaagactgtatatatttaagataggtataggataatgtgtaatatggtgaccttacagcaaatatttgccaagcatactttttatactgtgcttgtggaggactgattaggtcgagggaatcattgtatgcattatatccttattctatgactggattatgaccatgtatgaggctatgatttttctaatgggatgactattagtgaaagtcaggttgccatgactcatcataggctttctaacctactccttgaatgcgactactcattgcgaaatgcatgccatacgtttgatacgtaactgtgtgatcaacagctaactctagtcgtgatgtggatcagacttttgg

SEQ ID NO: 626947 - DNA, 321 bp, Homo sapiens
  misc_feature (2)..(2): n is a, c, g, or t
anaattacacagtctcatcactgtcatcatcatcaccatcacatcacaccatcagcataccatcacacatatcacacgttgtcatcacacaacagaattgtggtcactgtcatcgtcattcatggctaggagtccagtgctcccctttctttctgagactggtgctctggggattctagaaagcccggctggggcgtaggagaacgaaggcacctttcttctcatgccctctatactttgggaaagggtcccagaagccttctcctttttgacccacggtgccgttggccaacacggtgcggttggccacggggattccct

SEQ ID NO: 626948 - DNA, 424 bp, Homo sapiens
tcaaagacgtggtgtttgatatgggatgaaaaacaccacttaaaggaggcatttgcttatcagcgacaataagcaaaagcttgaagggtatgttattctctcaatactacttctccacttcgcaggcatatctattcaggagggcatcttgaaagaggagcagggtcacccacgacttcttatatctcctgcagtgcactggccaagtgtgtgtgtattgatatgcttgaagcccctagggttctcaacatgccaaatcacaaaggggttcaatttgtggcctgcaacattgcccccaagcaagactgtcatccagtccctaaaagacttgaagcctggcattgctttggtctacctcatggatcaaagtcctttcaggcatctgtttccagaatagaaaggtttcatccatattgaaaatttg

SEQ ID NO: 626949 - DNA, 241 bp, Homo sapiens
  misc_feature (11)..(11): n is a, c, g, or t
gtctttcatantttattctattttataaataaaatccttttagtaatccagtgccgttgtcgtttctgaaaactacagtattctcagaagcttgtagcagcagtaaaaaaaaaaaatttgtcctataattaattggggcaaattatacctgattttgttaaaccaattttgttaagtttactgctttcttaattattacactttcttaaaaagagctgaattttatacctcattgttcctt

SEQ ID NO: 626950 - DNA, 223 bp, Homo sapiens
attcgcggccgcgtcgacaccagatctggggctctatggcgccgggtctggacaagcatgaaaaacgcatcgccgtgccggtggtggtgtcgagcatgctgctgtcctacaccgggatgggcttagcctacttcctggggctcccgctgatcctcaagttcttcggcggcgctacaccggccggggtggagatgaagaccgccatcactaaatctgggtaact

SEQ ID NO: 626951 - DNA, 438 bp, Homo sapiens
tatatttactgcgttgtttactgatgatgtcttgacccattattgataagagagcgatcctctaccatgttggtatgacaagtatgcatataccgcgtatgtaagttagtggtaaaacatgattactgactcgtagatacactgtgtagttaacccctctgaatattctgggttatggtttctttttcattcattcgatgatttttttattgagcatctaccatgtaccatgcattggtctgggcatttggaatacatcaagtgaattaaacaaacaaatgccattgaactcctaaaactcaatcagtggcaggtggccagagaagctagtctttgggaaaaacaatgggagaaaaagctaaggagaaacttctcaattgacacggtattaatcaaagtaaaagctggaaagatgtatattgataggttgggtttgac

SEQ ID NO: 626952 - DNA, 140 bp, Homo sapiens
taggctactctaaggatccggaggttgagtccgacattggcgaggctaggagcgtagggagctggcgctcaaggattctcgtgccaagcaggaggagctggaagccggcctgcagcgggccaagcaggatattggcacgg

SEQ ID NO: 626953 - DNA, 422 bp, Homo sapiens
  misc_feature (55)..(56): n is a, c, g, or t
  misc_feature (60)..(60): n is a, c, g, or t
  misc_feature (121)..(121): n is a, c, g, or t
  misc_feature (138)..(139): n is a, c, g, or t
  misc_feature (142)..(142): n is a, c, g, or t
  misc_feature (180)..(180): n is a, c, g, or t
  misc_feature (186)..(186): n is a, c, g, or t
  misc_feature (260)..(260): n is a, c, g, or t
  misc_feature (272)..(272): n is a, c, g, or t
  misc_feature (315)..(316): n is a, c, g, or t
  misc_feature (328)..(328): n is a, c, g, or t
  misc_feature (360)..(360): n is a, c, g, or t
  misc_feature (369)..(369): n is a, c, g, or t
  misc_feature (382)..(382): n is a, c, g, or t
  misc_feature (388)..(388): n is a, c, g, or t
  misc_feature (392)..(392): n is a, c, g, or t
  misc_feature (402)..(402): n is a, c, g, or t
  misc_feature (405)..(405): n is a, c, g, or t
  misc_feature (410)..(410): n is a, c, g, or t
gcttcccaaagtgctggaatcacagcatgagccaagtgcctggtcttagctgtgnntttnattatgccatgcatcaacataacaccgggccatcttcctatcccttcctatcccatatgtntaatgaaaacatatttnntgngttaaattaggttaatttaccagagatttagcttagtntttttnaactatagaacaatacccctatagaacaatgtacagctgcacccaaggttaaaaagaggtagcagggaaaacanacttaaactctntgtatatggtgaacccatccctctcctgcctctaatggtatgnnacattatttcgntattatacaatgtagtggtataaacagtattnttaactganggcataagttagnggatgntatntttctcgtgnctnatgtngctcttccactt

SEQ ID NO: 626954 - DNA, 218 bp, Homo sapiens
atgtaacaactatagctactatgtataaatgtactctcacctaaagcctaacatgattcattttttttttccaggaaacagaaaatgtcttgggtctgggtattaactatcagaaggaatttaacgtttaagaactgatccccaataaggcatggtcccttacacagtttcatggaccaatatttaggttatatgaaaagtggttacatatttagggg

SEQ ID NO: 626955 - DNA, 231 bp, Homo sapiens
ccccgcgtcaccactagtaaggcctacagctctgcagaggaggaggaggagagagggagaaggaggagaagagtagactacagcaagctggagttagcaggcagaatccaaaggaatattattgaaagaaaaccaggggacttttgggaaaccagagaattgttcttttcctgttggaaaaaggcaatcactaggggaagcacagatgtgagaaagtgaatgtgcggaaaa

SEQ ID NO: 626956 - DNA, 515 bp, Homo sapiens
taaggccgccgggctgaccatccgtgtacatgaagttcgagccacgatcgtggacgggtgctgtctgaaacacttcacacgtgagcagggaggccggagaggagcgagggaggaacggacggactccagttgagcgcgcggaattaagtaacatgatagccaagcttgcacaaaacctgaccctccgcatcaagccctgataaagcttaagttcatcctttgtgacaagctggctactggaggcagtgagcatgtgcgtgtgagctggacacaggagaacttctgtcaagcgacatatacaaatgcgccgtggtgtctctcgcagacaaacaatgagcatatatcaaagaagctaacatcaggaaatacttcatctcgagccattgaatgactgcccagaatgccaggcttttgacacatcaaactgactaataaccagccttcccctgcctcaccggcctaccgtgaacatgtaatcctatgtcaagcagatagccgcatgtgacccatgacac

SEQ ID NO: 626957 - DNA, 127 bp, Homo sapiens
  misc_feature (7)..(7): n is a, c, g, or t
  misc_feature (35)..(35): n is a, c, g, or t
  misc_feature (87)..(88): n is a, c, g, or t
agactgnttgggtcatccgagatcattaaaaatgnctgaccctaacaataggcacaaaaataaaaacgaaataaaaaacctccttannttcgaagtatcttagaaaaaaacagggccttgagttctg

SEQ ID NO: 626958 - DNA, 117 bp, Homo sapiens
cctatcggtgtacgtgacacagagcgctaacactcagttcgactatgtatcaggaaagctatcattgcacagaaaagaatgcactcaatttcatggtcataatagtcattcatgcat

SEQ ID NO: 626959 - DNA, 532 bp, Homo sapiens
cattaacattctcagtttgccttggtctagcgaatatatagtacataatgggtttcaacatgtcagacaggcttgttaacacctcatgacctagagtgaatcatacacataaggagtgcaaagagctatgattactggcatgagaaaccgcacactgtctagatgttggtagttaaggctagtgtgaaactgttgtgcagcatgcgaaaagagcccatgacaatgctacacagtatactgcggtctctgagatctagacatcatagaatataaattcgggctgaattgctgtgagctattgaattcttaccagatatctcatgctgaaggcgaggatttaaaactgggctgttgctgctgtcgtagacgatagcattgttgagtgttcatataatcgcagttaaagctcagtgccatactatatattgattatagacagcgaaaaccatcttataataacttaatgttgtgctaaacgagtggccttgactaggcaactataatctttgttatgcagagctatatcataggt

SEQ ID NO: 626960 - DNA, 929 bp, Homo sapiens
  misc_feature (11)..(11): n is a, c, g, or t
  misc_feature (132)..(133): n is a, c, g, or t
  misc_feature (141)..(141): n is a, c, g, or t
  misc_feature (146)..(146): n is a, c, g, or t
  misc_feature (148)..(148): n is a, c, g, or t
  misc_feature (205)..(205): n is a, c, g, or t
  misc_feature (208)..(208): n is a, c, g, or t
  misc_feature (235)..(235): n is a, c, g, or t
  misc_feature (266)..(266): n is a, c, g, or t
  misc_feature (291)..(291): n is a, c, g, or t
gcagcggcagnggcctcgggcggggcggccggacggacaggcggacagaaggcgccagggcgcgcgtccgcccgggcggccatggagggcgcctccttcggcgcgggccgcgcaggggccgcctggaccccnntgagcttngcgcngnggccccagaccctgctccgggtcgcgtcctgggtgttctccatcgccgtcttcgggnccnatcgtcaacgagggctacgtgaacacngacagggccccgagctgcgctgcgtgttcancgggaacgcggggcctgccgcttcnggcgtcgcgctgggcctcggagccttcctcgcctgcgccgccttcctgctgtcgatgtgcgcttccagtcagatcagcagcgtccgcgactcgccggtcgcgcggtgttgctggacctgggcttctcaggactctggtccttcctgtggttcgggggcttctgcttcctcaccaatcagtggcagctcacggtgcccatgggccggtcacgtatcgcatggccgggggacgcgtgcgtcgtggcctgccatcgccttcagcgttcttctccatcctcagctgggtggcgctcaccgtgtaaggccctgcagtcggttccgcctgggcaccgacatgtcactcgttcgtccaccgaaacagcttgagcaccggggcgagccaggcctatcccgggtatccggtgggcagcggcgtggagggcaccgaagactaccagaggcccgccttcaccgagaccttggacacagccccaaagggttaccaaggtgcccgcctacttagcggctggcagtgcacagaccagtggctccaagggcaacccaacaagcaaggcccagggtctccggaactctctttgggccttcagctcaaatgcccgggaccagagtaggtggccgctttggccatccggggccaga

SEQ ID NO: 626961 - DNA, 183 bp, Homo sapiens
gctcgacatggcccaccataattacccccatactctctacactattcctcatcacctaactaaaaaaaagcaagcaaacaaacaaacactggtccctcctaacactccagctcttggggctctgaatgttcacctcctgcccactcccatatccacacatgcttgtggctgctagagtcgacg

SEQ ID NO: 626962 - DNA, 899 bp, Homo sapiens
  misc_feature (11)..(11): n is a, c, g, or t
  misc_feature (132)..(133): n is a, c, g, or t
  misc_feature (141)..(141): n is a, c, g, or t
  misc_feature (146)..(146): n is a, c, g, or t
  misc_feature (148)..(148): n is a, c, g, or t
  misc_feature (205)..(205): n is a, c, g, or t
  misc_feature (208)..(208): n is a, c, g, or t
  misc_feature (235)..(235): n is a, c, g, or t
  misc_feature (266)..(266): n is a, c, g, or t
  misc_feature (291)..(291): n is a, c, g, or t
gcagcggcagnggcctcgggcggggcggccggacggacaggcggacagaaggcgccagggcgcgcgtccgcccgggcggccatggagggcgcctccttcggcgcgggccgcgcaggggccgcctggaccccnntgagcttngcgcngnggccccagaccctgctccgggtcgcgtcctgggtgttctccatcgccgtcttcgggnccnatcgtcaacgagggctacgtgaacacngacagggccccgagctgcgctgcgtgttcancgggaacgcggggcctgccgcttcnggcgtcgcgctgggcctcggagccttcctcgcctgcgccgccttcctgctgtcgatgtgcgcttccagcaaacgcgggggcagggacaacgacaccacctcgacccaagctggggatcctggcactgtacccatcccatgtccctgagggtagttgaccgtctcgttctgtcattgttggtgcgtcccgtcggagcacactctcacttctctccacaggatgtaaacagcccagcctgtcagtgtgtaaacccaggccacggctaagaggtcacctcctaagatctcaaaaaggtgtccccctatcagggggcccgggcccggcccacgggggctggccaggcacggaaggaacagtacctgtggccagacacacagcctgccctagcacatcagcaagaccttgccaggaacgcaccatcatgggggcacgcgcacaagccattaaagacacgcacggcacgtgcacgccacaaatggccgtgtgcacattggacgccgccgcacacacggtccggccaccggcaccgacacagcacagccagggaaacacgcggcacacacgcaagcgcagaacaatcgccccgcgcagccggcgcaccgcctcca

SEQ ID NO: 626963 - DNA, 181 bp, Homo sapiens
ccagcggtcgccctgttacatgtagatgagttctccatgtgggtcaggctggtctcgaactcctgacctcgtggtgatccggcctgcctcggtgttccaaagtactgggattacaggtatgagccaccgtgcccagccggtttggtttttaatagggtttggcaaaaaaggggcggccgtg

SEQ ID NO: 626964 - DNA, 639 bp, Homo sapiens
ggaaagacctagaatccaagcgtgttacatgaaaatgtaacagagcagctgcttccacctttcagatatagatgtggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaaagacaaaacaacagttgggaggaaacattttcccaatggtccttctggtgaagcttatttgggtcacactgggagccatttctaaatctttctctgggggggaacaggccaccagaactggtggtcagaggtgaaccatcttaaattcactaagttctataaacctacattcagcttcctggttggtctgcgggggatctggccttattgcatatgccagtgcatcagatatctggcatgcatcagatcacatggccgtcacgacaaagctccatggtgaacaacctactcgcatttcagagaacacactctcatcccatctttcttagcccttcctacatttaaactggctggtggcccaacattatcactctca

SEQ ID NO: 626965 - DNA, 825 bp, Homo sapiens
ccaattaaacaagactcaatttttatttatccctgcatgagctgatagatatttagagttgcttccagctatttgagcctaaccatagaagaaactaatttactggccctgtcatgaacattgatggacaagtttttctgtgggtgtgtatttccattgctctggttatatgtctaggagaattgctgggtcatataataaatttatgtttaacattctgaggaactaccagactattttccaaaggtggctgtaccattttaccttcccaatagcgatgtgtgagggttccagcttctccattccttgttatgtggtcttccttgccccccgcacctgcccctgttttttaaaccaggcacatcagctttatgtttatttttttatatttttttttgagaaaaagactcaattggtccacaaggttgaagtgaagggggggaaacccatttatcgggaaccacaacccctgtgggtacaagaaagtattgtgggattacaccccccgagaaaaagggaaaaaaaagggaacagaaaacaaaacgcagaaaaagaaaggaataaaaaaaaaagaaggaacaaatagagaagaaagcgacagaaaaacaagaataagaaacaagacaatcaagacaaaaaaaaggagagacaaaacagagacaacagcgaacaacacaagaagtaacaaaaatgagaaacgcaaagacaaaagcaaggaaacgaaaaaaacgacataaataaacgacaacagcgaacacaaaggacaagcaaagaagaaaaataagacaaaagaagaacagaaaaccaaaacagataggaacgcca

SEQ ID NO: 626966 - DNA, 469 bp, Homo sapiens
atctgccatagctgagtggtggctgtccctttggaaggctgtacagtttgccaccatctccacacctccctcttacagggccagccaccatttatcatcaggcttgcgctgttgtttctcttaaagaaaagtgaattctctttttgttcgtatgtctctatcaaaagtgggaaaatgaaagatggattgatagcgccgcgtgtttcaagagaagtgggagcaagcatatttctttgtggaagtatagtcctatgtgtttaatatgtaaccaaactttgtctgtgtcaaaagaatacaactgaagatgtcattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatgcagttacataataaa

SEQ ID NO: 626967 - DNA, 993 bp, Homo sapiens
tacacaaggggcaatccactttttttccctgagccttgctgcctaaacttatccttcaaacacagcaaaaggtaaaaagtctgtttgtggtaagtataaacccgtttctttgccaacagcaaatgtgggtggctccattaaaaagtatccctttggagcatcattctttcaagcctgaggctctccagacctcgtgggcaaccagccgtgcgtgggtgtggaccgtggctcctctcgtggccgtggatgtgggtggccctctccagagggaaaccatactgtgtgttttcatcatataacgtgtgggccttgtgatgtgtgtgtttctccaacagatattcacccctcgttgagagtgtgtggctcgataaaaataggcgctcgcggggccctgttgaactcgaaggacgcccgccactcaaaaagaaaacctgtggagcgcccacagcaagagaagtgggagagagggccacaagtgggtgggagagccaccgtgggcggacacaagccgaggggagttacccaaattgcgcaagagactcacagggctacgaggagagccgcctcccatagaaagaaatctcccctttggagagggggccaccacaaagtcttaatcgcgacgttttacccccaagagtaatttcctgttgcataccccaacagtgtgggtccccctatatataaggatgaaagctcggaaatatattaaagccattaggaccaacggtggacgcgctacgatttataaccaccagagttccgatgacatgtggcaaaacaactgtgctgtaaccatgaggaaccatcttagttggcaagggaaccccctaaactatccgggtggtgtgcgtgcaccataattgggtgcccaagattaccctaccaggaaacttaagagcccctcaaagggctaaatttttaccaattctcgacaaggctgaccaaactggtggttaaaccactaaaccacgcataggagtttgcctggcg

SEQ ID NO: 626968 - DNA, 238 bp, Homo sapiens
gaaagaatcaccaatgttacatcaagaatttggagaagacatggatgatgagcgccttaaggatctctttggctagttagggcgctggcttaatgtgtgaaagtaatgactgatgaaagtggaagaatccaaaggattgggattagtaagctttgaaaggcatgaagatgcacagaaagctgtggatgagtatgaacggaaattggagctcaatgtgcaaaacaatactttatgcttg

SEQ ID NO: 626969 - DNA, 234 bp, Homo sapiens
cccaggagttcaaggctgtagcaagatatgatcacacccactactctccagccttagcacagcaagaccccgtctctgaaaaacaaaacaaaacaaaaacctaaaactggcccggcacagtggctcatgcctgtaattctagcactttgggaggccaaggtgggtgaatcacttgagctaaggagttcaaaaccaccctgggcaacatggtgaaaccccgcctctactaaaact

SEQ ID NO: 626970 - DNA, 226 bp, Homo sapiens
agggctgtacgcctcggtttacgggatgaggctccctgagctgctcccaacatcaccatggccaagggcttctatatttccaatgtccctgggcatcctggggatccgtcctgggcgtggcagccgtgtgcacaatcatcgcactgtcagatggtgtactcccagtgagaagaacaagaacgccaacagctcccccgtggcctccaccaccccggaccgcctcagc

SEQ ID NO: 626971 - DNA, 320 bp, Homo sapiens
ctgtgttaccaggatggctccaactcctgagcttaagctgctgcctgcctcagctcccaaagtgttaggatcacaggtgttagccacttgcatctggccaacttaaattgtatctatatatagatattgtttaagaattacctaatatttaggacctatgaaaaggtataaatgattatacagtaagtatatacctgctttagcatccctagttcagaaataaaatattgctaatttggttgtgacctcttcctcctccccagaggaagctgctgtaactgaatttggtatttatcatgcttatgtgttggggataacag

SEQ ID NO: 626972 - DNA, 871 bp, Homo sapiens
gcgcgtgcacagtagtgttagtgaacatgttcatagctgtatcctaggagatcctggtcttgagtagtgcttggatattcaccattaaatgaacgcccgggggtaatcgaatgttcggaccaaatccagatgcagttcctgaggtcataactggattctatctaagaggagtctcgatgcgagacttcgataatcatagtcatcgcgccgccggaagcagggtgggcctagccctactagtctcaatctccaacacatatggctagatacgtaataacctaaactactccaatgctaaaataatcgtcccaacaattatattactaccatgacatgactttccaaaaaacacataattgtgaatcaacacaagccacccacagcctaattattagcatcatccctctactattttttaaccaaatcaacaacaactatttagttggttccccaaccttttcctccgaccccctaaaaccccctcctaatataatacctgatcctacccctcacaatcatggaaagccaacgccatttatcaagtgaacatattcacgaaaaaaatctacctcttatataatctccctagaaatctccttaattataaccattcacagcacagaacttaatcatattttatatcctcttgaaacaaattatccaactggtatcataccgatgaggaacagcaagaagctgaagaggggatattacaatttacactaagaggtcctcctatcatggctattacatcaaacctagtcataaatttatatcctcagccggatataaatctggcccattaatggtgtcacaaaggttggaagacttagctgaccaaagaacatggatgggaaaaggggaacattaa

SEQ ID NO: 626973 - DNA, 494 bp, Homo sapiens
catcctcctggactcaatcatggcttgtggtgtggtcgccagcaacctaaatctcaaacctggagagtgccttcgagtgcgaggcgaggtggctcctgacgctaagagcttcgtgttgaacttgggcaaagacagcaacaacctgtgcctgcacttcaacccttgttttaacgcccccggagacgccaaccccattgtgtgccacagcaaggacggcggggcctgggggccgagcaacgggaggctgtctttccctttcagcctggaaatgttgcagaggtgtgcatctccttcgaacagggcaaccttaccgtcaagctgtcaaatggaaaagaattcaagtttcccaaccgccttaacctggaggccattaactacatggcaggtgacggtgacttcaagatccaatgtgtggcctttgactgaaatcagccagcccatggccccccataaaggcagctgcctttgctccctttttaaagaaaaaaaaaaaa

SEQ ID NO: 626974 - DNA, 858 bp, Homo sapiens
  misc_feature (5)..(5): n is a, c, g, or t
  misc_feature (7)..(7): n is a, c, g, or t
ttcgngnagagagaggcgcgacaggaggaagcggacaggctagcgtcttgtctcctccgatactttcgttccaaagagactggtggacagtgtggttctccgacgggtgctcgagtacggtctctgtccgctaaacagacgcgttgtggtaagacagagatggtaagtctgttcgagaaatgtgttttgcctttgacattttataaggcccagggtccacaccagcgctggcccagagcccgcttagacacggatgtgactcgggcacccgcgtccgcttctgccccaaagcggaaattttggaggaacatctccaacagcgtcacctttgggccgccctcaaagcaatctgggtcaatactgccccccgggaaaccccaagttggtagcccccctacggatctcttttggaagaaccccaatgccggtcttgtaaaccccccttcagaaacaagccttattcttacaccccgtgcctacgatcattcggaagatctttctataacagcaccatccaacatgggttcaaagcaccacccccaaattgagcactggcccggggcctttttcccccctgggtaaaagttccacttggtgagccccaaagtgcattaatatttcatcactctcactatagggctatatatttcaccaccccggctttggagaaattagtccccgcaagccccgggatccactcggttttgcagcccaaacctcgggtttgtgaagttcaagcccctttcaccgagaagcgtattttatacaagcccacctaacagtaatcaaggacgcttcaagcataggcaacccccaaaccaaccctttaacccccatacattaaacttccccccaaca

SEQ ID NO: 626975 - DNA, 775 bp, Homo sapiens
tgagcgggttggcgagctgaggcttgccaggcgaagtctggagaccagccgggccgcgtgcgctaagtggccatggactcgcccagccccttgggcgcgttgcccaatgaagccgggctgctccatgtcccggcggcggcagtgctggatgaaccatgatggcgggacgctggagaatgctacggtgcggagctggatgtgcggagacgtggcaggctggcggttctggaggcgtgcagagcttcgcttggcctgggaggcgcccgttgacttgacggacggctgacactggagtagcgggacgcgcgtggctgggcctagaacccgttgctgttgcgtccccatgtcgcgaccgatgtgactgggcagtcacactggtcccgtttcgctggggacgcctaggagggaggggatgattcgttgaggcaagaagttacgaaggggcctgatgatactcgcggcagcatgccatgggctgtgagaagagggaagggccgaacggctggcaggacccggcgtttgccaagccaaggactgacctgaggtctatgcgagaggccccagtaacgggggaagtcagttgtgggctcacaaacggtcggcgagactgcggtgtaggaacgacccagggagtgggccaggagcgtgggcactgcagtgaacccttgaggggtcatagagaaagtcacgggacggagactgtgacggtgcctaggagggtttatccctgcggagaagacagcagagccggcatggcaagccatcgacagccgcg

SEQ ID NO: 626976 - DNA, 1009 bp, Homo sapiens
  misc_feature (161)..(161): n is a, c, g, or t
gaggctcaggctcgggtcagcaaagggacctgcgcggcgccctggggcggaggaggcccgaggtcagtggccagtgccgtgcggttgacggaggtcggggcgcaacggggaccgggtgagggatgctgccccaagggcgggggggttcgcatgtgcccccntcaaaccctgcggcgggggttggagtacagggcgggcttccggcgcgggggggtcgggaccccaaatattccaaggccaaagagggccgcccggcccggggtctttctttctttaaccccagaagggggggcggcccggtgggggaattgggaaaagggcggtggcaggacggaggcaacaatcctcccagttgcgggagagggaaccacagggaattgtccgttgtggagccccgtggcgggggccataacctggccaaggcgccagcccaaagaaatcgggcgggggttcccccttccattattccccagccggagaaaggggggtcctccacttccaaagtttacaagcacaggagtgcccttggcgcccgaaatttggctagaaggggagcgccccttgtgacttggcccacccttaagtgtcccgcgcttcagaggccacgtggttggccaaagacttcgggggttctcaaccaattgacgtggggcgcccccggggaagacctatggcgcaagggggtggctgattgccccctgctggaaggagtcgggcaatgaaccttgccctgtgttatttggaagccccaccccttttggtgggccatcctgccttaggagaatttgtggccagctggcacagggtgttcccggtacacgccgcttggtatagcaggaccggccggggcatctaccgctgccaatgtgggtcaccggcggggcgtcttgcttgtgtacggcacgccggggatatcctgtggaccctgtggcggccccattggcgccagggttagagaaaagcgcgggggccctgggggggggaggcccccttcccccggcgggcgcca

SEQ ID NO: 626977 - DNA, 890 bp, Homo sapiens
ttgagaagggtcccacccccgcgtggggaccccctggtcccgcgcccccagggtggcccaactgacccccccgcagggactggttaaagaatgctacaggctggtctaacggccaacatggttcccccagcccccactccccgcccgcagcttccaccacacggacaacactttcgggggggacaccccacgcaagctttcccgaccctctggagggagctctccctcgcgttctccctggagaagacgcccgcgctgcgctggcccccgctctcgcccctcacggggaaacttggggtctcggggacacctcacagctggtcgccccccctctctggggggttctttgtcgcaccatcgggtctctttctctctcgtcgctctctgggaatttcgcgcactcactctctcatctgtgacactctgttctcgcgtacgagaggggagactccccatcgggctctttgtgccacgcccctcgtccacacagagactccctccatcagagcacagcgtgctcggggtgtccccgcacactcttgcgccgccacgtttccccccgagtggtctcccctgcggggacgcggggcacagccacacccacaagccctccctggcgttcgaggcgccccctgtgtctgtgccacaggcactttggcctcacagccccccctgagagtggggcgcgtcctgggccacattccccgaaggaagctgggcccctgcacacggcacacacacagggcccggccaaagacccaccgcggcgcccccgcaccagagccacacccgctggggtgtcctgccctctaatgcccggcgccgggcaccccaactccaagtttggtgtttgtctgtgtttgtttttcaagaaaagattccaattgcca

SEQ ID NO: 626978 - DNA, 157 bp, Homo sapiens
tccctgcaggtagatagacaagatgccattgactgagtggcttataaacactaggaatctatcgcgtagtctggaggctgcgaagtccaaggtcaaggcagtcagcaaacttggtgtctggtgagggctaactttcggattcatagagctctgtttt

SEQ ID NO: 626979 - DNA, 325 bp, Homo sapiens
tacctcaagtaaatagcatgaactttggttagcactctgtttcatggccccactcttttactatcagttatttggaccaactatgtaactttccaactataaggggttgttttagaattaaatgaaatatttagttactttttaaagaaatacatagcataaagaaggtactcattaaacattttatatgtgaatgagctaacataaatctgaatttcttagcttttcattgaaggtttttcagtggccactgcctgatagatatgtggacaaattggacaccgtgtaactcactgcgactaaatttaacgcttaatcatgtcca

SEQ ID NO: 626980 - DNA, 351 bp, Homo sapiens
ttttcccttaaaattttttttagggaaataaagggtttttaatttagggggtttaatttccccaaaccccttgggggctggggccgggatttttaccccgccgaaaaaatttttttagattttttaaaataagatcccgaagtttttttattgcccccctttttggttttttgggaatttttaaacccccgtaagtttttaaaggggttttttttttttaaaataaggaaaagggtttgtggcctgtgttttccccccactaaaaaggcccggccttgggatttttttttttttggttgtggggttgggaaagcccttatttgccgaaaataaagggttttccccgggcca

SEQ ID NO: 626981 - DNA, 315 bp, Homo sapiens
  misc_feature (265)..(265): n is a, c, g, or t
  misc_feature (308)..(308): n is a, c, g, or t
gctacctggtaggatgctgtagatcccagggttgattcaaccaatctgtcttgctagacaggtgtccaatttctcccccagcattaatagcatctcttatgagtccacttaatgggcttcattgaagaggaaataacaaaaccctctacccagatgttttcaaaattaagaacatattttgtaaatatgcattaggttaaatgaacagtctaatgttttatatcaaagatgtgctgagggagggaaacaagtaatgagagaaatnaaagtgctagaggaagattagcggggttgggggtgtgtacggngatactt

SEQ ID NO: 626982 - DNA, 144 bp, Homo sapiens
atgtgtacagcattaggtcgagcgtataggtaacagccatttaggtaacagcccatttaggtcacagccatttaggtttcagccacttaggtaacagccatttaggtaacagccatttaggtagagccctttaggtaacagcca

SEQ ID NO: 626983 - DNA, 209 bp, Homo sapiens
acgacgcgagcaccttccaggctctggtatgattgctggacaatcctcactggcctaaagtgagatcattaccagcaacctggcgacgtgtcaggacattgggattggggcttaccttgtctggctgggataaataaccatccaggatgagaactctcacttaactctaacaggagctagaaccctcaccacaatcctcgttcggaaaa

SEQ ID NO: 626984 - DNA, 114 bp, Homo sapiens
  misc_feature (12)..(12): n is a, c, g, or t
ctggagctcggnaccccctccaaagtgctgggattatagaggtgagccaccgcgcccggcctatgcctgagtgatttttaaattttttgtagcaatggggtcttgctttgctgt

SEQ ID NO: 626985 - DNA, 124 bp, Homo sapiens
tattaggtaagtatgagagactgataatggtaagtgctaaataggtattttggggaaggaattaggcccaaaatgtgtcagtggctcatgccttgtaatcccagcagtttgggaggctgaggta

SEQ ID NO: 626986 - DNA, 143 bp, Homo sapiens
acttatcatcttcacaagttctaaattctacgactatcctagcaaatcgctgtcgccttaatccaagcctacgttttcacacttctagttaggtctacctggacgacaacacagcaagtaacccggagattaggtctacctgg

SEQ ID NO: 626987 - DNA, 503 bp, Homo sapiens
acgtccagttttggttgaattcgtcttgttgccctaaggcctcctatgaaagactgacaggcttggactgaatcttgtgatctggacaccaagggtcacctgtgggcccagagctagctctgaagaatgcggtagtttctctgagaacctccacagcaaaagtttggtcctctgttacccatgcatgtcccactttaccagctacatcccccagtacctgcccatggctcatgactcctgaaaatataaaactcagtaggcaggcatacctggttcagacctgccagggctatgtgggaactatcattggtacaaaaaccctaagtctggagaagactgtggtagacaacagggcgacatgtctgttctaaacgcccatcagcaacttccaatgactatggccaagtgagataagggtgtacagatccctccagagagcgctcataaaattgtccctcaaaactgcaattccaataaccattttgtggatttcctaaggaaaa

SEQ ID NO: 626988 - DNA, 339 bp, Homo sapiens
atattggagataaaaccagcgaagtcccacatcacataccttacaacacacaagtgtgcgcaccagacccttggatagtgtaccgcgcgttacagaaagagcctgtccgccgggcttggtctgctccagctacgcgggaaggcggccccattgcaaagtccagtttctccgcgaaggtgccgtgtggctcatgtgccagaggcccatggtttccatgttaaggaagcgcacgtgcatcttggtctcaatgtcgatcccctgacatatcctcagaagctcctcaaagtgtgatcccctcgtacacctgctcaggctccatgtgccacatgcacactctgg

SEQ ID NO: 626989 - DNA, 136 bp, Homo sapiens
acgccataactagtacgcactaactatcacctcacttccagccagcaccagtacactccacaccacagctgaatccaccacattaacaacataaaaccctcattcacagccacagaactaatcatattttatatct

SEQ ID NO: 626990 - DNA, 766 bp, Homo sapiens
tatctgaacgtgacgctggacaagcggtgtacttagtcctgagcagaagaggatgaagatctcgtattgctgtcccccattcgttcccgctggaaagcgattttgacagagctgatcactggtcagatctatcaccagtataggtgaacatggacctgggaaaggtagtggttccttggtacaacacacattcgaatagcatcctaggaagaagcgtcagaatgactcaccactagcctgaggctaggtcacggagttcacgctaaggtccgagtgacatgtgtacaagagaatcatatcaagctacttgagcagacagctaaatccaaggctgacaggtgcaagcgatgtactcgtccatgcaatccgagagcaaggaaatgtaagtgatgacagaattacaatcatgccacgactgcgtgaataggtaaaaggcatggtatgagaggagatgatttagccattattaatgatcatgtttcggatacttggacgcataatggatgagggggattgattatggcagtggacttgggtgcagtactaacttatgaaaccatgggggaaggggtgaacttaccgtgcgctgagagagcactcacaaagaaatacaatctatggaaagatccgagaacgcaacttagtacccgttgtacctgacagttcaaaacacaaagacaatgccttgcaaggcactcctgaagaaacctacattgcccttctggaagtacttgccaccctggattcacgcccaggatcttggaag

SEQ ID NO: 626991 - DNA, 93 bp, Homo sapiens
ggatttgctggtgcagtacaactaggcttaatagggatgaatagcagctatgaacatttaaagaaattatccacagaccaccaaaaaaaaaaa

SEQ ID NO: 626992 - DNA, 1389 bp, Homo sapiens
  misc_feature (262)..(262): n is a, c, g, or t
  misc_feature (288)..(288): n is a, c, g, or t
  misc_feature (349)..(349): n is a, c, g, or t
  misc_feature (469)..(469): n is a, c, g, or t
  misc_feature (676)..(676): n is a, c, g, or t
ggagaaggccgcaagcgaggaagccgcgttgtatggatccgtgtagtattcggactcctctgtcgactagccgaatagtggccattgagtgaccgtacctctcatactcatcggttgcgccacggacgtgtgttaggatcacagccatgtaggagaaactcgtcacttgccatgcgagaaggactacatacgtgagcatgagaagtcgacggaacatcaccagcacccccgaagtggggccgagaattggactgaaaggttngttaagtacccgacgcacgtaaagtnggtgcgattggaagggtattacggagcatcccgactctctataaccgatgctatcagctgnatgtttgagagaatcagagcgctgccattaaggaagggttcaatcccacacaagatggtcccacacagagagagacggtcgcttgatctcgcctattcgaactttggagtgacacgccanagatccgctctagtagattgtagaacgatcctcgggccagggcatgtggtacacatgatcctccggccaggcgcttcatctccgcggattctccgatgaagcccatgtcctcgaagtcaagcaattgggcgggaggcaattcaattggcatgccatatcttagcttacctcgacctcagagtgagcagcatagcaagcgcaattgtnggggcccaagcgagaatgcctatgagacgcgatttgtgtgggtaggccttggataatctacgctacaggccgtgggcttgatcccatcgttcgattcgctgggatcccgtcggaagggggcttgatactgggtgtgtgatgccgccatctaggcttgtgtcggatagaggggcgcagcgttccggtgccttggcggttgcaccaccgtcccgacgtgccgtccattgcgtatcgagtcgtgcgtcgacgctttggatggattcgggcgggggacagtcgcttctgcattggcaggttacttggccacctttaagccccgcgttgcgccacaaggtctgttgccacctaagcttgtacgcattgtagttccctcacctttttccattccattcggaccaggcccagtaacttgacccgttggggtgcgctcctggattgggccgttctgtgggttacgcacaccctgagttgccgccgtttttggcactctggtcggcggagaacctcctgatgtcgagcgccttagctgtaaaagtataccctgtatcgcgccctttagtgcagatgtgttctcctcgaccggtccccgttgggtttgtggggcgcgtctgtttttcccgtaagaaggtcgcaccccgtggcgcacccgggtcactcctgtgccgtgttcttcttcttgtggggccccacacgtttttccccccccttggcgc

SEQ ID NO: 626993 - DNA, 127 bp, Homo sapiens
tgaataggtcgctgatatatcagggacccgtgccttatgatctagcacatgaccctatcacccctcacctcgtatgcagccagtagctatggatcctatgtgggcatgatccataatacggttatca

SEQ ID NO: 626994 - DNA, 957 bp, Homo sapiens
ggttgccttatgtgagaagctgtgacgatatttcttttcaattccatctcttagttatccatagcgaacatcaagaaatcatgaacaactttggtacatgacagagtttgactgccactatcctcgatgaacggttttactgccaaggacatactaggaccatgaaaatttaactgaagcttctctctcttctgactgactagaggatgcctaatctatagtggcagacctgggagaacatctctaaagaaacatctagacggtggtataaaagcaactccctcgtgtcagaccctcattttatgcagtacaaaatgtacatgactagcgaaagcacatacgatgaatgacccttgcatgcctaacgtggacaagcgactttgaacttgctgctaagcaaaagacttgaacataccagtagagagagacagagtcctatgggtgtgacctcccaacaagagggaataatactaagtgccaacataccctatggctaacaacacaggctatctacaacactcaaaagtatagctagcctacactcacctagcgcatgttcacacgcaattgcatgaagcatctccgcggactagcccgcaatgacatgacgacacagagatagacacccgcctgtgctccgtgtagattacccatcccaaacatgaccaaaaagtatggaacatactacagacagccaagtaacgcactatcacttgacctctaaattccacaaccacgtcaagagctcctaggaccagatagtacaaattggcttctccaacttatcgacatgccccagcggccaacaagtacaaccatatacaaaggcaatctcacttattataggtcaaccgtggtcgtacgagacaaaagaaagacgatacactaattatacgcagtggcatctcagaatgcgaacgattaaaccggttatccccccatgaatacgagaaacgg

SEQ ID NO: 626995 - DNA, 136 bp, Homo sapiens
cccctgcccccctttggttggggaattaaagggggacagggccctggtccccccaaatgtttctgtttccttgcatggggaaaagggcccctcctttatggctgattaaaccctgtaataaagcatttttggggga

SEQ ID NO: 626996 - DNA, 280 bp, Homo sapiens
ccaaaaaaatccaacttttatttcttaaatactgggaaggaaaaggggggaaacgggcccctgatgaggaagggccgttccgcaaaaagctaaggatcattaccaaaggccccctggccattggggaagcgctcggaacatggggtgggggttcccggcgatcctttattgctatcaaaccggagcttgggtcttttggctggcataccattgaggccggcctccctcaaaggggcgctgagttaaaccttccgcgggctataaacgccctggtggacaa

SEQ ID NO: 626997 - DNA, 423 bp, Homo sapiens
agcctcacggtgagttaaagcagactacatcataagctgtatttatacattgaactgtcctgtcatctgtatatgataagtagcttcatccagacttgtgaggataaaggtcttagagtaccaatgctgtgttaacggttgcacgcagacactaagtaaatacaaatcgttggcagagtctcgggttccatataccaagaaaatttaaaacctatattggggccgggagcagtggctcacgcttattatcccagcacgttggcagaaccaggcaggtggatcacctgaggtcaggagttcgagcccagcctggccaacatggggaaaccccatctctactagaaataccaacatcagccaggtgtggtggcacccgcttgtgaacccagctgtcaggggtaaggctggaaggggactcctcta

SEQ ID NO: 626998 - DNA, 153 bp, Homo sapiens
atacacgcgctggtcgctcttgctgaagatttggcacagtgtgtatttcaagacctcgctggtggaggccacgtggctgcccgcatacttcacctgtgctggcaatgcgccgcagaatctgacggtcgcttacggtccttgaagcccgatgta

SEQ ID NO: 626999 - DNA, 274 bp, Homo sapiens
ccagaaaataactgaaaatgaactggaggcctacatattaaccatacaacaacttggtagtgtattaactcgaatttataaataagcaaactgtacagggccaatataaaaagtagcatgtaccaattggtcattggcagagggatcttggctacttacaacctgaaggcatgcattacacattgaatactgtacatttatatcaagctatgacatatctgcagaggaactgtggctctgtaaacctaaatctacagaactttggcaagcctgt

SEQ ID NO: 627000 - DNA, 138 bp, Homo sapiens
gtatcttctttgtgtgtgtgttttccaagccaacacactctacagattctttattaaggtaaggttctctaagtaaatgtgtaacctatgggcactgtgtaaacattttcaagtggcgatatatcccctttaaacctc

SEQ ID NO: 627001 - DNA, 1709 bp, Homo sapiens
gtagttggccgatgctccggctggttcctttgacagagtattgcgggtctcgcgcgtaatcattaccatggagacaatcgacctatgtgcacctggagtctaatcccgtcgagtatactcgatgtcgcgctatcatgttgcgtccgctcacgtgcctggtcgttgcgcacttcttgttgaggcgacttgccatcatatgatcagacctcagacgtcagtgtagttcagacgagtcgtgcacagagagactcaacgggagggaatatgagggaactgatggtgcataccctatgtgccttggcccgcgctggaataacactacccctcacggtcgaatgggaattcggcggggctggcccgcagtgttgggctcaccggttatttcgcttgatcacggcaatagttccttcaccggtagactttgtgcgtggcgcgcattctcgcgtcccagctagatcctactccaggagactttgagaattggggttgcgttgctctgcttgttggtgttgagctctcgttatcccggtaccggaaacggtaacttccttggaggcttaacatcgtgccgacggtgtcgtaaccctcctcgtgcgagacgtcgtggtgacacagtagcgttggttcggccccgataataattactctcgtcccttagagggcactcgtggcgtgaggccatggtatccaatccttggtatgattgacagagctccgttagccagcgggactggaaagtttccgataaacttcggcttatgcaagtcttggaacgggcagcttcgacacttttcggtgcgtacacaggaagccctaataaccttttctattgcaagagcaagactactattttggcgaattttctgtgattacacggcactggtaaacgcgtccccacgcagtttttgtgttggttctcgccaccgattagacattgggactctggcttcgtgtgtggccgccgtctggatggttatagcctaaagagcgtgaaagaattgcaaactatttgagcgagaccggtgtcgtactcatctgtggcgccgaggtgggacgttagtcgatctaaatgtgcgatctacgggacatacgtctgtggcagtctttgcatgggtgacgcgcttgggcccatgcaccgatgccaatttgacatttgtggttgctttcttgttgagcgaagaattgtatagtgcacgttatttagagacggagagttaatttgtggggccttgcgtggtggaccatgaagaattgaggtggacggggtgactcacggagaagctctgttgcaagaccgcagcataggaaagtagattgatgaaggggtgagaagacagagtgctcagttgtagagatagaggaacgtgtatggtgtggtacagttacgagggtaaccgtgcttcagttgcacaggctgtcgtttagaacgcatgtgcgttacgatatcagcaagctgtatagaggagcggcgttttagtggtggtagccacgtaaggagacagaggcgagatccccgagagtagctagcggccgaggatcttgtcttgctccacagtgtcgcgggtatgggtagggtgctgcctgtggtcgtacatgggcgtgtggtacactaacaacgagaggtaggaagccagacaagagggcagatagtcagattcgaagacgttgtgagtaaaggcaagcgattgatgtagctggtgtgtagacgg

SEQ ID NO: 627002 - DNA, 410 bp, Homo sapiens
gtgatcagcgttctagatgggcatatgcatgacgaactgtagccaagaagggtctacaaatgtacgggcttggctcaaagcagatctcaatctcagtcctgctattaataatattcgggtggcctcccagggtgctgtgattacaggcgtgagccagcgggcttggtagtggctactttatcctagaagtcgcttggcctctcgttaggtcccaggcgaggcgggtcttgcatcttggatgactccatggcttctagagtgtagcgcagaaagaatggttgtataataggctgtattaccgagtgtatccaagggcttacctggggaaggcacacatttctactcggaggtctgataaggatgggctatacagcgctggtagatagtcatgtccacacgcggtgtgcgaa

SEQ ID NO: 627003 - DNA, 232 bp, Homo sapiens
  misc_feature (165)..(165): n is a, c, g, or t
ctgtggtgactctactgatgcttagaccaggcaggactgggccagtgaggtatggctgctgaggcgggaaagcggtggctgtggagggcacgtgctgcccccacctccgtctcggggcctggttccccactggatggcagagcgctgctccagtgtgcttccacnttggtgggcgcccaatagatgtctgctactggagcaagcttgtggtctcagtggagtgagacatgac

SEQ ID NO: 627004 - DNA, 419 bp, Homo sapiens
  misc_feature (5)..(5): n is a, c, g, or t
  misc_feature (21)..(21): n is a, c, g, or t
  misc_feature (215)..(215): n is a, c, g, or t
  misc_feature (351)..(351): n is a, c, g, or t
ttaancctgaaaaatagatgnaaaaagtgccattttcccttacccccctgcccagcccatcctgaggacaatttgaacttgataacgtggggcccaacgtgcagctgtcccatgaaaaaattgtgttatgaggccgggcaacgggtgttacgccctgtaatcccagcactttgggaggccgaggcgggtggatcacctgaggtcaagagttcaanaccagcctgaccaacatggagaaaccctgtctctactaaaaatacaaaaaatttagttgggcatggtggcgcatccctgtaataccacctactcaggaggctgaggcaggagagaatcgcttgaacctagaggcanaggttgcaatgagccgagatcacgccattcaactccagcctgggctataagggcaaaactctgtctca

SEQ ID NO: 627005 - DNA, 361 bp, Homo sapiens
ccacggcaggtagtactggaagcgtggctggggaggcatcaggaaactgacatcacggcagaaggcgaaggggaagcaggcacgtctggccatgttggagcaggagagacagagagagtgaagtgggagggctgcacgcttttaaacaaccagatcccacaagcgctcactcaatatcacgagaacagcaagggggaagtcggcccccatgagccaatcacctcccaccaggtccctcccacaacactgggaattacaatttgacatgacatttgggtgtggatacagagctgaaccatgtcaagggtagttcaaccgctgagattgattgattgattgattgagtacaacctgccggtgg

SEQ ID NO: 627006 - DNA, 370 bp, Homo sapiens
aaaaaaaaaaaaagcctcttttcccccccccccccctttcccccttttgaataaaaaaggggtcccattatcccaaaaattccataggggtttattgagagggtcccttttttttcccctccctaatccccaaagaaaccccgggggcccacttttggaaacctggtaaagtaacccttaggggggaatgggggccaactggctctttggattaggggggggataaaccccccccaaaagggggggagggccctttattcagctccctgcaactggttttgttcaaaggaactgggcagatttagaacgaattgggggtttgggttccccccccccgcttcccaagatttaagtttgggccaaaccttta

SEQ ID NO: 627007 - DNA, 514 bp, Homo sapiens
cccccccccatccccgctcacaacttgggttcttctcaacggggcgagctgagaagcggtcatgagcacctggggattttagtaagtgtgtcttcctagaattcgaaggctctctctttctaaaggtgctacatagttggtaatgcttggaatggcaatagggtagaatgattaatcaaaggcatattttctatatttgaagagtatccttccttcagggtttaatagactgagtcagatgggtctgatattaatcaaaattgtcttcttttaaggcccgctgataagcattgacttgctgtcccctaaggaaatccgagcggctacaaagggtttttttacttttcacttcaattaaagctgcgcttcgcttggggaggggggactttttctacctggacacattcctgcattcatgtattttgttttttttgactaaagctatgttacatggaaaggattttgaagccttttgtttcccctgctttgttttaataaacagtatattttttga

SEQ ID NO: 627008 - DNA, 1024 bp, Homo sapiens
  misc_feature (20)..(20): n is a, c, g, or t
  misc_feature (197)..(197): n is a, c, g, or t
ttgccattggttggatgatnatgcaatacctcctccagtcatgtctgtttttgtactctataatgctcctttgatgacagaagttgttaattttaatgaagtccaatttctcagtgtttccttctgtagtaatttttatgtcgcatttaagaaatctttgcctacttcagtatcttgaagacacttgtttcttctanaagttgtgtgttttgtttttcacactatggtctgtgattcatcttgaattagtttttgtgtatgatgtgaagtagggaccaagatttttcttcctctcatgtaaatattcaattgatcagcactgttttttgaaaagactcttctttctatacatatgcaaaaaaattaaattggatctttatcttacaccatacacaaaactaactcaaaataaattaaaagcctaactgtaagacctgaaattataaaacttctagaagaaaacataggggagaagctccatgacattggtcttggcaataattttttgatatgatgtcaaaagcacaggcaacaaaaaaataaacaagtgggactacgtcaaactaaaaactttctgcacagcaaaggaaacaatcaacaaaatgaaaaggcatcctatggaatgggagaaaatatttgtaaaccatatatctgataaagtgttaatatccaaaatatgtccagactcatacaagtcatagcagaaaaaacaggctccaatgttaaaactgggggaatctgcagtagaccattttttcaacaaacaacgcgccaaaagaacaacaacacatttgtcgggcgccgcctggtgaccctgaaaaaaggttttaaaaacccatcgggttggggcgagcgggccccaaaggggaatggggaaactggggcaagacgggttccctaggaaaaccggggcgaaagcagggacgtgagttcccccattaaaagcccgcgggacaccagcgtttgaaccactcaaagaggtggaggagtagggacataacacgggccacagagccaataaata

SEQ ID NO: 627009 - DNA, 177 bp, Homo sapiens
  misc_feature (18)..(18): n is a, c, g, or t
agtcgggaacagtcactntccaaattttctttcttttgttttttaacaaaatcataagtagagtcattggccttcatggtgctcttccttcttcatttaccaagtcagaatttcttgttccttttctttttttttttttttttttttgggaaacatgttcgtttttgtggcccgggt

SEQ ID NO: 627010 - DNA, 339 bp, Homo sapiens
cacgaggagattcttcatttagcaatgaattacttctcacatttcatctttctgaccatccaccgatcttttaaacctcttggcattttgttttttttggattcgccaagcattaatcacaaactgggcagcatctcttttcactggtaacctcttgttggcaagagacaagatcttatttacagtactcctgttggttcctggcccatacaatcaattatgttggaaggcttgtgctgattgatgccttgaatctctcatatcctggtcttttacacctacggccatgtagcttttattctggttgacacactgtacttttttgtcctttaatcattc

SEQ ID NO: 627011 - DNA, 110 bp, Homo sapiens
tgtggtgatttgtgtttgagatgtgagtgtggtgtatgttagtgggtggtagtgggatgtggtgttgtgtggtagttgtgtttgttcgtgtgtgtgtagttgttagggtg

SEQ ID NO: 627012 - DNA, 238 bp, Homo sapiens
  misc_feature (14)..(14): n is a, c, g, or t
  misc_feature (57)..(57): n is a, c, g, or t
  misc_feature (94)..(94): n is a, c, g, or t
  misc_feature (103)..(103): n is a, c, g, or t
ctagctcaggtctntggctatttatttgtatttagtagagacaggttttgccatgtnggccaggtggtcttaaactcctggtctcaagtgatcnacctgcctnggtctctcaaagggctgggattacaggtgacagccagcacacccagcccaactcctactgaatcttaaacatcaacactggtatctgacaccaaattcaagttaaagactcatcttcagacctgagcaagccagg

SEQ ID NO: 627013 - DNA, 456 bp, Homo sapiens
aggaggcggactatgaaccagctaggtagacagagtagacaccccatctcaaaaaaaaaaaaacaaagtagaaacccaatctaaaacaaacaaacaaaaacaaaacaaaacaaaacaaatacaaaataggtgtccatctcgataattggcttcctaagatatgaagtaaataattgggtgtaataatagcaaatcaaggtaatggaggtgaaattaatggctatgtaggcagcccttgactttggtatgtctagattggtatgctttatactttagacaccttattgccatggtctgaataggtagtgtcctcccaagtattcttttgttagaccctattctccggtgtgatagtataaagaggtggaaccttcggggaattagttcatgaggactctgccctcaggattgggattggtgcccttaataaaaaaaagattgaggggagctactttg

SEQ ID NO: 627014 - DNA, 275 bp, Homo sapiens
gctgaggcaggagaatcgcttgaacccaggagacagaagttgcagtgagccgagatcacaccactgcactctagcctgggtgacagtgctagactccatctcaaaaaaaaaaaaaaaaggtgggggactcccgagtttaaaaatttactacaaggctccgggggcaaagggggtgttactggcttagggatagaaacataaaacagcgcaatgaaatggggggcccaaaaaaaagcccacatatccggggccaattgatggccaacagggatagc

SEQ ID NO: 627015 - DNA, 866 bp, Homo sapiens
gctctgcgttctgtagtgacgcggcttgggcccttggtggattgtaagctgctggttttgcggcgtgggaacgacggggcgacacggtgcttcgagcactctattcgctcgggaatccccggcatggactgaggtgctgccagaagagtgcttacccgcaatggggtgaagcgttcagcctccgccagacgacgactctgtgagtctagcacactgaggaggcaggcagactctggtgtaactgacagatgagcaacacaatatagattcttgagaactatatgggttgcggtgatgagaaaggagcatactggtgtcagtcttgttcaatacggatgatcgatcataagtcgagagcatactaacagcttggcgagatccggtggtagaagaaagtaggaagagaaggattacatggaagagactgtgatgtctccaagtagtcgagacatacaagtatgtggacaggtgaaaactttatctagtgacgataattccggagaggatttgtggacctctggtgttacagctgatggtagaaggactcattgatgggagaaacggtgatagtgagtctggaggatgtatgagtgatgacagagtgatgattgcaacgtgggtcctggaaagtgggatagtgattcctgaaagccgatgcatgagtgctgagacgagcaatgaatcgtgctgcacatgaaactccgaagcatggtggagcagcgctgattgacggttggacagtgatcccaaataactgaaagaagcatgcaaagatgcggttatcataatgagtgtcgtgaagtccagtgctgtcataactcccaaatgcttagtcatttgtgataacagagttaagccgttatagt

SEQ ID NO: 627016 - DNA, 899 bp, Homo sapiens
ttggcgggcgtcctaactgcaggtctcctcgacttgactccaatcacagcatggtcacttggcaagggggagcctttctggctgggtagctccataggcctggtccaatcgtgcgcagtctatgggaccgtagggggagcatccctgtgcaagcaccctgcgtagtgaattaggcccaaccttgtaaaacatgaatagcgggttttctctatgggtttgaagcgctctggttagagagcgttgtgtacactctcagctacagtgtggaaagcggtgtataggcctatatgttctcacggtgagtgtctagatgtccacatatcgtataggtagactaacaagttacgtaaagttatgtgtgtgactcgccttgtgtagtagtatgtgccagcgctgcagccgtccgaggttgctatttccgcctctggacccgtgactctcactgaggtcaccgaatgtgagtgtggcaggcccacttcttaccccagatagcctcgggcgatgccttgtagtcataggactagacaagcgtgtacaagtattccgcacaagactgctgacagcatggagacaggttcttggtttcaactacggtatattgatatcggaagtaggtctagacaagatcctcggttgggttctctagctacatagtttgaatcgcacagatccccacctgccatcctatagtgttgtcttcctgtgtgttgccggggcttctgggcagcctgggtcacgtgccacggggaagtcctcgcagttgggaggccatacagagacccactgtgtgccactgagttgtcccacttgcctgcttggcaacctggagaactgaatggggggcgtcagggactctctccttttatatcacaacagctcaactgctaccggtcaagtac

SEQ ID NO: 627017 - DNA, 106 bp, Homo sapiens
aggcactgtacatgcaacatgtcccgagaaagattctagccagtccaatgcccagtgcacatccagatgaaggtgtgtgagctcttctgggttgactccacctgag

SEQ ID NO: 627018 - DNA, 645 bp, Homo sapiens
ccacgcgtcgatgctctttccctggaatcctggagacctgtccaagagcatgggtaagagtcagcatagaaaatcagaatcaagagcaaactcatgagactgggacaatccaagaagatacctggctctggttttagtacttagggactccaactgccactgtactggactgtaatatataaatccagatagcatacacaaggtggagtgctggactgaggattaccataatgaaatgtactaaatcttcatattagagtatagcaactaacgtgaacagtgcaaggacatactgcatttctattacagtatcagagtccaagaacaggatgtcaacatagataaaagccgtcatacaaaggcagaactacactccaaaattaaatgtgttaaaataaggtggggaaccagcagaacatacttctagctacagctatactctctctaccacactaagctgagcccagcaatacaggagaggctagaagggaggagcctcccagcgcggccgaggagacagagcccgtagcagggccggccctcacaacccaatcacctgagacgtcgaccatacgaaaaacaatgctatccaccaaagcccagagagacccaacctccatccatcccctcaccactgctcacgaa

SEQ ID NO: 627019 - DNA, 457 bp, Homo sapiens
ttccccttcccttatatattgaggctatggggtaggagaaaagagcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgaactcttttggcctcttctgctcttttcctggggctcttttttctcgggggggtgtggggaatagaacagcccggggcttttggggacccttaaaactttttttctctctttggggaataaaaaacactaaacaattcaattcccagagaaacccaaaaatcccacctttccaaccaacaacaactaaagggcctggggttctgctccaaaccataactctttttattctgggg

SEQ ID NO: 627020 - DNA, 776 bp, Homo sapiens
  misc_feature (695)..(695): n is a, c, g, or t
gtccaaagtctcatctgagacaaggcaagtcccttccacctatgagcctgtaaaatcaaaagcaagttagttattttctagatacacagggatacaggcattgggtagatacactcgtttcaaatgggagaaatggccaaagcgaagagctacaggccccatgcaagtccaaaacccagcaggcaaatcttaaagctccaaaatgacctcctttgactccatgtgtcacatctaggtgatgcaagaagtgggttcccagggtcttgggcagccccgcccctgtggctttgcagggtacagccccccttctggctgcattgagtgtctgcagcttttccaggcacacagtgcaagctgtcagtggatctaccattctggggtctggaggatggtggcccttttctcacagctctgcttggcagtaccccagtggggactctgtgtgggagctccaaccccatatttccctttgacactgccctagcagaggttatccatgagggcccccccctacagcccgaagcaaacttgcctggattccaggcattcatacatcttctgaaatgtaggcggaggttcatgaacgttaattcttgagcttgtggtgcatcttgcaggcttaagcaccacctagaaacctgacaggcttggaagcttgcaccctctgaagccatggcctgaggtgtacctgtggnccccttttacctatggcaggagcagctgggatgcagggctcaagttctaggcttgcacacagagggggtctgggacccaca

SEQ ID NO: 627021 - DNA, 360 bp, Homo sapiens
tactgtggtgtaccgtagttaggactagtgttgatatacaattatggtgggaagtaatttaatttggttttggtgtgttcgaatggtcatttaattttaatgttgttggtggatgggaacatagtcagtgaggaggagtaggctagtcgtatgtagaaatagaggtttagcagtgctgttatggctatgagtgtgggcatgatgatgctttcattttttggtcatttcttgaataattattcattttggcataaatcctgatagtggaggcaggcctcctattgagagtagggttactataataaggcttgtgatgacgggtatcttgtctcaggtatgggatagggacggtaacaccca

SEQ ID NO: 627022 - DNA, 335 bp, Homo sapiens
tgacacattgtgactttctaaaaacctttttggtgcccaaccaagttccactagtgacccacaaggcccgctgagattgtgctgaatctgaaggcacgggggacccggcttattaatcctttattttggcccttggaaaggggcgcaccaaagctctttattaaagacacttgtaaggagcctaagcaaatcaatcaaacttttgggatttaggttatttaccttattaaaattgcgtatttatgcctgtgtcttttactcacattaagaataagaacaaatggcctctaaataatatattataaaattggcaataaagttaatgatctaattga

SEQ ID NO: 627023 - DNA, 877 bp, Homo sapiens
taaataaatctaacaatatatgtaacatacaatatctttgttcgtggttgttttgagacggagtctcgctctgtcacccaggctggagtgcagtggcacaatctcggctcactgcaacttccgcctcccgggttcaagtaattctcctgtctcagactcccgagtagctgggactacaggcaccagccatcatgcccagctaattatgtatttttagtagagacagagtttcaccatgttggtcaggctggtatcgaatcctgactcaggtgataaacatgtaaagatcacaaagtgctggacatacaggcatgagacacggacctggagataacaaagggtcaataatagaaaacaaacacaacacgtagaaccaaaccacagtaccacaaacacaaatgacaaataaaaaaactacacccaattaacagcggagcatgaaaaaggacagacacaaaacaaaaagggcgccaaaacaaccaaaaatacaacgcggatcacgagacacaaaccaaagtacagagaccaaacgacaccagcaacacacacacaaaatcacaaacaacatacacgacagggcagacaaaccagaccaaccacccaagagccacaaaccaactaatcccaaagcagaaatagaaaagaaaacaggaagaacgaaagaagtagacagagacacaacagaagcgcccacaaaaaaaacaagacatgcaacaagagacaacagaaaagatgaaatcaaagcgagggaaagagagagaaagcaggcaaaaagaaacagaaacaagaagaacaaataaatgaagcaactacgacagaacacccaaacgcaaagagaaaagaaaaggaaaggaaaaacgacaaacgcgtcacaaag

SEQ ID NO: 627024 - DNA, 1120 bp, Homo sapiens
  misc_feature (789)..(789): n is a, c, g, or t
  misc_feature (1057)..(1057): n is a, c, g, or t
aggatggcgtggactgtggggtgaggcgggctggaccgggcttggcgaggcggaggcctcgctagtggccgagggactctgggagactcggtaggcagactggttgtgcgtgcaaagaagcttcgtcccacgcatcgtgagcgacgagctgcgtgacgtgatggcgcgacgcgagtacgacgggctagagtagactgcccacgcctggggcaccgggggtcccactagtagcacacgcgcgaatcggcgactgtcccgtacagcacaccggtggccaggcggtaagacaaacggagcatacgttcacgacgctggcacagctatgtgtccccatgatgttgctggtggcgcaccgccggggcggtctgatccagggacctgtgaacctacatatcgcgtgaggacgagacgccgaagcgtgcagggccgggcctatgtagagggcctggcctcttagggatgaagagctttggcccattcaaagtctcttgggattattcactttgggaacgccatgaaggcgggcgaaaagctggcgttgctggttcgggtagcgttgcgctcgaactggcgcttctggaaagggcctcggaagcgcaggcattagcattcgcggcacaatgcacgctacgcggtgggctagcggaaagggcacacccacgcgaagagataccgacgcgaacacatatgggttgcgctgaagacgttattccgatccgtcgaagttgtttatagccttcggtatcgcacacgcgcaatggatgtagaacccccatgcggtggggtcgntaatgggcacggggaagtacaccccctaggggggccgagaaattcgcccaacgcctgtaaaccacccgcgcgaaaccaacttttgcacccgcattggtttttcgaggaccagccgcattagtgtttaacaccgttggaccggaaacgtacacggcaccatttggacacagggtggcattcccgggtggtcacctggccacgtattagggaacctgtatccggggtggaactcgtctttacccgcgttataggaccattggcccccgtnacctcgcgtcttttgagacctcgccatacaactagtgttccagattgccccccagacggaacg

SEQ ID NO: 627025 - DNA, 227 bp, Homo sapiens
ggtgcatttattattagacactagtgttttgtaacaagaaatacgagggatacatatgcagtcggtttaagtcatatagatgggcaaggttgatatatattggctatattcccgactggtcttttcaccagccaaaagtcctctatgatgtcactctacgtacgggattcttcacttaactctagccttcgccctttccctaccttctatcccctctttccgtgagg

SEQ ID NO: 627026 - DNA, 142 bp, Homo sapiens
  misc_feature (90)..(90): n is a, c, g, or t
  misc_feature (118)..(118): n is a, c, g, or t
gatcagctagctacctactactttccattgggcagggggtggtgttctcttaatttgtatataacctgttgtctaaattttatgtacagncttttataataaaccattctcctatatnaaattttggatactgttaaaatat

SEQ ID NO: 627027 - DNA, 300 bp, Homo sapiens
gggtttttcccctggccccacgggttttggggaaaaccccaaatttttgggtcggggcccccaatttgtttttccccccaaaaatttcccggtttttggttttggttcccccttcccaaagggccccccaaggggttttttttttgggggtttgggggaaaacccctttgggggtttttgggaaccccttttcccccccccccccaaaatggttccttggccaaaggcatttttgatttggttttttgattgggagggttttttccgccctttttaaaaaaattttgccggaaagggtta

SEQ ID NO: 627028 - DNA, 310 bp, Homo sapiens
tgcccacataaatattcctcaagatttcttgatgtaaatctgggtccaattaatataaaggatagttacacttccgtttaatatgagacattataagaagctagacccctcccctgaaatctccctcaaggctcgtcctaattctcacagaagattcgtgtaaccttgtggtcgttcactctcaataacatcagcatctaagtgtgttaatgattaaatgtccgtaattcagtcaccgagctcaggtagcacctcaagaagtgtctcctagagcctctctagtgtctctctatcctatatgtagtgtcca

SEQ ID NO: 627029 - DNA, 301 bp, Homo sapiens
ggcccaggtctgtatttgcagtggcacaattcacagctcattgtcagcctcgaacctaccgggctcaagcaatcgtcctgcctgagcctcccaattagctggaaccacaggtttgcgccaccacacccagcttattgttttaatttttttgtagagattgctggtcttgaactttctgaccctcaggttgatccaccgcgccttcagccttcccaaagttgctggggtttcacaggcgttagacgccactgtgcacccgagcttcacaattttcttaaacccgtggttttcttcttattcc

SEQ ID NO: 627030 - DNA, 246 bp, Homo sapiens
cctgagttcatctggcagtgcactcagcaatggtcttaatgtacggaagtgcagactcacgagtgcctgtgcacagcagccagatggcctggttcacacgtgtgcagtggtggtgacacatccacagcctgtctgtctcacagtccctggtgcgcccatgtgcttcatgagtcctcgtgggatcctctcagatgtcgaccgtgcagtgcactgcaatgctatgtgcactgtgcctgtctgttctta

SEQ ID NO: 627031 - DNA, 81 bp, Homo sapiens
ggatttgctggtgcagtacaacctcgaattcgagctcgaattcgcacttaattgctttcctgcctccttgaaaaaaaaaaa

SEQ ID NO: 627032 - DNA, 112 bp, Homo sapiens
tcgagaggatcgaatactagcacacactaagtaagctggtcactgctatcagcactatagggtcagttgtctcaacctctcatacatatcattcatagcagaatggcatatc

SEQ ID NO: 627033 - DNA, 280 bp, Homo sapiens
  misc_feature (1)..(1): n is a, c, g, or t
nacccctccaaattgacccgaccgatgccgctgtcaagaccgccgatcttgaccctgagacgaccctggtcatcattgcctctaagaccttcaccactttggagactctgaccaatgcccggtgcgtgcctgcgtggctgcttgacggcttggtcgctgccggtgccattgccgacaccgagcaggcttgacgtgaccccgtcgctaagcactttgtcgccgtcttgacggccttggacaagggcgaggagttcggcattcacccaatgaacccctttgg

SEQ ID NO: 627034 - DNA, 134 bp, Homo sapiens
aatacatcacactcccataatgaatgtataatgtttaagtctacatcaaaaaagatctaaagggtgtcggcagataggtacctcccaagaatgtataccagatgtgaaaataatgtttccctacatgcatcact

SEQ ID NO: 627035 - DNA, 151 bp, Homo sapiens
ccggtcataggatgtggtgggagaacagactgattgctggtttggctgtggccatcagggagtgacccacagagtattagatcaggccagggaagaggcactagccccccaattaaccatctctactggtcccgacatccgtactggcccg

SEQ ID NO: 627036 - DNA, 437 bp, Homo sapiens
ccaggtatccgggctcaaatacacctatgatgccactaagccaccgctcaaacagggcggtacaggcggagagcgcatagtcgatctgcagatcgccgatgctaatggcgtctttcaaaaagtcgatcctaacggcacgtatacgatcgcgactagatttcatccggtcgacaaatggcacaagtttggcatctttggtgatggcaagactatcgatgatgtgtacaaggccatcgatgctcggccattgcagtattcgcaggtagacatgataggcgagtacatcaaaggcaagactctcgacccgtcgacgatgtcccgagttgaaggacgcatcacagatttgacgccaaaggtaaacgatgacgtcttgagacctgcccagagcatggccgtagctcctactctgagtggttttgacgcagtcggcaaggcgc

SEQ ID NO: 627037 - DNA, 403 bp, Homo sapiens
tttctggggaatgcttgggtctacttcttatgtgaagatacccgtttccaacgaataactcaaagagttccaaatatacacagtcagatactgcaaaaggagtgtttcattcctgctctgtcaaaagacagtttcaactatgttagttgaatgcacacatctcagtgaagttcctgaggaggcttctgcctagttttttgtgaagatattcccttttccaccatgggcttcacagtgctccaaatgaaaaattccaggtcctaccaaaagactgattcaaaactgctctatcaaaaggaaggttcaactgtgtgagttgaatgcacacatcacaaagcagttcctgagaatgcttctgtctagtttgtatgtgaagatatttccttttccaccataaacacca

SEQ ID NO: 627038 - DNA, 322 bp, Homo sapiens
  misc_feature (182)..(182): n is a, c, g, or t
  misc_feature (238)..(238): n is a, c, g, or t
  misc_feature (271)..(271): n is a, c, g, or t
  misc_feature (273)..(273): n is a, c, g, or t
  misc_feature (279)..(279): n is a, c, g, or t
  misc_feature (287)..(287): n is a, c, g, or t
aaaaaaaaagaaaaaaaaaattttttcccccccgggaaaaaaaccggggggttttttcccccaaaaaaaaacaaaaatttttttttttacacatttataaggcggggggaaaccccccccaaaaattttagacgggggggtttttaattttaatttggaaaaacaagggcccccttttttcnggattaaatcaaaaatccatgttgagttttagtgcagcatactcaaaatatactgntagtcagatgcccactcgtgcgaatctgcaagncngggatncactagtntagagcgaacgccaccgcgggaagctccaactatg

SEQ ID NO: 627039 - DNA, 472 bp, Homo sapiens
gcaggacctgtcatgagccagatataggagaggcactgctcgcacgactgcgtggatgctaacctggtagctggctgaacacgtgccctgttgtgctcctggacagcacgctcctgcttccgcttcttcttctgagcttatgctctgcttcactggctcgaagtcgtccttggtgtcgccacgggtgaactcatctagccgtgactggaagaggttgcggcccaggttggtgtccttctggccacgctcagtggccaggtagctgacgaagatctggtagttctccatcagatcattgtagcccacgtggatcttcccgttcgggacagagtacatcgttttgatgttgctcctgaactactcggtggatacgataaaccagctctcaatgggcgtctcctgggaccggagttcctttatcttgttgagcaggacctcgtccaggtacttgcgctcattggcgttggcgatc

SEQ ID NO: 627040 - DNA, 317 bp, Homo sapiens
ggcatgagttgttattatgcctgagaggtgtgtccaataatgagtccccgtctggcctgtggccaattgtatgtttgccacaggcaactgggggggcggattagggcggcatgtaaaaccttgatcatcagtggcctctgttcatgtttgaatgtggtgattatcatggcaggtgaggtgtggataggtgagtctcgatagcatactgagctggccggtatcccacctctctattgtattcctttagattgtatgccacatgggtgatgtaaaaatgttttgtgtcatttaagcgagttatcgtcgcacggccttga

SEQ ID NO: 627041 - DNA, 136 bp, Homo sapiens
ctagagtatccccgctgacctcttgcattgtggccaggtatgtaacctgaaactggtttagacttcaggactccatctccaagtctaacacagtgttcttaccttgcactacagggtttaccatctagccaggcaa

SEQ ID NO: 627042 - DNA, 109 bp, Homo sapiens
atagtttacaataaaatgttgctctctttcggattctcactaacttttgttactattctaaaagtttgaatttgctggatggggatccatcgtagagatcgacctgcag

SEQ ID NO: 627043 - DNA, 176 bp, Homo sapiens
caggagtcttcagtgtgacactgaaaaaggagtgacgcagacaataagaagcccacagaagacagagatagagaactactagagggataagccagggacaggcgtgtgtggtaacacatcgtgaactgagggagaggacatttcaacgatggtggccctgaggattgcttggctgg

SEQ ID NO: 627044 - DNA, 507 bp, Homo sapiens
catccgtacccacggaggtgtcgtcagattgccttcactgttgagattgtatgccaatggtatactcaatgtctctgctgtggacaaaagatacggagaaaagagaacaggattactatcactgaatgacaagggccgttagagcaaggaatgacattgaacgtatggtccaggaggctgagaagtacacagctgacgatgccaagcagagggacaaggtgtcatccacgcaattcacttgagttcctcatgccttcaagcatgtaaagcgaactgattgaaacatgagaaacttcaaggcaagattaacgatgaggacaaacagtcagcatctggacaagtgtaatgcaatttatcaactggcttgatcaagcaatcagacatgctgagaaggaagactttgaacatcaacagaaagagctggagaaagtttgcaaccccatcatcaccaagctgtaccagagtgcaggaggcatgccaggaggactgcccgaggataagaggtga

SEQ ID NO: 627045 - DNA, 359 bp, Homo sapiens
tgggaaacgggttagagtgtttctggtggaatgctggattgttaatcgtgttagatggaattatgaccttgttgttgtctttatgtggcagttaagtatggtttaaagagatgtttatgggtgccaagttgacaagggtagacttgtgatggttaattttatatgtcaacttgaataggccacagggtgccagatatctgtttaaacattattttgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaaaaaaaa

SEQ ID NO: 627046 - DNA, 527 bp, Homo sapiens
tatgcaggaatacggctaacgggtaaggacacgctacgagaatacgagcacctactaccgagcccctcgctgccgctatacacaccaccctagctacccagagagccgctacagcgtagcaacataccaatgtagtaaagctatagtaaagaccagaacacagactacaggagtatcaaagcggccttacaacatagataagatccgaacagagataggtaacatcgacaaggaagatatgcataataatagcatgcttcataaggggaagaataccaactgatgagtatctagataccatgatgaatagaggctccaggccccatcaattacaccatgtacctcaccatgtatggtgagaagttcaatggcacagatacctagaagatgtcatcagaaatgcctttgcttgctttgctgaagaagcaactaggaaccatacaggaagattacttgagagagctagctgacaaccataggggatcgcgaaaccagataaggaagtggatgagctagtaactcagccg

SEQ ID NO: 627047 - DNA, 278 bp, Homo sapiens
agattgcagtgagccaacatcgtgccatccagcctgggaaccaagagcaaaactccatctcaaaaaaaaaattcatcaactcaaataatactcgattagaccacgtgtgtttcttttcttcttcttcttcttcttttttttttttaagatggaggttcactatgtcacccaagctggagtggagtggctcgatctcagctcactgcaactcccaagtagctgggattacagtcatgcaccaccacacccagggtaatttttgtatttttagtagagac

SEQ ID NO: 627048 - DNA, 1084 bp, Homo sapiens
gtatcaaagcccccttagcactcctgtgccaccacatgtcgcagtcgccagcccctgaggactcaccaaagtcgtgtgaatgataaagagtacaacagccacttcaggtgaccaatggatctgggccgcttgtaagctcgtgcagatggaccatcctagcatcatagaatgctgtgttgcagaccaactgaccatgtacctccgtcctaccatgggcgtagataattcacgctgccgcgtatctaccctttctgggagggtcctaggagcgttggtactgcactcatgctctgcggatccgtgtcatctccgatagttggtcctgctcaggccgaagtagggcaagtcgtgctacccaggagtgcctattgccagtcccatcactgaatacatagggccctgataggaagcaagggcgtgaagtgcagcagacgggactgtatgcccatctgtggggaatcgaactcgacgccagtgccaccctttgcgaagaacgcattacgcagaggacccatgcgctggtcgaccagaaggatccgcttgtacttgcctttgcatagcactggagacgccggttgacccggcgtaaagtggctccgtgtgcgagaggaacacaagcttgggcacacggtctttccaatgcacacgccaatggtattctaacactggtccttgggcacggcaacccaaggacctaggtagtccaagagccgacttatgtaccgcacaaagggggtgcacaccatagagtagacctgcgtagctctccgtagtagcacttgcaccaagaatgcggagccccttgaagtgtgcactgtgacgacacgctacaagcgcctcaacaagggccaccaagttgccggcagtgacttccaggggttccctttgtggacactcgccacggtacggcccatggaagtggggatgagtccgtaggcacctggggcgtgacaccatggaacaggcgcgacaggcacgcactttgcacgggtcaaggccgtggtcatacacggcgacataacgtggcactaacaggtagtgccagacgaatgctataggattgtcgcaccagagcaatacgaac

SEQ ID NO: 627049 - DNA, 466 bp, Homo sapiens
  misc_feature (90)..(90): n is a, c, g, or t
agaggagtcagatacctttgcctaggccgagctctgtacaccgaagatccccacagaaaaaggcatcgtcgtcgcaccgcaactctcttnacacttcccctaagttacgcctggttctattgcttatgtgctcctcttattttttttgctatcatccatccatgtggggtcctggaatcactgtaagagagtgaatgcaatgaatcagaataaaactacgcttttgttctgagcacctgaatacaaaacttaatgtcgagcacacctgggtgtcaggccccatcagtgtcacccatgagcgtgtgcgtccttgaccttaaggtcggcaaacctgagtttcatggcctagtagagtgcaccgatgagctgtgctcctctgtgcagatgctcatccctttgcagttctaagttccttgtctgcaaaatgatcaaactgtctcatgatgtcactcgtggggtaggaggt

SEQ ID NO: 627050 - DNA, 109 bp, Homo sapiens
  misc_feature (39)..(39): n is a, c, g, or t
  misc_feature (49)..(49): n is a, c, g, or t
  misc_feature (85)..(85): n is a, c, g, or t
gatcttactcctttcctgtccccctgtacaaaacacttncctaacccancttgtggttttagggccagccaaagctcactgttgntgggaaagtcctaatcactacacg

SEQ ID NO: 627051 - DNA, 169 bp, Homo sapiens
tctactggggacgctccatatatgtacccatatctcctctggactcaggaacgcactaatgtgggtctaaagatgctttgtaatactcaggaggaaatacaccatttctcatgataaggctacctaccccctctcaaaccacttacgggaaggtgtcatcaatcttggg

SEQ ID NO: 627052 - DNA, 347 bp, Homo sapiens
  misc_feature (44)..(44): n is a, c, g, or t
ctagtggcatccaaagaaacatgggtgggcattaatattatttngagatacactttgctgtggattagtgttgcttctttgattggtctgtaagcttaaggcctaaactaggagagacaaggtggttattgcccaggcgcaatgcaggactagaacatggagcttcccctgatatatctatgcttaggcaataggtcgctggccactcagctcttatatctcacgaggctagtctcattgcacgggatagagttgagtgtgcttcacagcccgagagagttgcaagctaagcactgcaatggaaaggctctgcggcatatatgagcctattctagggagacaagtca

SEQ ID NO: 627053 - DNA, 314 bp, Homo sapiens
  misc_feature (243)..(244): n is a, c, g, or t
  misc_feature (270)..(271): n is a, c, g, or t
attggaacatttaggtttttggatttttgatgaggaatgttcatccaataagtacaatgcagatattccaaaatctgaaaataaaatccaaaatctgaaaacaagttcaaaatctgaaacacttctggtcccaagcattctggatgagggatattcaatctgtgttattaacatgtgaaaggaaatagtaaatggtatagacttttaccagagaacttacattttattttaaaaagggagttnnggtattgaacaatataattaaaattnngaatttagtgggttagctaaatctccacatagacactccgaca

SEQ ID NO: 627054 - DNA, 125 bp, Homo sapiens
  misc_feature (29)..(29): n is a, c, g, or t
  misc_feature (33)..(33): n is a, c, g, or t
  misc_feature (90)..(90): n is a, c, g, or t
ttactgcgcgttgggcacgggacagcaanaatnacctgaccaaggaggagtgcctcaagaaagcctaccggaagatggccttgaagtacnacccagacaagaataaagacccaacgctgaggaga

SEQ ID NO: 627055 - DNA, 203 bp, Homo sapiens
  misc_feature (28)..(28): n is a, c, g, or t
ctgccccccttcaaggacagggaagagncccctgtgggatggcagccagaggaataagaacttgctccctccccaaaggtaaacccttggtccaaaggtttgcaggggcccaaaactgttcttttttttttgagacggagcctgggcaacagagcgagactccttctcaataaataaataaataaataaataaatatttttta

SEQ ID NO: 627056 - DNA, 280 bp, Homo sapiens
  misc_feature (178)..(178): n is a, c, g, or t
acgtgtactagaggatcccagatatccggatctgaatagtgacggtctgtattactgtgaaaataagaaaatgtagttaattacacatttaaagagtattccacataacttcttaatttctacattccctccacttactctatcgggggtttccttttcagataagcaagcttttccnatgctccttaagtgtatttcctttttagataggaatccaggaagtattacgattgaatggaacaagcacttgacatactctgtctagagggtcacacaatag

SEQ ID NO: 627057 - DNA, 425 bp, Homo sapiens
gtgactctacaggatctgtcgctgctccctcttcacatgttactcaactatcccttctcagtaaggcttttctgactatataaaatggacacttctaccactccccactctacccaactccaaacttttaattctattcccttttaccctgctttcccccatagctcttatcaatatctgatgggccagtaaagtgactggtgcttattttgcttattattttaatggcttacccaacccatccataaggacaggagctttgattttgtacattgctatgtccccagagtctagactactgccttgtacaaaacaggtgctcagttaacattcgttgaattaattgaataatttaaagcaagagaggtaaatttggaatctagacatatatatgatatttaaagccatgggcatagaaaaccact

SEQ ID NO: 627058 - DNA, 328 bp, Homo sapiens
aacatatcaagtgaagaatcccagccatgaaaggcccccaaataatataatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgc

SEQ ID NO: 627059 - DNA, 200 bp, Homo sapiens
tgggtgatgtattctcactcggtcccccaggcgggagtgcaggggctcaatctcggctcatggcaaattaccccgcccaggttcgagcgattctccggcctcagcctcccgagtagcggggtttccgggccccccccacccatggcctagcatttttttttttccccattcagccctggggggggccccccatagagtct

SEQ ID NO: 627060 - DNA, 824 bp, Homo sapiens
  misc_feature (2)..(2): n is a, c, g, or t
  misc_feature (82)..(82): n is a, c, g, or t
  misc_feature (88)..(88): n is a, c, g, or t
  misc_feature (92)..(92): n is a, c, g, or t
  misc_feature (101)..(101): n is a, c, g, or t
  misc_feature (109)..(109): n is a, c, g, or t
  misc_feature (117)..(117): n is a, c, g, or t
  misc_feature (121)..(121): n is a, c, g, or t
  misc_feature (133)..(134): n is a, c, g, or t
  misc_feature (151)..(152): n is a, c, g, or t
  misc_feature (154)..(154): n is a, c, g, or t
  misc_feature (215)..(215): n is a, c, g, or t
  misc_feature (222)..(222): n is a, c, g, or t
  misc_feature (237)..(237): n is a, c, g, or t
  misc_feature (710)..(710): n is a, c, g, or t
  misc_feature (718)..(718): n is a, c, g, or t
  misc_feature (720)..(720): n is a, c, g, or t
  misc_feature (733)..(733): n is a, c, g, or t
  misc_feature (801)..(801): n is a, c, g, or t
gnccatgaaaaaaacaattcaattaataaaaccggttgtgagggggggggctgtgggggggcctgggcttccttctcctggntcccgnccgnccgcggccngggctccnctgccccncggntgtccagtgtcnncctttgggggggggggnngngggggggggggggagggggggggaaaattctgctgtccccagtgtggggggggggggggtnggggggngggggtgtgctcgcnggggcctggggggggggtggggaagcaggggctttgtcagttctgtgggtttagagcccatgctgaacggaattccccctttgtgcccagctgtctcccacccttgctgtgttgagtctgcgagcctgggatatgctaactcgggggtgatacaacctggaagaagaatgtgaggctctcctggaaagatgcaaaaaccatctcagatccaaggggccaagatcacaaggtcctgctgctacctgaggggtctgaagctttgagggcaggggctggggagtcacaatcctgtgaggcagggagagggaagagtcacaaacccaactcagcgctattctccagccctaggcgctttcactcctcagtgccctagaagtcaccagtaggtgtcaactgggcagacaagggacaggaagacagggatggcccagggctttttacccgtttggttttaggcccgtttctccattaanggatgcanangcagggtggagtnagtaaatgaatgagtcacatctcaaaacagcaggaaggaacagcctctgctggcaatgacagttcccnagatgagatccctggggctctga

SEQ ID NO: 627061 - DNA, 942 bp, Homo sapiens
  misc_feature (261)..(261): n is a, c, g, or t
ctcaaagtggcaggtggggtggggggagatgtgtgggtttctaccgtcacattactgcttttcaaaaaaaaacacacacaaaaaactttttttttggctttctaaattctctgttcttttcactactgatttttgttttgttttttggccgtttaaaatcccttattcagcctaattatggttttctacactcccctttcatggaggcacaagaagaagtgggttctccccttataagtagactcgtgcgtgtcacctagnttaagtgagaaatatgcttaatcatgacaatacgtgctttggaataccacacgtgtacagagggaggaacactagctgggagaaatctggtcttctggattatttggttggtggacacattcctatgtactggtggagctggggcatggtgttttttctggtcccaggaaaagaaaaaccatacttaaggtggatttggcactggacagccacacaaatcttaaatttccctttttaaacacattttttttcaagtggatcaaagggagaatataatagtgggattggctataacatggaaaacttataatccacaattcagtactcgggattataaatcaagctctaagtcttgggaccctcggtggaaacatttctaacccgaattttaattgggccttttcaaccaagggcttagagtggtagcaggggatttcttccaatgaggaaaccgtgatgtcctgatttaaagacgaaggtgatatttcaatggttcggaatataagctcctgtgcaaagttcgggggtggtgtttacccacataaggggctttctttcccagtcaagcgcttaaccacattctggtcaaaatgatcccttttcccgggctcacattggggttgtcatttctcatacatcaggagtcctccagcctgggcagtggccccaccctttcaggga

SEQ ID NO: 627062 - DNA, 281 bp, Homo sapiens
tcaaagtgcctcttctatatctacactgttgtaaagctcatagcacttcacaatctctgtgtacgtggcaccttcgcactgggtgtagttggcggtgtgtgaagctggaactgtggacgtacttttgtcggtgtctctggacaaacctccataaatctggtaatcttagaacggtccacgaatggtacccttggtgtggtgttcataagagtagatatagaagagtggcctttttgggggtaccgaggctccgaatttcggtaaattcttgggttcataag

SEQ ID NO: 627063 - DNA, 118 bp, Homo sapiens
tccccgtacgcccaaaaaataaattaaccttaatacagcatgatatgtagtagtaggggagtctaaggggggaattgagacatcccgccccctgttcttctatttgggcgtacgggga

SEQ ID NO: 627064 - DNA, 223 bp, Homo sapiens
tgacaaaacacatatgcaccccttccttgtactatccctattatgcataattataacaatgctccatcttgcctacgcacaaacatgacctaaaatctgctcattgcatgctcttcaatctagccacatcagccctctgtacgtaaacatgccacttctacatcctaaacccccatgaatgcttcacctgtgtgcatgttgttgggacttgggtcccgatgct

SEQ ID NO: 627065 - DNA, 202 bp, Homo sapiens
ctgagcccggccccagacagttcacgctacaaagaatcacgcgggtcacctcaggacctcatatctggttagaaaatgaacgtgagacaagccagtgcacgctgctctacaaagcattccttaagtgacacaggaggacgcctggggactttttatatatttgcagattacgcctttttgtaacgagcagcagggaaagaca

SEQ ID NO: 627066 - DNA, 1727 bp, Homo sapiens
tcattgtgcactgctaggtcgtccgctcctgtgtgtttgtcgttagttcctccctctttgttgctttccgtgacgtctccgtagtgtgttgttgcgtcacgttgtcgtccatgctccagtctttcgtttttttactatcgtccacctctgtggagggtctggtgggtgttctactgtcgtcgctccccgcttaggtgggtttgttgtgtgctgcttcattggtgtccggctgtactttctgttgtcgttggtggtttccgtcttcgcttgttggtcgttcgctccgttacgcatcgctctgtgttttcgtctgtttgtcctacttcttcttgtttgtgtgtggatggctggtggttgctggagccgctggtggttgtacctactattttcctgctggggagtcctcgctcccccgcgtgggggttgggtacgccgccgcccgctctgctcgtgggtcttctttcttctgtcttctctctctaactacgtcggttgtagctccatcgtgagggtcgctgtgttgtactcccgctcggtgtcatttgttctctcccgactggtcttgagttgttgggtagtctcccagcttggtgtagtgttctaacacgctaactagtttgatgagtggttcctctcccacgtgctcatctacgtggggggatgataccccaccggcgtagttgccgtagttggcgtacctgtggtatctactccacagtgtgtggtccaactacaacttgtgggtgcccccactccgccgacatagttgttgtgtatctactgcgtggggaggaatttctgtagtacggtagtgcttgttcttcgcggtggatgatttctgattagctttgtttccgcgggggagatacaaccacacaccatcggtgtgttgggtcaacaccaaatgtgtatatcccccccggggtagtgctcccccccgcgttgtgtgagtcccccccccgcagggggggctgtgctcccgcgtatgtggctcctccttgtctcgcgtgcgttgtcctctgttctcacctctcacgtgcgctcctgtatggtcctccgtacgggggcccacacgtgcgcgtggtgtgtccccccctgctctcacgagggtgtcccccgcgtgtggtgttcgtgtggtggaaagttgggggggtcacgttgccaacacgcgcgtcgtgtcctcggtcccacgtgctcacgtcactcccacgcgtggtcgcgtgctcacccgtgtgtggagagggggtccgtgttccggtgtctcccccgctcctcacagtagtggggccccccggcgcacgtgtgtgtgtgtgtgctgtggaggtgtctctcactcactgggccaccacagggtgaccccccgtgtgtgagtgtgtgtctgcgtgtgtgtgcgtctcccacccgtccccacacccgtgtctcacccgtccgcggggtgtgtgtctcgatccgtgtggtgtccgcgtgtgtgtaaagagaagtctcccacccgctcccgcgtgaggtcacaacacacacggagagggcgaccacacggaacgtgaagggggaagaaagtccccgcccgcgggtcacacgtgtgtccccaacccggcgtccacgccccgcccgacgtgtccccgacccgtcaagcccgcggtggcggtggtaaagagtgcgtccccggaacgtggtgtgtgtacgcggtcgtacgggtgtgtcaggaggtgaaaaaaaagtccaaacgg

SEQ ID NO: 627067 - DNA, 124 bp, Homo sapiens
cctcacacgactgcgcccgcaaagccgcatcaatgcataagggctctggcaaccatatcataggtacgaagtgtgtttatccctgtatacgcaattcccgaggcatctatatctaggcttgtgt

SEQ ID NO: 627068 - DNA, 158 bp, Homo sapiens
caatgctctttgtgcctcttcctggcttaggatgtcgcctctcactgtgctccctgcctcaacccctgcttcctgcaggtttattctcaccaccacatccagaagtcacttttcccatcctctgttcaaccccgcagtagccttcgtacaccacctca

SEQ ID NO: 627069 - DNA, 742 bp, Homo sapiens
  misc_feature (651)..(651): n is a, c, g, or t
cgcgcatgcatgctcataagggaaggttaaaaaaaaaaaaaaaaaaaaaacatggtcgtgcgggtcgccctagtccagtctagtctagactaaggcaagcttatccatgcgaacgcaagctgacttgactaggccaatctaccctatggggagtcacattacactgcactggccgttacatcacaacgactggactgacaaaaccctgaccgaacctaattgaattgccttgcatcacattttcgtcaggtgaggtggtagaatagagaacaggcccgaacggattgcccttcacaacagtagcctaaatggaaaggggaatgggaatgcgaagcgataatgttaagataaaagtcgagttaaagtttaagtaaatcatcttatatccaaaccgccgggccgggatcaggccattcccttttaaatgaatagactggaccggggttgggtggagtgccggtccggatcgagacaacactccactataaaggaacctggactccaacgggaaaggagccaaacctatgtcaaggggatggtccactaccagaacccttaccctaattatttgttttgggggcggggtgccgcaatagactaatccgaacccggagggggggccccgattttagcttggaaggaaagcccccnaagtggaaagaaagggaagagacaaaggacggggcctccgccctgggcctttaatttaaaggttaccctttcccacctaccgacgggagga

SEQ ID NO: 627070 - DNA, 945 bp, Homo sapiens
gtgtccgcccttagacagagaggtggtaacacatgtacctctctaggcgggatgtaactcgtgtgtggcgtgtcgtggctactcaggagtgagcgtatgcgacttcaagcttggctatactagtgtggaattatggattgcgactaacgaccatgtgagacctttgaggcgtcacattgtatagtgactaatccacgtaagatagatgctctgattgtccagttgacactgctggggtttgcaggctcggcacaaactactggcccgttgtctggtgcagaagaggcctgtggcgttgcatgctccgtgcctaatcatggagactccgtggagtcatttggtgcgtgcacggtattgagagtactcggttgcaatatcctgtaggagtggcgagaacgaatagagtacaaaaggacagtctcgatgtatttgctgggttgtgactagaaaatctgtaaggacaggatgttcggttcgcgaatgaccatttactttccgaatgtgctcaatggacgattagtgaaaaagtcgggtggtggtgtgtacgacaaatagggggggactggataagttagggtaaaatcgcttcgggtgtgacaattggtaagcctgaggaatccaggggggtcactaacgttgtattgtaattcgaattgcttgttcacatgcaagtattggatggaagtgtaggcaggctacagttgatagttggaaatgccactacctagagtgttaggtaatattgagtcacatttattgtgagacggagtatggaggaaaaggtgaagggcaactgtaggcattggaccagatgagtatcagggtcacatagtaactataaaaaagagaaggggggggagtgttggtacaaacagatcactatgtctttgcaaggaaaaaggggaatattgacccaaaattgcggggctttgaaagcgagaatgc

SEQ ID NO: 627071 - DNA, 504 bp, Homo sapiens
attcctcacgccgattgggtggtgttcacctccctcgtgcaacaccagactgtgactaacagtcctagtggataaatgccaagcacatatagcgctcaacatatttcagaccatacacgagatgaccaggcccgattccagacctgagtgtcgaagtagcttattactcagacgtttccaataaaaataaggcactgtatcggcgagtaccatttgaataggaaaaaaaaactacggggggtgtgtttttggggaacaacaattcagtatggggtatacgtggctctgttcaggattccccgtcgtgccgcagagaaaaccgaatatgactaggaaccatgaggttgagggtccagttcctgcccttgctcagggggtaaaggatccggcattgtcgtgagcgggggtgtaggtggcagacgcggctcggatcccgtgtggctggggctcaggtgtaggccggtagctacagctccgattgacccatcggcgacgccaatgggt

SEQ ID NO: 627072 - DNA, 104 bp, Homo sapiens
  misc_feature (56)..(56): n is a, c, g, or t
gagaagacgacagaagggcaggagaaagaagagagcaaaaaggataggaaagaggncaaggagaaagataaagataaggaaaagagtgatgtaaaaaaagagga

SEQ ID NO: 627073 - DNA, 813 bp, Homo sapiens
gacacgttccagtatattttacatttctctaagtgtccttcatttccagaagttgtgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcatacataaataatcacaacttctgaaaatcaagggacacacttagagacatgcaaaatgcactggaaagtctcagcaatagaattggactataccttagaacgcaacgacagcaaatgtcagagttacgaagacaaggcttctgaattagcccaatctgacaaagacaacaaaagcaatttacaaacaatgaacgcagcctccaataagtttgttcaacaaccaagcctcaagaataattggctgttcccaaggaagaagaagaatctaaacagttggcaaaacaaatctgagggattaattgaggaaaacttccccggacttgctagagatctagacatccaaatacaagaagcttacagaacaacctgggaaattcatcacaacaaagatcatcacctaggcacatagtcatcaggttaaactaacggtccagcatgaaggaaagacatctcacagaagctgtgagtcaaaagcctcaggtaacctaataacaggcaacaccctatcagactcaaacagaacctcagccgaaaaccctaacagcaagacagggaatagagaacaaaccagaagcccacctaaagtaaacagcagtacaaacgattacacggcaacacagagc

SEQ ID NO: 627074 - DNA, 886 bp, Homo sapiens
  misc_feature (741)..(741): n is a, c, g, or t
tggaaatgggagtttcggcttttggtgcgcccaggctgggagtggcagtagtggcgagatctgggcttactggcgaacctcggcttccagggttcaagcagatttcttctggcctcagtctccctagtacgctggggattacagggctgtgcaccaccaagccgggttggtttctgggcttcttccgggggacgcataatggtctcaaagggctcatccgagttggcagtggtgtttgaagaactggctattctctttacgggccaagcagtggtcctacaggtggtgggttcaccacactttggtttccggtgcactcatcaggcggatgggaccagcccagtgttctctggaaacggggctggacttgggactctggaattggttaacgcaattgggctctccagggagtcctggtggaaaaatgttggcttcatccttttggaatgtctggcccagggaggccctaatgtggtgtaagaccagggtgtccccaggttggcggggtctcatcagggatacgcaattgggagagagtctcacttttcccggaagaaggggatgtgttaatggtggttaacagggcattctgggagtaatggtaatatattataggggacgaggttaagggggactctaaattggcgcacggtattggtgggagagtaacatttatattccggggggtttttaacaaacagcacacaattaataatcatatttgagtagctgacatatggntgcataatccgggagggataataaatttaggtggcaataacagtttttgaatttccgagaaccctatgtgtagcagggattataggaataccgggttagtgggtgttccaaacaaaggattactccatggggctgaaagagccta

SEQ ID NO: 627075 - DNA, 1070 bp, Homo sapiens
ggagggcggatcacctgaggtcagtgagttcgagaccagcctggccaacatggtgaagccccgtctctactaaaatgcaaaagttggctgggcgtggaggcacgtgcctgttatccgagctactggggtggctgaggcacgagaatcgcttgaacccaggaggtggaggttgcagtgagccggggtcgtgccattgcattccagcctgggcaacagagcgagactccatctcaaaaaaaaaaaaaaaagacttgactaaagaaataaggccaggaaaggggggcatcatgcctgaaatcccagaaattgggaaggccaaaggtggccgagatcaccgagaggacagcgagtaggggaaatagcacacccacaaacatggcaaaaacacaaaccaacaccataaaaaacacaaaaaaaagggccgaacaccagagggagaaggatgccagagaaaaacccacgaagaacaaggaggcaagaaggacaggaaaaaaaagaacggaaccagaagaaatagagaaagaagaaatagacgaagatagaaaatagaaaacacagcacagaaagaaatacacaacactgggacaaaacaaagagaaggaacaaactcacaaaaaaaaagacaaaggaacaaaggccaaagacgcagaaggaccaaagatggatggaacacacaagaggacaagagaaaacaagaacaaaacaatgacaaaacacggaaaacacaacaaacacaacaaaaaaaaacaaaaacaactaaacccagagcaaaggatgaccagagccagaagaaccagaacaacataaaaaacagaggagcacaagagcatgagccgagcaaccaaggatagaaagacaaagtaaccacaagaaaccaaacctggaagaagaacaaaaaagaactaaaaacaaaaacagcacatgaaccataaagcacaaacatgaaaaacacagcaaaacactaattaggactaatcctgtcaagcaccagaaaaaaatacatatatattatacctatacaaaacacaaacagaacatagatctatcatatacccaaacaatcaaaaaca

SEQ ID NO: 627076 - DNA, 262 bp, Homo sapiens
gggggccccctttttggttttgaattttaaaggtgggaaggtttaaggttccaaggtttttatatataaaggggggcccatcttttcataataatttttcaggtcgggggccgccgaggggcccaacttttcccttttcctttttaaccgttttttggttaaagagggtactctttttttttctgttaaaaacgggagggccttttttgggcctttaggtttgttccccccggaataaaaaagtttaaatttgttttcctta

SEQ ID NO: 627077 - DNA, 215 bp, Homo sapiens
cgggaggatcacttgaggccaggagtttgggaccagcctggaaaacacagtgagactcctctgaaaatatttaaaaattagctgggtgtggtggtgattgcctgtggtaccagttacccaggaggctgggacaagaggattgtttgaatccaggagttcgagattacagtgagttatgattgtgctaccacactccagcctgggcaatcaagctt

SEQ ID NO: 627078 - DNA, 951 bp, Homo sapiens
ttcgcggatgacgccggactgggcctactccgccggctctcagtgctattgtccctggggcctggcattgaggcgggtccactgtgggaagggcgtgtggcgcgcggctccgcggacagatgccaggagccaagccctgacagcagagtgctggacagaagtggcatgggtagtctggctagtgatgaagatgatagaacagctgaatgggtgagaccagtgcatggtgctagagaattctactaaaatgggtttcatccatggtgctgtctacaacgctgtgggtggatgaagaagcgaaaagatggaagctagtacggccagagtggcatgtcctcatgtgcaatgctggaatacctaataagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtgggagcccttgtctttcctactattgctacaatagtggtacatgatgttcagtagtgttactctaatttacaaggacaatctgggtggaatgcgttggtgcataaaggagcatttaaagttacttcaacagcagcatattacgacaggacacgcaaattctgaatatcagagaaga

SEQ ID NO: 627079 - DNA, 525 bp, Homo sapiens
  misc_feature (149)..(149): n is a, c, g, or t
  misc_feature (212)..(212): n is a, c, g, or t
  misc_feature (477)..(477): n is a, c, g, or t
tacttttcccgggccatcacctcatcgtcaagtgcctgcttaaagacggggcggcgggggcagaggacgctctgctgcactcaagatgctgatacatttctcaagcatgccggcttgtgtgtctccggttaaagtttccttcccatttnctgtgcagatgttaaaagattgactcctttccttttttcagggtataggtgctcagctggganaggtgagagttaaattttctcatgatgctggtgccaagaaatagcaccttgaaaagagaaagaaatcaagacatgatctccagggagctgtcgtttggagcacattcccgagagctctccctgggccgggaggctgcgtggtgtcgttcccctcagcagcatgcttcgggtggagcctcctgccctgttcagatatgttagataaaaacaccttgacagtgccagcccgtctttaattttcacaccatctcaagtaaaatatgtnttgaaatgaaaacattttgcattttattttaagcttatttttggggct

SEQ ID NO: 627080 - DNA, 252 bp, Homo sapiens
cccaggctggtttcgaactcctgagctcaagcgatcagcccgcctcggccttccaaagtgctgagattacaggcgtgagccactgcggccggccttacaaaaaaaaattaaaattagctgagcgtggtggtgcgtgcctgtagtccagctacttgggaaactgaggtgggaggatggccaaagtccaggtggtcaaagctgtagagagcagattgtgcagtggcacaatctggggagaccctgccttaaaaa

SEQ ID NO: 627081 - DNA, 288 bp, Homo sapiens
gtcctagcagatactcacctagtcagtgggtctgacggcatctggctaaaaaaaaaaaaaaaaaaaagcacggggcgcccagcttccaccaaccagattttcaactcgggaattcccgggagatgcacaaaactccccatttggtaagctgtcaaagctgactcctttctcttcccaccctccacctccagtggggagaaatccaggctaaaatgacaattttcattataaagggggggaccaaggaggtgatctcttctgcacgagggggatctcctctagagttcg

SEQ ID NO: 627082 - DNA, 115 bp, Homo sapiens
ggtcggtttttccatctctgagccttgtttccttttctgtagcaggggggtgataacagcacctacctacagggcaggttgtgaccatgagataacatgcaagaaagcattgaag

SEQ ID NO: 627083 - DNA, 479 bp, Homo sapiens
cggtatattgcgcaataccgtagagctcagagatccagatctccactgaagttggcatcacacgatgtttgatctttccaccgtgtgataaggagtcagagcattggacccaaaactacccgtggtgacatacctcatgccaaatgccaatggtgcacattcatctgcagacatgccaccagaacttcgcctatggttcttccatgctggtacgattgttgaacactagggtgacttgagactcactcctacaccatgaacattttgtgccgacttccattaaccatgaaaagacttggtcgccagggaacgttgtgttagttttgttagccgagccagaacaaacaagaacgttgtaacaagttttggaacatgggtataaccctcttgcaaaggaacagattggaatttgactacttgcctcctggcaaccctacacttctcttaccttaatccattggagatgccactttgagcaa

SEQ ID NO: 627084 - DNA, 125 bp, Homo sapiens
attcaggtgtgtgcttagtaagaaatgaagccagtgctaccaaatgtacttgcttgtcacggctccatggttccccataatcaacagctactgtctgcagttttcaacatgctgcctgcctcaga

SEQ ID NO: 627085 - DNA, 150 bp, Homo sapiens
  misc_feature (139)..(139): n is a, c, g, or t
actgtgctgctgggccagagatgtaggctagttatgggcaacagcttttttgggaatagaaggcagctgtttcttatggtgcagtcgcgttggaggactggttttcaccgtccccgtgttaatttgtcttctcttcacncttgcagatcg

SEQ ID NO: 627086 - DNA, 412 bp, Homo sapiens
  misc_feature (36)..(36): n is a, c, g, or t
  misc_feature (132)..(132): n is a, c, g, or t
gatccaatttgtccagacccccagaggtagcccgtncctcacggttgccctctgtccaaggcagcctgtgactgagcatctggtggtccaggcagggccactgtcttgccgaagtcaatcatccagaccttngccaggccagtgtggtcatgcacaaagagaagggaactgcccactacctgcagcagagagtgagagaaaagcagttagagaaaggagcaagcactagctaatgtatttcccggtgagcagtaaacagggtggtaagacagcagaaactctggaatgaggctacccacgttcaaatcctgactctgattctacataaacagaataattgtataattacatgtaatgggcataaatcatttcaaatggttcctgaaacacaacaaatacacaatgaatgtta

SEQ ID NO: 627087 - DNA, 910 bp, Homo sapiens
  misc_feature (53)..(53): n is a, c, g, or t
  misc_feature (80)..(80): n is a, c, g, or t
  misc_feature (82)..(83): n is a, c, g, or t
  misc_feature (97)..(97): n is a, c, g, or t
  misc_feature (101)..(101): n is a, c, g, or t
  misc_feature (124)..(124): n is a, c, g, or t
  misc_feature (127)..(127): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (163)..(163): n is a, c, g, or t
  misc_feature (168)..(168): n is a, c, g, or t
  misc_feature (173)..(173): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (190)..(190): n is a, c, g, or t
  misc_feature (206)..(206): n is a, c, g, or t
  misc_feature (226)..(226): n is a, c, g, or t
  misc_feature (241)..(241): n is a, c, g, or t
  misc_feature (243)..(243): n is a, c, g, or t
  misc_feature (251)..(251): n is a, c, g, or t
  misc_feature (255)..(255): n is a, c, g, or t
  misc_feature (264)..(264): n is a, c, g, or t
  misc_feature (283)..(284): n is a, c, g, or t
  misc_feature (288)..(288): n is a, c, g, or t
  misc_feature (293)..(293): n is a, c, g, or t
  misc_feature (296)..(296): n is a, c, g, or t
  misc_feature (301)..(301): n is a, c, g, or t
  misc_feature (305)..(305): n is a, c, g, or t
  misc_feature (331)..(331): n is a, c, g, or t
  misc_feature (338)..(338): n is a, c, g, or t
  misc_feature (343)..(343): n is a, c, g, or t
  misc_feature (376)..(376): n is a, c, g, or t
  misc_feature (382)..(382): n is a, c, g, or t
  misc_feature (388)..(388): n is a, c, g, or t
  misc_feature (394)..(394): n is a, c, g, or t
  misc_feature (396)..(396): n is a, c, g, or t
  misc_feature (400)..(400): n is a, c, g, or t
  misc_feature (406)..(406): n is a, c, g, or t
  misc_feature (410)..(410): n is a, c, g, or t
  misc_feature (430)..(430): n is a, c, g, or t
  misc_feature (432)..(432): n is a, c, g, or t
  misc_feature (442)..(442): n is a, c, g, or t
  misc_feature (444)..(444): n is a, c, g, or t
  misc_feature (473)..(473): n is a, c, g, or t
  misc_feature (490)..(490): n is a, c, g, or t
  misc_feature (493)..(493): n is a, c, g, or t
  misc_feature (496)..(496): n is a, c, g, or t
  misc_feature (794)..(794): n is a, c, g, or t
caaaggaccagtctgcagagggatcctgtggctggtaagcgaggtagtgctcnacacggccgtttgcagctaccgtagcnannatctgggcattcangcanggttattgacccctccgaggctnttntggtgtntngntgctgntttnaggaaccctaatgcntgaangatgnttatatgtngntgntcnttggggtgcgccaccnaccagggccgcgtggagatnttctacagaggccantngggcactntttntttataacntgtgggacctgactgatgnnagtnttgtntgntgggncctnggctttgatgaactccacccatgctntgggcanagctncctttgggcaatggatcaggccccatcatgctngatgangttcantgcacngnaacngaggcntcanttgctgatttttatttcctngnctggctgaanancaacttcaggtacgatatatacgctggtntggtctgcaccaatganatnatnatcacccacaccctgggacctctccagggagctctcggaggcccttggccagatctttgacagccagcggggctgcgacctgtccatcagcgtgaatgtgcagggcgaggacgcctggcgcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaagatttgacatcaccctgtcgtcagttaagtgcttncacaagctggcctctgcctatggggccaggcagctgcagggctactgcgcaacctctttgccatcctcctcccccaggacccctcgttccagatgcccctggacctgtatgcctat

SEQ ID NO: 627088 - DNA, 149 bp, Homo sapiens
ctacagctacctcagtccaggctgcctgctgagatcctgtctttagctcacatacattccacggttgggggacacatttagtccagacaccgctgtggagattagcattttagtttatttcgcccactgctttaggcagtagtttagga

SEQ ID NO: 627089 - DNA, 1085 bp, Homo sapiens
  misc_feature (601)..(601): n is a, c, g, or t
  misc_feature (778)..(778): n is a, c, g, or t
  misc_feature (880)..(880): n is a, c, g, or t
agcgggaattagtccgagtggagagaccgagctgaatggttgtgtggtcgcgtctcgcaaaccggtgacgctcgctgcttggctgaccaagtgagtgaaaagcacatgcagacttcaaccagcaagcttttccactgatttgacatagagaatgggctgatggatactataaccgaaacaataggaggagactgtcggagaaaacgttcgtaccgtcgaagatactgctgtgaggcgacgcaaaatcttccacgaggacaggccgagatgtttcatcctcggaaccattcggattcaagttggacagtcaaaattcgctggacttgcgtacactgagcacaacattgtagctttgccctggaattcggcttgcaacttattgactggacatagccaacaaagtcgagaacgttagcgagccagtaagcggagctggcagaggcacaagcaacacatctatgcaggagaagtccattatcgcaggtgcttcgtgttagactccacaagggaactcgtggcctaacttggcgcatcacttcaactgtcaagcctcggttcttggcgtgggagaactgtttcgcccgaactgctgtattggagnacaaaacccatttggcgcaggcaggtacaggtttgacatcaggaatggaccaggacacgttctcggactcgcacactgtggcatgcgcagcgccgcaaaaccacggactcactgtgaacttgagttgcaccttgggttccagagagtccacacaacgttccattgccataccgcagngtttcttggtagactttaaaccatgtgggacttgcaaaccgacggctccagaaaaagctcgccagaagcaatccttttgtttaccgaggacacattatgttngctatcgagcacactttctcccttgtggttagtacacacccataagtgtgggttttctcatttgtgggcccgcttttttctccattggtagggtgtgtgggtatcacctctctggattcttctgttcattggagagcggtttgttcttcccccgtggaactgggtcgaagaccacaacaagaaattcattgccgagttggtaatg

SEQ ID NO: 627090 - DNA, 352 bp, Homo sapiens
aatacaccaaaccgttaatgaaaactttgatgtcaaaaggttatgagttgaatgcagagaaaatagagcattccaaagccgaaatgcagcgtttaattgaagtattgaatcagaagttaattgctaatcatggacgttactttgtcggggatcgtttaggtttggcggatattgctgtgtgttcgatgttagcacctgtgctggagattaaagggacaccttgggaaaaagaccatgaggaaagtctatctgaagcatttagtgcttataaaacctatttaaccaatttacccttggggcagtatgttttgtagacgcggccgcgaatttagtagtagtagtaggcggccgc

SEQ ID NO: 627091 - DNA, 356 bp, Homo sapiens
  misc_feature (43)..(43): n is a, c, g, or t
  misc_feature (118)..(118): n is a, c, g, or t
  misc_feature (122)..(122): n is a, c, g, or t
  misc_feature (127)..(127): n is a, c, g, or t
  misc_feature (198)..(198): n is a, c, g, or t
  misc_feature (213)..(213): n is a, c, g, or t
  misc_feature (223)..(223): n is a, c, g, or t
  misc_feature (254)..(254): n is a, c, g, or t
  misc_feature (272)..(272): n is a, c, g, or t
  misc_feature (349)..(349): n is a, c, g, or t
gaatatgaaggcccactcacagactgaccgagcgaacctgggnaccctgcgcggctactacaaccagagcgaggacggttctcacaccatccagataatgtatggctgcgacgtgggnccgnacggncgcttcctccgcgggtaccggcaagacgcctacgacggcaaggattacatcgccctgaacgaggacctgcngctcttggacctgcngcggacatgngcagctcagatcaccaagcgcaagtgggagngcggtccatgcggcgganagcggaagaagtctacctgggaagggcccggtgcatttgacgggctccgcaagattaccttggaagaaccgggaatngagacgc

SEQ ID NO: 627092 - DNA, 365 bp, Homo sapiens
tttcgctccatagctgagactctgattgacaaatctgtccagctcttgaatggttcttgggaaccagggcactgtgtcagtcttgttatctcgtgaaagctcatgcacagtggcaccaatgtcatgcctcaagatctcgataatgtttgtcagagcaggcaggctacgtttatgcatatgagtgagtgattcatactcatctttctttaaacgagaaggtctagattcaatgtaagtcaggttcacatcattctcctcagataagcgcaatactttgggattacagttgtcttcaatatagcctgtttcctgtccaaagtcagatagtttcatgcacaagcctgggttttccaggaccgcagtgg

SEQ ID NO: 627093 - DNA, 125 bp, Homo sapiens
ttaaggatccctgtggagacgggctctcacgatgatcaacgagattgagacatcctggccgacacagtgaaaccctgtctctactaaaaatacaaaaattagctgggcgtggtgcgcgcctgtag

SEQ ID NO: 627094 - DNA, 365 bp, Homo sapiens
  misc_feature (96)..(97): n is a, c, g, or t
  misc_feature (138)..(138): n is a, c, g, or t
  misc_feature (180)..(180): n is a, c, g, or t
  misc_feature (183)..(183): n is a, c, g, or t
  misc_feature (187)..(187): n is a, c, g, or t
  misc_feature (194)..(195): n is a, c, g, or t
  misc_feature (199)..(199): n is a, c, g, or t
  misc_feature (337)..(337): n is a, c, g, or t
tcttcatgccgtacacagtcgtggtaaacatatatttcacaggtgtagaagccagcaactacttggctgttatttgaaaaaacgttcatacgtttnnctactgtgatttgtatgaaaggtaacatcaaatcaaggtanatagattcagtaaagtcagtagtgttcagtaagatgatgtanttnaatntgtactnngganggttgatgagaacaaagtgggaaaacttgtaaacattgcccagattgtggacatagggttttttccacaattgttggtcttaccttatgcttgagcttatagtgatgttcttgtgtccatgtgtttatcttggtgatnttttctatagttgggattttcttggtgt

SEQ ID NO: 627095 - DNA, 601 bp, Homo sapiens
cgggatgtaagacccagctgatttctgtatgtccgtccagttgtttgcacttgcagactgtgagcaacagtctaactctctaaaagtggaacattgtggacagtttatctatggaaaacttcattaatactggtgccagcccattgaccagacacttgtagattaaccgctgacatgggtcacttaattgagtacaagatcacatgcagttgctttcatagtagccgatagccaatggatctttagccattagccccatgatttattatgcccatttcagtacatattgcaaaactgccattggaatgcttaaattaggcttgttgcgatgcttcgtgcctgtaatcccagccctgtaggaggatgaagcagcaggatcgcttgaatccaagagcctgtaaccagactgagccatagtacagcctagtctcttgcccgactcttcctacacgtagttgactatggtggcaatgtgctgtgagcccattggcgacccaagttctggtcgcagtatcgtttgagccacataggctcaggcataactgcattctaacatgccatcccagtgagaccctttccagctttgttttgcgggtttgct

SEQ ID NO: 627096 - DNA, 169 bp, Homo sapiens
ggatatttggatagctttgaggatatcgttggaaacgggattgtcttcatataaactctagacagaagcatacccagaagcttcattgggatgtatcaattgaagtcacagtgtttgaaccagtccctttcatagagcatgtttttgaaaccatctttttggtagtatc

SEQ ID NO: 627097 - DNA, 345 bp, Homo sapiens
  misc_feature (76)..(77): n is a, c, g, or t
  misc_feature (118)..(118): n is a, c, g, or t
  misc_feature (160)..(160): n is a, c, g, or t
  misc_feature (163)..(163): n is a, c, g, or t
  misc_feature (167)..(167): n is a, c, g, or t
  misc_feature (174)..(175): n is a, c, g, or t
  misc_feature (179)..(179): n is a, c, g, or t
  misc_feature (317)..(317): n is a, c, g, or t
cccatgctacagtcgtgagctatattcacaggtgagagcagcatctggctgtatcgacatcaacttcatacgtttnnctactgtgatttgtatgaaaggtaacatcaaatcaaggtanatagattcagtaaagtcagtagtgttcagtaagatgatgtanttnaatntgtactnngganggttgatgagaacaaagtgggaaaacttgtaaacattgcccagattgtggacatagggttttttccacaattgttggtcttaccttatgcttgagcttatagtgatgttcttgtgtccatgtgtttatcttggtgatnttttctatagttgggattttcttggtgt

SEQ ID NO: 627098 - DNA, 589 bp, Homo sapiens
gctgtcggcaggagcgacatgccattgactgccgggcggagtatgcctcgtcatgctggtcctgctagagcagctgggccttgccggtggcatgacctggctgtgcccccgtgtgtgtacagcagcagctggagctgtagctgggagctggctgcttgcgtggaaatccgcaaggagctgaagctgagggagtggtgctgagaacctgcgtgcgggccaccactgaccttggcctgcatgccttggcccctgtagatgcttgctgctgctgtgggctcctctgctgcctgcctcgacctgctgcaccatgcagctgcatgtgagctgcacgcccactgtatgtgcttccctgaccctggctggccacccacgatggcccccagtcccctgtgctgtggtttgccccacctgctcggccaccaacctgagccgctgttggcgggcctggagaagcagttggccattgagctgaaggtgaagcagggggcggagaacattgatccagacctacagcaatggcagcaccaaggaccggaagctgctgctgacagcccagcagatgttgcaggaccagtaagaccaagattga

SEQ ID NO: 627099 - DNA, 693 bp, Homo sapiens
taagggcccatttgagtatttggtttccaattagggaaatagtgggtataaggattaggatggtggtggaagtatagtacggatgctactggtccaaggagggtaaaggggtagcttacgggtggtcctccgatccaggttaaaatgaggaggtctgcggctaggagtcaataaaggtgatgggctatagggggcaaaatataatgcttggtagttgggatatatggaggatggggattatggctaggatgaggatggatagtaatagggcaaggacgcctcctagttggttagggacggcactcggaaaatggtgctaggcgacatacggaacatatcatgcgggctcgatgtgggacaggggtgtaaaggggtgggcaagggctataatgggtcggggtccgccaagggaggccgggtgagcaactccgtgtcaaggcacaattcaacggagcacaagcgcaccgaacacacgtacagccgcaggcgccgcccccgacatgcgcgtaccacagggagaacagggtgcatcgcaaccgggaagaggcaacgcgcgcacaccctaacgggggaggactgggacccccgcatcgcgggcacaaacatccggacagtgaacagagccgccaaagcgggcgcaacaacccgcacgggaacagtcgccccgaccagggctcaaaacaacgcgcaccg

SEQ ID NO: 627100 - DNA, 128 bp, Homo sapiens
  misc_feature (5)..(5): n is a, c, g, or t
tgtantggtagcaatgctcactgcagctccaactcctatgctcacgttctcctcatagctcagctcctgagtagctgggactacaggttgtgcaccaccacaccttgctaatttttgtatcttttgta

SEQ ID NO: 627101 - DNA, 870 bp, Homo sapiens
ggatcttatatttatttattatttaatttagttttagaagacagggtcttgtcctgatgcccaggctggagtacagtggcatgatcatagctcactgtggcttcaacctcttgggctcaaagtgatcctcctgcctcaggctcctgagtagctgggactacaggtgtgcaccaccacacctaggtatttttatttatttattttttgcctcacactctgccaagtctcaatgcctggctaattttaaaaattatttgtagaggccacgtgaggtggctctcacctgtaatccagcactttgggaggctgaggcaggcggatcatttgaggtcaggagttcaagattagcctggccaacatggtgaaaacccatctctactaaaaatacaaaaattagcgggcgtggtggtgggcacctgtaatcccagctacacgggaggttgaggtgggataatcgcttaaacccgagaggcagaggttgcagtgagccaagattgttgccactggcaacctccagccctgggcgacaagagctagatcctggcctcaaagaaaacaataaatttcgacccaccaccgggcaaaaagggggcccggcgtaaggtgccccaggcgggcacttacaaccctggcgctcaagacacgcgtctaacctgggccccaaagcggcggggacaccccggctgtgcaagcacaggacctcggctagaagagacaagctaacagcccagcaactaccgagcagccccggcgggtggcggactcagcccaaactggacgggtcaggcccacggccgcggaggacgggcagccccgacagtgaccctgcacaacaggcgagaccaacaaacgccgtgcagtggccaccca

SEQ ID NO: 627102 - DNA, 140 bp, Homo sapiens
ttttacatggagacctctgtacggtcttcagagtactgcccttgggaccgttcatcagctccagtgtatccaggtttgctgtgaactttcagactgtggcttcagttggcaaatgacattgccgttccacgttcaacccg

SEQ ID NO: 627103 - DNA, 118 bp, Homo sapiens
  misc_feature (104)..(104): n is a, c, g, or t
taggaggcacaggctatattggtgtttaggtggtctaccaaagcaccagccacagatagcttcgttaaggtcactttctcgtacctactggggaaacttccagncagacagccgtgct

SEQ ID NO: 627104 - DNA, 299 bp, Homo sapiens
aaattctcctgcctcagcctcccaagcagctgggaccacaggcatcccgctgtacgtctgactaacttttgtaaaaatagtagagacaaggttcaccatgttggccaggctggtctcaaactcctgacctcaagtgatccacccgcctcagtctcccaaagtgctgagattacaggtctgagccactgcgcccagccatgctgtgtgctttttagcattttcttcagtttttgttgcaacctatgagtcaggaactcttattatgctattttacctaggaggaaaagagcattcacaga

SEQ ID NO: 627105 - DNA, 392 bp, Homo sapiens
gcgtcgacaattccacaaaggtggaaacaatccaaatggccatcagtggctgaatggaaaaaacaaaatatggtatgatgcaatgctattcagccttgacaaggaaggaaatggacagggtgtggtggctcacgcctgtaaccccagcactttgggaggctgaggtgggtagatcatgaagtcaggagttcaagaccagcccggccaacatggtgaaaccctgtctctactaaaaatacaaaaattagccgggcgtggtagcaggcgcctgtaatcccagctacttaggaggctgaggcaggagaatcatttgaacccgggaggcagaggttgcagtgagccaagatcgtgccattgcactccagcctgggctacagggcgagactccatct

SEQ ID NO: 627106 - DNA, 173 bp, Homo sapiens
gacaactacaatcttgctaaaggtttcaattatcaccaaggacctctaagaatttcatttatcttctgagtttcagtttaaattatttttcagtaattttaggtattatggtttgctcgtctcttaataatctctacaggagtcgctgtagctataggtatatcacgtgcaaa

SEQ ID NO: 627107 - DNA, 232 bp, Homo sapiens
agctgggaccacagttgcatgccaccacacctacctaattttgtcattatttgtagagacagctactgcctatgtttcccaggctgatcttgaactactggcctcaagcaattataccaccttgaccttgtaaagtgctgggattacagacataagcatccatccctgtgctgttatttctttttaatgaaggcatttatagctataaattttcctcatagcactgcttttg

SEQ ID NO: 627108 - DNA, 262 bp, Homo sapiens
cagaaggatcagttgaacccaggagttcaagaccagcctggccatcatagtgagacaccatctctacaaaaaatttaaaacttagccaggcatagtggcacactcctgtggctgagataggaagatcgcttgaccccaggaggttgaggctgcagcaagctgtgatattgccactgcactctagccagggtgaatacaggaagaccctgtatcccaaaataaagagtttaataaaaatgtctaattcaggtacaagcagttc

SEQ ID NO: 627109 - DNA, 164 bp, Homo sapiens
aagggccctaatccccttcatgggggctcccccttttcccctttaaaaggccccccctcaaaatgctttccccttggggattagggttttaccctttctaccttgggggtgggggggcattacccttccgcccctccttgaggggtccctttttttttaaccca

SEQ ID NO: 627110 - DNA, 1346 bp, Homo sapiens
cagtggggggtcccccacgtggcgcacccctccggttggtgtggagttgtggtttattgcgccccccggtgtgttgttttgtctgctccgcgacgtttggtgaaacctgacgcccccctgtgccactctccgggggggcgttctcccgggtgtcctgttgttgccaccaggccgctttgttggttggggagaattgccgttgtgtcctccttctttcgtggggtgttgaataagacccgtgtgttcttgcccccgctgttgtgtcttcggggggagtccccactcttgtgagagaggggtgttctttccgcaccaatatgtgggcgcagtgaggtgttttcctccaagatggtggcagaaaatttgggggcgccaagaaataatactcggggtatactacccagggccgcccccctttattataagagggaaacaccccctagatgttccgctcgattgtgggtatatagtaggggatgatgtaaatgtcttcgtttttctccgctaaaggagatgaactactgttacaatattgtgtttctccctaatgtttctcacaaagtgtgtcctcctgttgtcccacaacattaaagaggtgaatagacacccactgtctcacatgtgtgaagagtgtctctcaaactacttttattagagaatacacacacaaaagtagtctgctgtgtgtctcacacctcatatagagacagtctctcacacaggtctccgcgtgttttctctcctcccgcataacagcgctgtgtgagacaccccacacacaccctccagatccccgctgggggtgagacccagagaagagtgtgtgtgtctccacaatgttgtaaggaggtttatagagaacacacaaagagagtgccccgctgtgagagatgtgttgtttatgagagagaagtggctcttcctcgagagagagtggggtgtgttggtgttcccttttgagaccctcggccgggttgagacctctcgggcgccacactcaaggagttcacagcccgcacctctctctccacaggagagagagagaggcgccttcccgcacttcacaccgctcgtaacacagtggcacaccccacggccctgggcacactgtcccgcccctctggctcacggcgtatccttttcccactggcacacttctgaacgctatactggaaatttttggttttctgaaattatactggctgtttaaccctcccgcggagatgtaagacccctcccgggcagagggcttgtttcttgtgttccagatgctgccatccccgactgctgggccccgtgccctggtccctggccggttccaataaataactgtttggatgagtgta

SEQ ID NO: 627111 - DNA, 190 bp, Homo sapiens
tgcccggcgggtggcgcgctaacatcaatcattttagggctaattgtgtgcccgccccgcctgtggggagtggttttcatatccttttttcgcctattccggccttccggtagaggtgtgtactccccgtgtgcttcgaacacaagtctcaaataaatgtacgggtactctttattaaccacgaataatt

SEQ ID NO: 627112 - DNA, 974 bp, Homo sapiens
ttttttttcgtactataactgctgagatattagtggatattgtggacaagactgagagaaaaaaagacaacttggtcgggctcgatatctcggataatatttccgtttccgagattgttggaaacacctctggctgtatttgccactttgtggtgcctatacaggctgggagtcacattgcgcgaaaggttcccttgcaaggtacccgcattagtacccacggtttataccgtttacaagccaaggttcccgtgccgaattttgttcccttacgggcgcgcgcaagttcatggtccaagcagaagccgcgatataccgcaccccaggggggcttaaattagctgttcggccactttgggcagaggcgagccagctgtagctccaggcgcatggggcatccaaccacgcggtgaggttgcaccaccgccaccagggcgccgcaaacagtaataccgcacccctcccgggcgcttaaaaaaatcggggtgcggccccccgcatccagaatagaaatattgcccgccccccgatgcgctcaatccagtaatatatcgcgagacccgaacatgaacccgtgtggggcagacaaatacgaaagtaagcatgattttgtggcacaaaccagaacacaagacggagtgatagcgtcgcgcccctcatccgacacccacattgtgggacacaccccttgtgcttcgagttctacaaattagtcggggttttcaagcgtacgccgcgcgtgcgccatttggccgcgcatcacacaatcacagaacacataggggtcctctcagaaaaaccacgcgacattgtctcgagataccgcctaacacccaacgagatcttccccgatgtaaacacggaacagggggagaacccctgcggcacgcaacgtgtaatgatgatctgggacaaacctccgccagagagaatttcccaaattctccaccccttccccaaaagggaacataaca

SEQ ID NO: 627113 - DNA, 111 bp, Homo sapiens
agttccatcgcgtcaccattttgtgttcttttcattttcttctctcttttctttttttatttttttctgtttttaacacactggggtgtcaccgtgttgccaggctggtct

SEQ ID NO: 627114 - DNA, 224 bp, Homo sapiens
agcggggccatcagccccctcggctcggctcgaggggcgggagctgcgcgcgcccatcggtccgaccgacaccctccccttcccgcccgtccgcgcgcccgcggccgcggccgcatcgccgccgtccttggagagcgagccggaccagttaaggaagcggagagagaatagaaagaagaacaacctaaaaatcaaaattaaacaaaaataactaaaatataacc

SEQ ID NO: 627115 - DNA, 183 bp, Homo sapiens
attaccagtgtaactagcactcctccaatccataagaagtctatgaactatgacaaggagctgtcaataatgtctatctgtgttttaccctaaacatgggttcagtggtcatgtctgcgctggtgttgaaacactttttcacaaccaatgattatgtatgtgattaaaacctcggaaatggac

SEQ ID NO: 627116 - DNA, 208 bp, Homo sapiens
ggcgcgcttatcgcgtcagcgatctcttgctcagctcctgagtagctgggattacatggtgctgcaccacatctggttaattttgtgtgtgtgtatttttagtatagatggggtttcaccatattgggcaggctggtctgacctcaagtgatctggcctcccaaagtgctggattacaggcatgagccacctgcgcccggacttccta

SEQ ID NO: 627117 - DNA, 497 bp, Homo sapiens
atggtgtatagaggatccttagctgagtccagtcagataaagatcctggagaacagctggaggagacaaaggctgtactgaatgcagctgtcccagatccaggactgattggagtgtggaggagcagtggccagctagctgtgagatggaagaagaagagccaggagtaccagatcttgctggatgtgaagacgcggctggagcaggagattgccacctaccgccgcctgctggagggcgaggatgcccacctttcctcccagttctcctctggatcgcagtcatccagagatgtgacctcctccagccgccaaatccgcaccaaggtcatggatgtgcacgagggcaaggtggtgtccagcaaggagcaggtccttcgaaccaagaactgaggctgccagcccgggtcaggcataggaggcccccgtgtggacacagatcccactggaagatcccctctcctgcccaagcgcttcacagctggaccctgcttaccc

SEQ ID NO: 627118 - DNA, 241 bp, Homo sapiens
gtggagttaaagtcaccgcagcggagatggacaaaccatgtgggtgccctccaggtgttttccaccatgaaatgggagattagcaggacccacgttggccaaccgtgggacctggtccctccagtaggagttgttagccaactgaatttgaatgcaaagatggagcaagggccgacttgagttacacttacataccaccccccatatacatagggggacagatcaaggaaacaagcaggag

SEQ ID NO: 627119 - DNA, 511 bp, Homo sapiens
agcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacggctgtaatcccagcactttggggggctgatgtgggtgggtcacagggtgaagagatcaggagcatcgtggccaacgtgatgaaaccccgtctctactcaaagtgcagaaattgactgggcgtggtgacacaggcctttagacccggctactcgggggactgaggcgggagaatcacttgaacccaggaggagggggttgcggtcggtcgacgtcacgccattgcactccagcctggcaacagagcgagacgtgtcttta

SEQ ID NO: 627120 - DNA, 260 bp, Homo sapiens
ttccccctaaaaatcatgaaaatttgagaccattatatatggattacttcaaaaatgtacaaaagtccataatacccattcttccttccccccatcagtgtcagagtatgaggtatctttcctgttattaagggacattttaaaacccgtcctttaagtttatgatgtgtgatacacacacacatcataagaaggcacatttggcatttctttgtgttgttccccccccacctttcaccaacctctactcaattatttat

SEQ ID NO: 627121 - DNA, 974 bp, Homo sapiens
atcctgaaagcaacataattcttccttccctcctttgaaaatcgtgtgtacctttagtgcagcaattactcactaaagggcttcatattagtccagatttaaagtctgtgtctgcatctaacttagtgcctcggtttatttgagcccgagtatctggatcttatcatggtaaagcaatataatcgtactggagacccagaaattatttgggtcctggatttctgaaaataggtgggggggcatattatgaaatttggcaagaaactaatggctgtttgaaggtcagcagattgttattttataagatctaaaaattgatgctggtgtgattcaccggagatgttattcagagcgattccgagtaatgagttggagaaatgtgtgtcgacacttagcgaaatttatatgaggagccaattatggagggcttctgaggtgcgtgtacgatgggagaatgtgtgagtatccccgttgaggaatgttttttggctcgcgatgaggggggagagattagaggcgattacgggataactcacgtggggtgaagagcacacattgcgcttgcaggttaggcacactgtgtggtatagtagtcagaacgcataggtgagggctctctggaggggcggcattcctggataaaaaacagtggccctatacaccttcgtgtgtgtcactctggagacctactgagatgtcactgaaagggtatgaagagacgcatgtctgcgggaaacaatgcccaaaaccaaggaaaacgggctttgtaacaatccggaatgacatccggcacgcccccgttgggagcccgggtaatcggacataagtgggtcccccaagagggacacgacaatcccagagcactggcaagaggaagagaaatccggggtcccacaatactattcggacccgcgacggcggggagggagcctccacacaacgggcaacagactaagagggcggcgggaaattcc

SEQ ID NO: 627122 - DNA, 773 bp, Homo sapiens
  misc_feature (16)..(16): n is a, c, g, or t
  misc_feature (77)..(77): n is a, c, g, or t
  misc_feature (80)..(80): n is a, c, g, or t
  misc_feature (91)..(91): n is a, c, g, or t
  misc_feature (125)..(125): n is a, c, g, or t
  misc_feature (137)..(137): n is a, c, g, or t
  misc_feature (141)..(141): n is a, c, g, or t
  misc_feature (152)..(152): n is a, c, g, or t
  misc_feature (165)..(165): n is a, c, g, or t
  misc_feature (176)..(176): n is a, c, g, or t
  misc_feature (182)..(182): n is a, c, g, or t
  misc_feature (189)..(189): n is a, c, g, or t
  misc_feature (195)..(195): n is a, c, g, or t
  misc_feature (200)..(200): n is a, c, g, or t
  misc_feature (213)..(214): n is a, c, g, or t
  misc_feature (246)..(246): n is a, c, g, or t
  misc_feature (248)..(248): n is a, c, g, or t
  misc_feature (252)..(252): n is a, c, g, or t
  misc_feature (258)..(258): n is a, c, g, or t
  misc_feature (353)..(353): n is a, c, g, or t
  misc_feature (380)..(380): n is a, c, g, or t
  misc_feature (394)..(394): n is a, c, g, or t
  misc_feature (422)..(422): n is a, c, g, or t
  misc_feature (435)..(435): n is a, c, g, or t
  misc_feature (438)..(438): n is a, c, g, or t
  misc_feature (462)..(462): n is a, c, g, or t
  misc_feature (472)..(472): n is a, c, g, or t
  misc_feature (500)..(500): n is a, c, g, or t
  misc_feature (556)..(556): n is a, c, g, or t
  misc_feature (582)..(582): n is a, c, g, or t
  misc_feature (640)..(640): n is a, c, g, or t
  misc_feature (659)..(659): n is a, c, g, or t
  misc_feature (731)..(731): n is a, c, g, or t
gtgggactcagttcanacccccttatgaccactcttgtgtaaggcactgtgccaagggagaatggaggggggcaggnggngggtgggaggnggtcatgggggacaaacagaggtgggggtcagcnaaggactggggnaggngtcctccacangcccagtgccctnctgcacaacancctcanccccccncgccgncctcnggcctggccaggnncagacactttccagtgccccgaaataacagtngntgcngccccngccccctcctgccctggcacctgtttctactctctccaccaggtgggtgagctaggcagctctgggttattagccactgggggtcgctgcctcgncgcctccctccctcccccggtaagccngattttaccctccnttccctttttccggcttccctgccacantggtgctggtttntgntagatctgtgggccagtttggggngtgacctgcncccacacgcttggtgccctgggggtgcntgggccagtgttgcaggaggctgaccgctgggggctcctccatccgcacgcggatnacctggagatccagtgtcccgcggancccggaggggaagctggagaggggctctccgcccggggaaggcctccttctgccactnccctgtttttgggtgagtncttgctgtctgggcccctgagctgggtgtgggagaagagctgcaagacgaagccggcggggaagctgccgtnagttaagtgtcggacctcggctggtgctgcgaaagtttccgt

SEQ ID NO: 627123 - DNA, 775 bp, Homo sapiens
aaggctgtacggcccggatgtaaggagtgctggctaatttttgtattctagtagagacggggtatcgcatgtaggccaggatggtctcaatctccatgactacgtgatctgaccgtcttggcctcccaaagcactgggattacaggcgtgagccaccacgcccggaccactgtttgtgttttaaagtttttcttagggtttatggtttttaatacccccagagagtactagacagggtttatttttatcttattttatttatttattttatgagacagggtcttgctctgttgcccaggctagagtgcagtggcctgatcttggctcattgcagccttgactctctctaggctcaggtgatccttccacctcagactcccgagtagctgggactacaggcgtgtaccagcacacccggctaattatagtatatttgtagagacggggtctcactgcattgcccaggctggtcttgaactcctgggctcaagtgatctacgccgccttggactctcaaagcactgggattataggcgtgagccacttgtgtccggtccctgtaggtttagatgttttttgggcacggaaatatgatactatggcccaggcaggaactcgcaatgggtcgctgacaaccagagaccacgtgccaacaacgtgcactactcggagatccaagcaacacatccagccctgggacctacccgaagaagagtggaataacaaagagagagcaaaaaacacaccggaaacagtacaaggacacaacgacaag

SEQ ID NO: 627124 - DNA, 135 bp, Homo sapiens
agattaatgattacctgagtcagagccatcaagaaactaagaggcacttggcactggcttcggcatcatccctgatgggcgactcgtaactcattcattcagttcctgttccaacccattgatggctcacgccgg

SEQ ID NO: 627125 - DNA, 779 bp, Homo sapiens
ggcagaagatggccgctgtgcgcccagaggcccaaagtcggagctcaccgatgtccgagagtctgctgatcctcaaggagactcactggaccttgagtccgtgtgtgcgctgtatgacatgcacgtgacttgtgaagcaccgcgccggagtgacgctcagtcgatggatccaaggttgcgtgatagggtgtacggaacactctactgctgttgtcccttgatgcacccacggaagtccagggttcatgttccagactgttgccctttgtggcccctgcttgctcgtatcccggccgtgtgttatccggaagcttggcgtggttcccacggacactatgtgcacagcttgggccatggggtgccagaagggtgaaggctgtgggcaagcggtggtgaggaacctctggagacacgtgttgcacactgattgcttgcagagctcaacaagacgtgcacctgggagacacaccggctacaggacacatgacagctgcagacaacttaaccagcgtgtgacaacaacacggagggaaagcgggcacactaaccggcatgcacgcgagcatctgcacccacgcgaccattttcacagagcacatatgggatgaccccccatgaggttcccgggcgaccaagacacccgaggcaacgggaggcgtgggcacgcccgggacaaccatcatccgggaagagccctcccgggaccacatgacgagcgcggctggcaggcaagcaagaagggcccggcgggttgggccccccggaagaggggcagcgaa

SEQ ID NO: 627126 - DNA, 708 bp, Homo sapiens
ctgctgtcaccagcgtcaccctgcccggctcctggcatctgacttcttcgctctaggcggtcgcctatcgttatagcacgtgctgcacgagtcgcttcgtccgtgatataactcagcatctacccatacaccaaatcgtcccccatacaacaccaagtactaaagaacttatgtcatccattgatacagtatgaattttctccactccacttaaagaccttaaaatgagggctgaatgtgtagagaaaagtttcgcctgtgccataatagtggtcactgaacttgaaaggatgagttgcatgtgctccaaaaatctgattatccatatctttgatgaccaataggacaggactgtctagtgatgccgattaccggtagagcgtcataaagctggtcccgtgctctaacgtgctataggccagtctccatggatacccttgcacccttgcaggaaggcgtcgggccagctgctcgatgtgcatattctccaggagcgcgctgtgaggccgtaggacaggcagcacctcttcgtcctcgtcttcatagtagctgcatgtgatctacctgcgctaagcctcttcaccagtgataatctacacaaaaggatctacgtcaggtctggaacaatagaaaatctagatttccccttaaaatggaagacgggaacgaacacaaatagaacatggcctacaacaccaggggacaaaa

SEQ ID NO: 627127 - DNA, 251 bp, Homo sapiens
gaacaaggcaggttgcccttgggcacgtccagcctcaactacttggaccccaggatcagcattgcctggtgcaagcggttcagggtgccagtcgagaagatctacacaccaacacagcgggagaggttcgcctccgtctcgccatggcaggagaagactttgaattctaacgacgagccgcgttgaaacttctttcgcatgtgtgtgtgtttttctcactattaaagcagtcctggggaattttgtacaat

SEQ ID NO: 627128 - DNA, 634 bp, Homo sapiens
gggacactgactagacttactacgtgaaggaggtctcttactatcaacaggttaattcaccatttcaacaaatctctcccggcagcctactaagctttttctttaattaagtacctgatttacacagcagattttactcattggaggactcaagtcatgtctaaacagataaaggtatcagctcaggcatagttcaggtacctggtaaatgcaatcagagttgttctgcagggtaattcagttttagacatccatttctaaaaacgtgttctgtctgaaaatggaggccttaataaccaatttctcgttattcagaggccagttatctagtatatttatcaagattaggcagtcacctggtttttcactcctttctaatctctctgactgtttggtggttttaaactcatgagtaagataaggagaagaaaaacagagaatgtacataaattaatggctaaaatgaagtgttccttggcatgtttctttttcttatgctttatttctgtgactcatacggagctgttagaagtgacttcatataatattatacagtgtaataaaatgggtttcgatgtgtgaggatccctcatgttattagattatggaacaattagaactcagacagaatatt

SEQ ID NO: 627129 - DNA, 98 bp, Homo sapiens
atcactttggcttcgaagccgccgcctgatactggcattttgtagatgtgttacctactttcttgatgtcctcatttagcctcccttctctttttctc

SEQ ID NO: 627130 - DNA, 792 bp, Homo sapiens
  misc_feature (367)..(367): n is a, c, g, or t
  misc_feature (662)..(662): n is a, c, g, or t
ggtagtccaggatttggttttcggtggtcggttgggagaccctgcatctttgcccgtcccagcctgtgggtgagggcagaagtcagccaggcaacctccccctgctctgggaggggcttaggacaggacagaccatcctgccaccgatgccttgttcctgagcctttgctgggagtcgccaggcaggcgcttgtggaaggaaggtgtcccttaaccccactgccttgcccaccggacagctgggacctttcctcagcaaccagtggatgcggacgttgagctgcctgggtcagtgcagctggccgggccccggagcctgggtccactctggacactgggctgtgggccctgtggctggcccaaaggnagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctgncctatgtcgactctgcagggctggcccgctggagaagcagtggtggggagtggcctggctcgctggagaagcagtggtggggagcgggctggcccgctggagaagcagtgcccaggctgagcggccgcaa

SEQ ID NO: 627131 - DNA, 980 bp, Homo sapiens
aactcttagatccgacgagcaaggcaatggcatgcccgtccctgagcacaaacgaaaggatggagtgcttccgtgcgtgatgacacagacatggcacattataggatcagatagccgcatgtgctagtactcagcaaaatctcagaagatgcagatccgaccctgtgcaaccgagaggttgtcgccgcaactacaataggtgcgggaatggcgacaatgcgtatgcgatggacattactccttagtgatggataagacgaaaacactcatatctccgaggagtataccgacggtagtgtaccagtatgctgaaatgtccgagtgggcgagtgcctgggacagaggaaggtggtcaacttctcttaatgctagcctgacagtatgaccatataaggggcggtaaggtcgactcgagaagtactaggagcgtcatcactggtgcatgtagcatgaccccaacaatgcgctatgcagaagagagtgctagccatgcctatccttgcgtgccttcggtcatgaatcatgtgcagaggggtaaccgtattgtgcagaggctcgaacgacaggcttgggatttgaaccaatgcgtgacgcataggtagagccagtaatatttgcatgggggtaccccccaaatcgtgaaaggtctagctaaaatgaagcgtaaggctatcaacgtcctggttccatggacaagaatcaattaagaagcggagattgtgttgacagaataacgcgtttgatgtgcttcgattatcttggtaaatacgggatcatctgggatggaggatctgattcattgaagatcgtatactgttggaaaaggcttcaaagaggcagatatttcctgtggcccttacaaatggtctttttgcaacgaagggggatggacaaaagaaccaccaatttggggaaggtgtagatgctggcacaggggggaccgaatcaagggctattgaaaaatgaaaagggttacacag

SEQ ID NO: 627132 - DNA, 433 bp, Homo sapiens
tataggatctcgtgcactgctcggatgggtacagggagataaaaaaagagtacgtggaacccatacgaatcccagtgagagagggccagagcaccggaaccagcagtaggaattggaaaaccaggcgtggcttcttcccagaaatctcaggcatcaggaggcagaaacccactccccagactcagcttggccaggaagtgctgctgtgggctggagaggatgggtctaggccaaggtgaacatgcagagagctggctgctcacccttcctccaccccataaagtggtctgagtaacaagagcagctaggcagcgtccaggagccagccctgtacaaggttgggtccctttgactgtgtgaccacaggccggagacgtaactcagggtggagctcaggtcacacctcacttacacacatacgaagcaggtgccg

SEQ ID NO: 627133 - DNA, 212 bp, Homo sapiens
attccggctctctgtgatctgtctagcttttagccacttcctgtgacctcactccctgttgacagatggacattgggcagctcggccttctgcattgatatctgctgtttcgacttggtttgtcttgtccaatggtgaccatagacccaatctccagggtctcatggtatgaagtacaggacgggagattggggaagtgctggggcctgaag

SEQ ID NO: 627134 - DNA, 1235 bp, Homo sapiens
agcgggccgcacacgactcccagtgtggccgaggacggtaagggtgcaggcgaggaaagcggccctgcccttctgtctctgctcccttcgactcgtacgtctgttctaccctccgtctggaaggagtggaacccatgatcgtatgctcggtctgactccattgctagattgagcacatggcatggcatagagaccatcctggtgcactgcgtgcacaggaaagctcgggtgccggatggcacacgtctccgaggaatgagcacccggcggggaccgcggtcacaacatagaaggtggcccgtgggtaacgggcatccaccgaacaggtactcggctgtctcgcccatcgacccgaacgataggtgcccgaggacagggcccacacggtggtccgtctagcgagaccggaaaagccagacgagtaatgatggacacaagcggagagcacacacatgcagggcgtgcagagaggcctgcagagcgtgtgacgcgtgacacctgctgatgtctcatggtaggagcgcaacggcgtgtgagcgaagccgagagaagttcgcgccatggaaggcccgatgagactagatcccagaggccttcatgggccagaggtcttcgcactattcctagattctctcaatgactgacctgctgcagatgctcctctatccgtttgcgcacatgcgctaacttggagatgtccatcccagaagggacgcgctgatggcgcacacaaggagctcatgggaccactatcacgtgctgaacagggtaccccccaggcccgcattggaattgacgaacacagaggcagagttgggatgccccagcaaactgggaagaaacacagacgggagcgccaggcgtccacgatagggtgagatcctagcgggttcgtttccccaattatgcaagggaccattttgcaaggttgccaacgtccttgcccattggggcatatccacaggttcccttataagcgaataggtgcaggtgcagagaagccacggtgccgttttgacctatgggtggcccttccataacgaataaacccgccttggggccacacttaggaacgcttgggaacgccccaaagtgggaagccatttccatgcggttggaacacctagcacgtgggacaccttgggactgtagatttcagcgagactaacgcgcttcaaacgcagggactagctacatcgaactgcgagccaaccggagaacaacaagaggataag

SEQ ID NO: 627135 - DNA, 304 bp, Homo sapiens
tggtttttgtttgaaattgcattcaattggtaaccgaaacataattgtcattttaacagcactgtgtcttcctgtttagggactgttatggttggcgttttacctatggctcctgaaaaaattttaccgttttttgttgttttgtttttaatacagagccctcatattagccattgaagttttgatgttattttttgccttgtgttctgcttatcccctaactattttattcttttttcatgtctagaactttttcttaagttaaatcattctctggatttaaaataaagaaaatttcctttta

SEQ ID NO: 627136 - DNA, 142 bp, Homo sapiens
tgctatagtcacgtgactgagctgtagccaatgggatgtgagtgatgtacaccacttccaggtctggcctataaataccatccgcatggttctcctccatgagttttcctttcccatcccttggcagagatatgggtaccga

SEQ ID NO: 627137 - DNA, 435 bp, Homo sapiens
ggaatgcactcatgaataataggtaagaaaaatatgcatttaatgaaatagtagtcatcaatgtgtacttttggttctttgaaaaaatgtgtttaaggaggtaaaatcttcccctttgtctcgatgagctatttgtttcatagtagcttacacattgaaggcactcaatacctaataaattgtgcattttttgaccttatatctagttcagaagtccataaataaggataaattgtttctagaaagcaaatttgagaaataatgagttaaaaaaagaaaagtggccaggcgcggtggctcatgcctgtaatcccagcactttgggaggccgaggcgggcagatcacgaggtcaggagattaagaccatcctggctaacacggtgaaacaccacctctactgaaaatacaaaaatttagtccggcgttgtggtggg

SEQ ID NO: 627138 - DNA, 150 bp, Homo sapiens
gtatccatcctggtcactgagatcttaattcatactacattgcaagattatcttatgtgtattatagtaaataggagatctacagattcaaggctcctaagagtttgatttggctctgtttggtcctaaaatagaatattgtctctccca

SEQ ID NO: 627139 - DNA, 430 bp, Homo sapiens
tcatgcccagtgctagtatcctgacatagagctattgctcatctcggcagtctacgacgtatttatcaccagtcccacagcactgatatcgagatacttatgtttgtgcacaatatccactgtcatgggattcaatgctgggccctcaaggctcccaacagaaatgactaattctacttggaatctccagcgccttctcccctccctaaactagttccacccaagcccaatcaaaaagtcccagagcagaatctctctcctctcataaatcccctgggttcaatttctacaacttgtctgaagctttttgagggcagacttgcaaagtccttggagaaataagtagattggaaagtttgtgggattgtatattttacacaagttggatgaaaaccaaatgaattgagttagccaaattgaagacaatttc

SEQ ID NO: 627140 - DNA, 303 bp, Homo sapiens
ccagccatcgaggacatctagaaaccaagtgaagagatttcaaggtagcagtgataagccaaaaaaggtaaaaccactgaatcatacaacatgtgagtcactgggcccttaattgagctgttttagtactatactaaccatcgtctaagaattcataactcagtacctgttaggttttctgctccttttgaagatctcttattttattctgttggtggcaagccctacttagtgattcatcctccaattcacccattttggatttcacactttccctaattttgttccaagtcattagctcgt

SEQ ID NO: 627141 - DNA, 971 bp, Homo sapiens
gaaaggagccaagagcatggcgaaaggccggggataagagcagcaggagcgggaagaaaagtctaaaaggaaagccgctgcgaagaacttcaggaggctgcaggcgctgtgggatggtggagacggaaaacggggtgcgatcacccggctgaagagtggctgtcgtttcctgcgaggcttttagcgatttcgggagattgctcatcgaaacggagcggcagaacaggttaatgttcaccgctggtggaaacaggctgcaggtggacgggaaaaagtggggctagttaatgaaaaaaatttaaaaatagagaaagagaggctctgggggatgaagggtcgaacaaaaagcctgtaccgaatgatcgatggagcaaccagcgggtgtattgatcgagcccataggagagcctaatggatggacagagggcgctcattgatgacacgctcccagtctgaaatttgcttcttacttcaaaggaaaacgagagttctcccgagaggattctcatctagcaataatcgagataagacctcagggggagaacgagtacgaaccctgtgaaccagctcctccacaagttaataccaaactcactgtgttgatccaccggaacgaggacgtgtgtctggaaagaaagttagtccacacggtgcatcgcacgagattttcacagacctgatggggcttacgggagatcgtaacacgcacagatggcttcatttgaggcacttgcagatggtcaagtggtcattaaagatgagcagggtcgctcgtacagacgtagagcgagggggccccacagaacaatgctggaaattctggaatatttacagaccggggcatcaacggcgtttgggcacctttcccaaccacatatcggaggggtgcactcccacagggagcttccatcagctaccggaaaggatggcggaccacacacgtctcaggcttcaaaaaccgcggaaactct

SEQ ID NO: 627142 - DNA, 251 bp, Homo sapiens
ggggaaaaggttttttcccctgcctagctaaccagtttggggagagcatggggatcctttttatgggggtgggtaatctggccagtaagattgagacttagttaagattccccttggaaattccttaatgtttattagcttctaactagggttgtaagtcccatgcccgaatttggagatttgggtttttcttttcaggggtttttttccctggggctaataagcttcctaataaatccttgcccgcctta

SEQ ID NO: 627143 - DNA, 102 bp, Homo sapiens
ccgttaaatagtactcgcagtgtgcgctgctgcactcatgaccctcgagattaacggtgctaacccctgtctgctcctccctcccgcagagactggtggcct

SEQ ID NO: 627144 - DNA, 1008 bp, Homo sapiens
acataggacaatggagcatgaggtacttcatcgtataattcatgatgagagcccagtggtatgaatatttcctgtagtgtactggtacagacctgatagaccaaagcaaagtgttcgcgagattacgatgcgattctctggcgagtcgtgcaatatcacaggggccttcgatgcatggagactgcaactcgcaagtgccattcattgtaattctctgcacacatgttgtagggagcatggacagacacgaagattcgtgagcaccgatgaagccatactatggagaaactcttgtaaccttcttcccatgactcgcctaggaatgatgtgtcgacgacgctccatttaaacgtagctctaaagcttcagaggttggttgtaccaaacgatacaatctctgacctgaaaagaaagcacgatttacagtctgctcgagtgctcatagaggtccaccgtctccactgccaagaccccgacgcacggtcgacgtttgtgacgagtgatagtcattggacaatgcggaagcttatgaccttgacaatccgggtagctccgatcgacgtagaacctgcgactctgcgaagatgcgtctcacgattatggaacgatgaagggagatcccagcgtctcatctagccatcgcgggcgacagacaatacgaacagttcgggctccagacaaggccgtgaaatttctgttttaccagactggggtaataatatcttcctcccaacggccacaagaacgtgggggcgtcgtgactacccccccgataaacttatttgagcaaaatctactaacgacgaattaagaacgttgtcccggtgacggaacccaatcgattagttcccagtaatgcctggcttggctaatgcacatgtacggcccaatggcacctttccgagttgatggcgtgcgaaaaccccaaggacatgggacttgggggcatagggagacacaaacgggaaggctgaggatccgggagttatagaagcaagtacattcaga

SEQ ID NO: 627145 - DNA, 882 bp, Homo sapiens
aactcccgggtgtttttaatatagttggaaggcaacaatattatttggtggcgaccaccgcgggggcaatcatttgtgaggttataacacagaatgtgatttttgtgcgcccagacacaggtggtgggtgtgtttcataccctgagttggaagaggacacacaacacatctttgtgccgcattttttttatatcaagaaacaagaggtgagataaacaacgcaggtttttttttacacaagaagggggggagacacccccacactccctcttcaggagaacaccccacaacactttttgggggcgccccccaccccctattttttttgtggggcaccccgcagaaggaaaataatcccccaccccacacccaccacagggggagcgaggaccattgtgtgggacctcttctaagagagagattttgttgcggcgccttatcctcccaccccctcccaacaacaaataaaaagagggagaggtggggttttattatctccctccaagagagagtgtgtgtgtgtgttattataacacaccacacacaaaaatatattatctctcttctttgtgggggcgcccacggctctctcacaggacagagaggtgtggtgtgtgagagatagaacacacaccacgccgttcacaccccccccgcgagaggagagaagaagaagagagaaaagaaaaaccccacatatatcatctcccgcgcgcgagaaagaaacaacccgctccggaggagggggggcgcaccaccccgcgagaaaaaaaagagaggagagagaaaaaaacagaacaaaaaaacaagaggttttttaaccccccgccccttgtgtgtgtgtgtgtgccccccacaaaagggggttttttttctctctca

SEQ ID NO: 627146 - DNA, 244 bp, Homo sapiens
gtctatcagtggcgtcgttttcattgagtgaaccacgtatagactgggcgtgattgtgacccaggcctgtgacagtccactcgcaggaactcttggatggtgctccaatctccgcgttttcctgtgcttgcaagctcagaagccagaggcgggttcggtagtggctaatgggacaatgtgctgtccagcaaagcacacattgagaagcggccccaaaattcccaccttgatttcctgcctgcat

SEQ ID NO: 627147 - DNA, 1094 bp, Homo sapiens
  misc_feature (485)..(485): n is a, c, g, or t
gtgtctacaactatacaaaaattagctgggcatggtggtgcgtgcccagctattcaggaggctgagctgggaggatcactcgaacccaggaggcagaggctgcagtgagctgagatcacgacactacactccagcctgggggaccgggcaagactctgtcttgtcttttaaaaaaaaaaaaaaaaaaaaaagcagtgggacactgaggggaggtacgacagtgcaataatagtgcgcttcatcccattttaaccgagaaatacctgggagggcattattcgcgaagaaatttgtgttaagtgcgccccgagggagaaatcctttaccaggtggtgcctatttaaattacagagaatgtgcccaagtgtgtgtaacgaatctcatttattgtcttaacatatagcgaaaccctatatttcttacacaaatataattttccatctatctatgtgcgtgctatgtgctttttttccgcgtgttccccnccgcgtgttgctgtctctctgggatttacatattacctatacaaacaacaccacgcgtttttttcttttcacacaaaggagagctattctatatatgcgggggcgatatatatttttccacacactcttctctttaaacacacaccctgtggggggcggtttttccccaaaaaccacacccgcaattttttcacaaacaacacaccaatctttattttctccccagctggggcggaaaacaaagcgtgtgcgggtttcaacaaagcgcgcgtaacaaagagaacatttcttctcaaaagacctctccacccatattaaataatcttacgaacgggcgggcgtaatgttttctccccccccgcgggggaaaaactgccccctttttttggtcataatataaagtcttcaaccacagcggggggctggcgtccctatattgtaaggagctataaaaaaaagcactgaatcacaacgaatcaaacacgaccaatgacaaagaacatgaacaaacacaactcatgggtgtgggtgcgggacgcggcgccatcaatggggggcccccatcgtatgaaggaagaaggaaggagtttttcttaagagaacaacacc

SEQ ID NO: 627148 - DNA, 522 bp, Homo sapiens
cctacgtatctagttcactcatctacatcaagcaagggttggtggactaggactctctgaccaaatcctgcctgccaactgtttttgtaaataaagttttattggtacgcagccataattcatgtatgcataactgctgtcatgctacaatggagggttgagtaattgacctacaactcctgaaatagtctctggctctttctagaaaacgttcctgacctgtgacatagagcacagcactatcagggccaagggcacaggtgttgtccctgtatgctcccttcagcgtggctttcctcttcggccattgggagcctctggtattgagtgtgcatctgttgggaaacagtgagtggagaccctggggacgccctcctctgtgaagcagcaacttaacacgcaggtccatgccatgcggatcagttttgccgtcttcatatacaaagcccatttggtgttttgaggaggggtatttctccatatactaatgagtctgtgaagcagctatttcctccttccttg

SEQ ID NO: 627149 - DNA, 555 bp, Homo sapiens
  misc_feature (208)..(208): n is a, c, g, or t
  misc_feature (297)..(297): n is a, c, g, or t
ccaggttcaaggcattgttgctatcggggactacatggccccgtcggtctgggtgttaagtgctccaaggaggtggcccccccatcccgtggggccatcattctggccaagctctccatcgtccccgtgcgcagagggtactgggggaacaagatcggccagccccccactgttccctcaaaggtgacaggccccttcggctttgtgntggtacgcctcatccctgcccccaggggccctggcattgtttccgcccctgtgcctaaaaaactgctcattatggctgggatcgatgantgctacccctcagcccgggggtgccctgcccccctgggcaaatttgccaaggccccctttgatgccctttttaagacctacagctacctggcccccggcctctggaaggaggctggattcccccagtttccccatcagggggtccctggccccctcgtccagaccccccccagagtttccgtgcagcgggctcagggtcccgctgtgggttccacataggggttttataccagaaaaataaagtgaatttagggtgga

SEQ ID NO: 627150 - DNA, 434 bp, Homo sapiens
  misc_feature (133)..(133): n is a, c, g, or t
ctcggaacgctatccaggattacgcatgaccaggaatcagaatatgactgggaaagatgattgactacggaaacatgctgtgcatgaggcgtagaacagcatttgaccaagtaacaggtgtgcacagaaagancgagtaatattcaaaattccaaatttatcactaaggagcaagaagaaaatgtggccctaaagggggttagttgaggggtagggggtagtgaggatcttgatttggatctctttttatttaaatgtgaatttcaactttggacaatcaaagaaaagacttttgttgaaatagctttactgtttctcaagtgttttggagaaaaaaatcaacccgtgcaatcactttttggaatcgtcttgatttttcggcagttcaagctatatcgaatatagttctgtgtagagaatgtcactgtagttta

SEQ ID NO: 627151 - DNA, 411 bp, Homo sapiens
  misc_feature (37)..(38): n is a, c, g, or t
ggtacgacaaagtattaggaactacacacatcaatgnnaaaatggaaaaatcacattctgtttttgaaaagtgatcttcccatgaacatattttcagtgacattaagagtttcagtttaaagttgggtatggtggctcactcctgtaatctcagcactttgggaggccgaggcagaaggattacttgaggtcaggagtttgaaaccagcctggccaacgtggtgaagccccatctctactaaaaatacagagatttcccgggcgtggtggtgggcacctgtggtcacagctgctagggatgctgaggcaggggaatttcttgaacccgggaggcggaggttgcagtgagccgagattgcaccattgcactctagcatggtgacagagtgagactccatctcaaaaaagtcg

SEQ ID NO: 627152 - DNA, 268 bp, Homo sapiens
agcgagagaagccccttatgggtctttcaactctcacatctatttagatgcaatcggaggccccgcaagggaccaccatgtcaatttaaaggtccggaatcaaattagcttccagggtttaaggcaattattttgggaggtggccagtcaattaaaaattgagggttaggtaacctccaccttttccacccaccagcattgagctttccatggatttgaaaaaaagaaaaacccatgtcagccccagcctggggctacctgacctgac

SEQ ID NO: 627153 - DNA, 346 bp, Homo sapiens
  misc_feature (164)..(164): n is a, c, g, or t
  misc_feature (209)..(209): n is a, c, g, or t
ttaagaaggagaacaaaaaggcgcacacatcccacccgaaccaagataggtgggagaaggcgcttttgccatatgagtgtgaacacaccgtgtccccaagtgttttgcgtgctcccgctctgtggtgcaggcccataaagccttacataggtgtttaatatctntccagagaagctgcgcctgggagacaccgtgtgtgccttgtgttngtggatttctttcctaggaagaactttaattcctcctgaggagactctactttttgagcccaactgctaatttttttgcggaactgtttagaagatcattccagagaccctgcagttgcactttctcgtaaaagtta

SEQ ID NO: 627154 - DNA, 261 bp, Homo sapiens
gacatacaggtcaccgcattactcactgtctcccttcttgccacctaacctcactctgctatcaagatatgaagaaattaccaaaccaaaaattaaatctagggggccaggcatggtggctcatgcctgtaatcccagcactttgggaggccgaggcaagcagatcacttgagatcggagtctgagaccatcctggaacatggtgaaaacctgtctctgctaaaactacaaaaattagccatatcttcttttattttcttg

SEQ ID NO: 627155 - DNA, 357 bp, Homo sapiens
cattttgcccagatgtttcccatttcacaaatgagggaactgaggttttgagagcttcccctgaggactttgcaaaacaaggtggtgtctggtttggatgaaagtggtcggtgattcctcaaatcctgccctgcctcccttttctggttcctccctaacatgttaagctcttgttgggggtgggatgccctaggcccaaggttaccaaatcctgggtttggaaaattgctgctgggggtgggatttaggaccaaaaaggaatttactatttttactgtgaaaaaattcagcagggggtttttttactttttccctttgaggacaaagtttttttcgaataaaaagactgaagcaaga

SEQ ID NO: 627156 - DNA, 934 bp, Homo sapiens
gcatcttgtgcgagaagccgagcgccgactcttctctcgcgcctcgcctcttcctccgcctcctccttcgcctcttcctgcctcctcccggttccgcgcgtcactccagcctaatcccaagcaccagtgtgcgacgcgttcccttattcatttccgtttatctcgcccacctacccagcctcctgaccaaggttgatccgtggcgggcccccgcccagcgaatatagataccccgctccacgcggctccacactagctatcgcatgtccactaaattccagagaaacctaccaaatctataccagaccacccttttggactggatgcaattacagggttgaacggaccatttagcttccccggaaggggaaaccacggaggggaataataccacttatcgaattaatacaacgaacactaccatgggcaacagggtggaaagcggaggcaatgcaaacaggacacacgcgggacccatacaccgggctaccacgggggccagtatcgcaggacatcgacatttccttagaccacaaaacaaggaaccacttttgatgagaaagagtcgtttagacaaaaaaagaaaaattagtcggccagtgatacaaagggcacgacaccgggctcgacctaagggaacgccaccccgaggccaatctacccggcaagaaaggcgatatacatccaccaggcacaaccaacaaagcgggacggaacccacaacactgcacaaacacgaacgactatcgtggggccgcacgacagtgcacatacacaagcgacagcagcagggccacattcggcaaaccgggcaacggacacacagccagcgcaaggagtactaaacgggacagctccacactccagtggacacacctcaaacaaacgtggtgacgacatcccacctaggccacacggccagggcacacccaca

SEQ ID NO: 627157 - DNA, 118 bp, Homo sapiens
  misc_feature (26)..(26): n is a, c, g, or t
  misc_feature (68)..(68): n is a, c, g, or t
  misc_feature (92)..(92): n is a, c, g, or t
gatctactcccagtttttaacttttnacagaatattgttgctttcctacaacaatgtacatatatttncagttgtatatgcttttttttttnccaaataaagtttgagttctaaactc

SEQ ID NO: 627158 - DNA, 890 bp, Homo sapiens
  misc_feature (1)..(1): n is a, c, g, or t
  misc_feature (65)..(65): n is a, c, g, or t
  misc_feature (235)..(235): n is a, c, g, or t
  misc_feature (372)..(372): n is a, c, g, or t
  misc_feature (409)..(409): n is a, c, g, or t
  misc_feature (415)..(415): n is a, c, g, or t
  misc_feature (506)..(506): n is a, c, g, or t
  misc_feature (569)..(569): n is a, c, g, or t
  misc_feature (631)..(631): n is a, c, g, or t
  misc_feature (661)..(661): n is a, c, g, or t
  misc_feature (683)..(683): n is a, c, g, or t
  misc_feature (698)..(698): n is a, c, g, or t
  misc_feature (701)..(701): n is a, c, g, or t
  misc_feature (712)..(712): n is a, c, g, or t
  misc_feature (719)..(719): n is a, c, g, or t
  misc_feature (750)..(750): n is a, c, g, or t
  misc_feature (763)..(763): n is a, c, g, or t
  misc_feature (780)..(780): n is a, c, g, or t
  misc_feature (874)..(874): n is a, c, g, or t
ntcaaatatgttaacccacctcattctattgtcttatgttgtttcagtcatgatcctcttctganatcaggaatacgaccccgagaaatgagtgagtgatatttgcttttatatctgatgcgttgcaagaattcagtgtcacaaacagttgagccataaattaaaaatggtagactcacatttgaatagcagccagtcatatataaaaaaatccaaattttttaaaaagtgactngtattaataaaaactggtgaataaatcaccaatgatttgtttcctcatgctgtcatattattcttcagatacaaccataaaggcaaataagccataaagacaaacaagatgacatattaagaatgtttaaaattgcntctcccgaattttccggattctactggcaaagcgaantttggncatctcctttttctttttcaaagcttttgcacatgcacgtctgccatcctccctgccaacaaagtcattgtcattccctccacagccagtntaggtgagagcatcacaggtaccgtatctcggattaaaacaacagcgagttacattggcagancacagtccctcatcttttggactgttgcaaaatgatggaattttctttggtgcgcagaagcncaaacaagtagcatcaacaggaaaccagtncacaaaccgggtccggggacanccaccggaaaagaantanacacaagtaangggactnagattaaagaaatacttttctgtggaccccncacactggtcgtncacactcacttgcagcnggcaaactttgggaactttttctattctccagcaagcttcgtcgcaagcctcccaggtgtagaaattgttggcgttgccctcgcagcccccgtncaggaactggcggcac

SEQ ID NO: 627159 - DNA, 841 bp, Homo sapiens
aaaggcaggaggaagagagagaagagcacggcggcaacagcgcacgggagaagagaagagttgaagacattggaacagccagacgcatagggaaaccaccgggcgaaaagaccggaacaaggagagcagacaccatgacttttaagtgctaagaaaacaggagtaaggcactgggacagagatcaagaaaagagaaaaaccgtgagaacgacaaacagaagaacgaggaagccaaacaggaggaaagaaaactggactgaactgaaaaagagaggaaggaaaacaaacacgaaggcaaaaagtataagcagaaaaaggacggtagaaaaagaagaagagaaggaggcgaggaacaaaaagagagagacaaacagggcgggactaacagggaagaaaacgaggggagagagaaagaagaaagagacaaatgggaaaaacggcacaatataacaaaaggggagagagacgagagaaaacacagaagaaagaggaccaggagcaagcaaaggagcaagtgagggcggagcgggagaagaagagcagagagccggagcacgggaggaacaataggagagaagcggagcgaggagacgggaggaggaatgaacagcggaggagcggagaagatacagcagagcggagagaaggagacgaggcgtcaaggaacgagacagagaacggactgaaaagagaagagagagaacataacgagtagagcagacagcgcgagagcggagtagacggaacgagacgcaagcaaaagcggacggcgacggcatagtcatgacgaagggacgagaggaagagggcgcgcaacccacgacagacacaaacacacact

SEQ ID NO: 627160 - DNA, 151 bp, Homo sapiens
ttggggcctcattcaggaaaatactaacctagatgagaaatcagagaaggactctcagaagtgatgtttaagcagaagctcaaaggatgaacaggaggccaggctcggcggcctcccaaagtaatcccagcacttggggaggccaaggtgg

SEQ ID NO: 627161 - DNA, 353 bp, Homo sapiens
  misc_feature (67)..(67): n is a, c, g, or t
ccccccccatttttgggggcccttttaatcccccaatttaaataaggctccaaaggttttgcctttnccgggttttttttaaaacctttaattttttttcctggggccccgggtttattttttttataatgtgtttccccaaaatttgtttgattgtttttttttcccgtgggcctttaaagggggggggggagttttcgggtgaccatgggttaccaaaaaccagtttttggaaattttttaaagggtgggaaaacttgattccaaattccccaaattaaaaaaaaggtccccctttttttaactttttttttttttttttttaatgtgttattaagggggcccccttttta

SEQ ID NO: 627162 - DNA, 108 bp, Homo sapiens
ggcacgagcttgctttttctaccacatctacagtgattttcctccaataaagtcttgaaaccctcagagtcatccattgaggacctggattcatcttaccttgtatca

SEQ ID NO: 627163 - DNA, 459 bp, Homo sapiens
actctgttacccaggctggagtgtgtagtggtgcaatctaggcttactgcaacctctacttcctgggttcaagccattctcccacttcagcctcccgagtagctgggattacaggtgcttgccactaagcccagctgatttttttgtgttactagtagagaaggggtttccccatgttggttcctggctggtcttgaactcctgatctagtgattcgcctgcctcggcctcccaaagtgctgggattgcaggtgtgagcccccgctcccagccccgtggctctttttaaacctaagtgtcccttgtgatgctcaaggtccttaagtcagttgacctttgctttttgatcttattttcttacggcccttacttattgcttattgtgtaaaaaatactgctatgtgtcccatccttttaatcaaggtgattgtgattttgactaataaaaaagaatttgta

SEQ ID NO: 627164 - DNA, 1273 bp, Homo sapiens
gagagagagagagagagagagagagagagagagagagagagaacgtgactcacagagtgacagcgaggagagacgcgatgatatccgtagaagagctatcgcgggccgctgctgcgtggaggctctcccggggcctggtaagagggacccagattggagaaacgtgaatgtttgaagtggcttgttctctacgctatatagcgatgtaatttacagagtcttgtatctgatgtgactccaaagtctcctgctctttgctgctgtctatctagctgcccccgaggacacccagtagttgggctgagaaacttgctggtgtgctgacatatagtctagctggggacatgctgagggcccatgggtgcgcttctggtctcagacgctagggaacacaaacgctgaagggcaatctatgggtatgctgggaacactggctgacgctgactgacagtgagtacgtggacgctcacttgacacctacctttggacgacccccgttgatgcaacaaactggcttattctatctgagtatggtctatcctctacagctgctgtgcacggcagcagcagcaaatgctcgtatgaccctacatgcgacgccaacacgaccagcagaagcgtgagagtctgaggattgacataccagcattcccatgaacttctcatgactgactcccgcaaccaaatcaccaaccaaggtcagatttcaacccccatgagatggcacagtacatatccatcgaacagacatttcacacaccttctaaaaacaaccccatgacacatattcacctcaacaggacataacccatgtaatcccacacatcaaaaattcatctaatcaacacaggggcttataaaatactcccagaccttgaaatccctaccctaacagtcaaacccccccccacatcttataaactactaatacaggacccggagggcatactacccagacacacaatagccattacataaccccccaatagagattaccacaacctctaacagctctttatccccattcaaacctgccaagaacaaagtaggacaacaaatttacaccagcagagctgcaacaacgagacatcaacctaagtgaaaactagaaaataaaaagcgccaacacaactcaaactgagctcatggaaaacagactcaaccatcagtaagcatcacaacagccagaccagacaaccatactctccctctctctttctccttctccctctcctcctcctctctacgcgaaaaaagcacaaacaacaaaaca

SEQ ID NO: 627165 - DNA, 125 bp, Homo sapiens
gcttgggctgtgcaggaagtgcctggtggggctggtgcagccggccagcgcaaccctgtacgactactacatacccgatgcgcagatgttctggtgttttacaggggcaccaacgtaagagcaga

SEQ ID NO: 627166 - DNA, 1497 bp, Homo sapiens
  misc_feature (1261)..(1261): n is a, c, g, or t
ggcaccccgatgtgtttgtgcccccccggtggtctatgagaacaacaccatgttgggggacaaaggtttctttgtctcgttgtcaacacagtgacaatatgccaccaatgtgtgttggatagatattgtggggcacaaaagaataactcttgttttgtgggttgtgggaagaaataaagtggggggaaaagctgttactcatcctggggggatagataaatcttccctcgctgtcgccttgcaaaaaggtttgctgccaaggtgcaaccactatgctggatgttgatgcggggggtccctttccgaaaagaggagcccctctggatggttttcccccccaaaccccgtgatttcccaccccctcttataagaagaagggggatccaacggggcttttaaggggggcgacatttgtggggggcccacggggaatggggccgccaaccacgttctctgcggtcgttgtgttggccgcccccgttgtaggttcgtagggggatagttctgtttcccaacccccgcgagggtttctctgttgtgtgtgacgccccccccccaggggtttcttcgtctgtctccccccgcacaataagctcccagagtccgcgccccttgtgtctccgtgggggaatatgttctctaatcactgtggggttcgccaaatagttgtggcaacattctcacaaagagtggtcggtaaattgttgtgacgcgctaagagccacacacttgtcttcgctcttatgacgccccactgtgtcgctgggccccacagtcttctgtgcgctgcccctcgtgtgtgcacaaacgtgtcgtgtcaccacacactgtgtttgggttgattggcgcgcctctgtcccaacagagcctctgctgtgcccacagtgtctctttattgtggcgtctttataagagtgttcacactctttgggggggcgccacccaacagagacgcctcacacagagagtctaaatagttttttctggggtgtttgttggggcgtttttgaaaacacccaaaaagctcttgtggagatttcacctctcgcacagggcctctggtgtgtgtgtcctctggcactagtctctgtgtgtctcgcgacaacacacgggtgcccctccgccctccttgtataagagaagcacgcccctctcactgcggtgtctacacaggcttaatatctttggttcttctctctgttcttctgtgtctttatagataggtgtacacctcgttataaaaccacaccacataacaccncctgctagagctcggagactcgttgagagcacggcctcgttcttctcctatttaaagtgataaaaatataaataagtaagtaagtgaagtgttgtaaagctaatttctgaccacgaaaaagacccaaggtgtactaattgtgatgagataagtgttgttttatatggaagaatgtaccagcttatggaccaaatgtcacacctttttgttacctttaataaaaaagtagtaggata

SEQ ID NO: 627167 - DNA, 266 bp, Homo sapiens
ggagctgggcaaacaccttcgggaggccgggccataaaaccgaaaccgggtctttccttctggccgtgagggggactccccaggccttcagaaccttcagtacagccctccgcgcagcacagccctgggtgtgagggccccctgtggccctgctccttagcaaaaaaagcatttggagttgaatgctgttcccaaaaacaacatgtgtatctgccgattgttttccatggttccaacaaattgcaaataaaactgtatgggaacga

SEQ ID NO: 627168 - DNA, 270 bp, Homo sapiens
acttagaggatctccgtggagccttaccctccggagccttacctcatctgcccctcccctagtgctgcagaacggctgacactgtcacactttcagaagaactggaggttgggtcctgatcatattacatgaagccttccaccattgtgaacaattaggcaaggcatggaagtgacagaaggggcatcgctggataaatacagagcaaatactgggggcagtgaaagaaggaaagcttacaagaagaacattccggtgttttcctttcaa

SEQ ID NO: 627169 - DNA, 109 bp, Homo sapiens
gcggtatatgcagatccagcagctctctggttacagtcaggacagaacagctggtgtcagactgggttagaggtttgtcaacagaggcagggccagtcactctttggag

SEQ ID NO: 627170 - DNA, 207 bp, Homo sapiens
tggcagaattccattaacaaggcccagttgctggaatgttggaatagctgatatgtcagttatgggcaggctacatggaactccagtactggtattaaatgaattccgtagaagatcagtaccggttgcagaaactgttttaccttgtgattgcaactgactgttgccatcagtttggacttccgaattgacctttggagggcaggg

SEQ ID NO: 627171 - DNA, 258 bp, Homo sapiens
tactttcaccatagcaaatgtataggaagttcatccatgttgtggcatgtaccaatactttattcctatataaattagctgaactccattgcatgaatatacatttagtttatctactcaccaattaatggacattatggattagtgtctaatatatggccattaggaatcatgctgctgtgcaaattcacatacgtttttctagtgtaggatatgaattaatttctctttaaggtaggttcctcaagagtagaattt

SEQ ID NO: 627172 - DNA, 403 bp, Homo sapiens
taaactccgaggatccccgacgagttgtccgagttaggacgagcgaacaacaacgaaagaagaagcgtgcggctcaacaagctcgacaccaacgaagggctaggaccgggttggggaggaagcattgagtgagagaggagggtgatattgcgggggcccgggatcggggattgttgggttgacgagatgagggacgtttgagcttggacttgcgggtggatcgatcgggctggatctcgatggtgaagctttgaagaaccgctcggcgtttgactcttgccaaccacttcttctctggtttccaaccctacgtgatatcctggtcttcaacgtctgctagatatatactttcctttaacgacctttttacgttaactcggacaactcgtcgggtaccgagctc

SEQ ID NO: 627173 - DNA, 150 bp, Homo sapiens
tccttcgaggacgcattcacccgtgtctgtcatgcaccacgtccacctttgtctaggttgcaagttgggcagcagctctggttcctctttaagtggtcatgcttcatacctaactttccccaatagtcgcctgaatggtcgtcgacgttg

SEQ ID NO: 627174 - DNA, 382 bp, Homo sapiens
  misc_feature (187)..(187): n is a, c, g, or t
  misc_feature (233)..(233): n is a, c, g, or t
  misc_feature (381)..(381): n is a, c, g, or t
ctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcatcaacgtcagaaaaattcaaatggnaaaaaactttgcacaaaaacgagccaaaaatattttggcccacaanaaatatctcctccggcatcgaaaaatttttccgggaggaaaactgttggttattgtgcacttaaaagaaccacccacacctctctccatagtttatatcactaagccacttcaggattttttttttttaagtaagaagagaaatgtana

SEQ ID NO: 627175 - DNA, 191 bp, Homo sapiens
aaaataaaaacagactcatctgagctgtcctgctctgacttgaggggagattagaaaccttctctccagatggtcaccacaatcacaggtagaccaaacgagctgacagtggactgacaggaagatgggtgcacacccgaggagctcgaggcaacataggaccctcgtacatcctcgaaccacccctttgg

SEQ ID NO: 627176 - DNA, 451 bp, Homo sapiens
gtaccccaaaactttgcccggagcgaggtccacattgcccatgttcattgcattttgttggataatcatcttaacactgaagggacttggaagagaacagactgtggacacttaggagccaaagggcctaaggccctcaagggtactgcctactgccacctttccctccccattgccttgatctgtggagacataggaggtgggagccacggaaggaggctgttaatggctgttgagggagctggaagccaaatgcattttttctgccatgttgcatattttgagaaaactattcgcaaagatgcttaaaggccattaagacgttcaacctcattcgcctaaaaacaaacatttatggcgcatatggagtatcattcacctgacttcaccatagtgcattctcatttgagccaggcaaactgaagttaaaatccaatctccggcagagact

SEQ ID NO: 627177 - DNA, 286 bp, Homo sapiens
cattttttaaccccaaatttgcccatcctttttaatagttctttttttataaaaaaaaaaaggaatttaaggccaggccgtagttttttttaaaatttattccccaaaccccttaactgccccgttggtattagcggcctgttttaaaacgaaagtttttttattgaaaccccaataaatttttttgtaatattttatggtaaataaaaaacctttaattgtttgacttgtttaacttggccctgttagtttttattaataaaacgcgcatgggcctttttaccca

SEQ ID NO: 627178 - DNA, 910 bp, Homo sapiens
gccgggcgcggtggcgcgtgctgtagtcccagctactcgggaggctgaggtgggaggatctcttgagcccagttcgagactagcctggggcaacttagtgagaacctgcctctaaagaaatataagaaaaattagctgggcctggtggcacacacctatagtcccagctatttcgggaggctgaggtgggaggattacctgaacctgggaatcaaggctgcagtaagccacaatcccaccacattggcactccagcctgagcaatagagtgagaccctgtcttttactaccctgatcttagccaaaaggcagagaaatgatgaacctgtcttttaaaaaaacacaaaaacacaacaaggacgcggggtgggggccgcataaccgacagtggaaatccccagccattggggaagcggctgaaggggggcgggaacaccttggaggctcggcatgtttggacaccacgttgtgacccacctcgtgggagaaaacacaatcttgtggggggaaatggcaaaaaataagcggggaaggggtggtggcatgccctgtgttaaatccccagttgcctcgggaaggctgacgcgaagcaaaattgcgtgggacatccgggggaagggcgaagtttcgttgggaagccgggagaacccgagcctggggaacaagaggagcagacttcttggtgccaacgaaagcaacacaccaacaaaacactttgtggggggccgccgccaaaaaaatgtgtcaacaacatctgtgtgggcggccgcgccccagataactgccactgggcacagtgtgccacagagaatccggctcgacagcggttggttcccccaaaaaaccggcggcgcggggtctcgaccccgagggtcggctctcggttccaggggcagtagcggcgcgcgag

SEQ ID NO: 627179 - DNA, 461 bp, Homo sapiens
ctctgttctcctcctcccctcttttccccacctcccaaaattggcagccagtctgtggctctcggtctggggtctggagggtggggaatgtgggtgtgggggccggctggagaagctctcgctagcgctgcctgtggccagacccgcctcttgtcccctttcgggcgcacacacacgtccacccagacactccgcgcgctccctcgcgctttcgctcgcccgcccgccgccgcctgctctctccctcctgctctcgccggtcgccttctcctttttttttttttttttttttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccg

SEQ ID NO: 627180 - DNA, 339 bp, Homo sapiens
atgaaactattttaatttgttcatgaatagttctgataatttggggaaatgaacctgattatatttatgccacgattgttgattaagtcatggcagatggtgcctaccatgtagatattgatgaatcttacttgagaagtttattaatactgaactatatgagagcatgtgaattaggcttatcagagtaatatgctataatgggaaatacaggaataatgtatttattcagatctaatatgaactttcttattgcatgaataagatggataaacatgccattttacaatgaagagtctaatagttcatctatattgttcattgttccatggtttcttt

SEQ ID NO: 627181 - DNA, 299 bp, Homo sapiens
aggtacaggtgcctccctttgggtggcgcatctgtgtggctcatgagtttagagagaagaggatgcctttcaagctaacaccgtctcccttagcaacatgataaagcatataggcatgggcttgaggtacctggagtggtggtacaggaagacccatgtggaaaagaagacagcgtttcatgcgacatgatcaattctgtacccctaagaacagatttatggtggtcccttgggtggcatcgggggaggcactattacccgggggtggagagggcagtcctgtcgttgtgagacatgct

SEQ ID NO: 627182 - DNA, 109 bp, Homo sapiens
tgccgcgacatcaagtgagatgacggtgccatcctgggatgcggtacctcaatgtcatccgagcccgaccgatcgtcagggccaggggccctttttcattcacgatgat

SEQ ID NO: 627183 - DNA, 916 bp, Homo sapiens
ggtgtacccgcacgcaaacagtggttcccacatggtgaacaatctgagaaaaacatcgtgtccctctcttggtccgcctgagctctttcgtaggcacaagggtttttcccggcccagtatctcacaatcgctgcagggggaaaaacgaggcgccgggctaaaaggaacagccgcccccggtcttttcacatgcagactgcaacaccgcgctccactgtagtcctaattaagaccgttcccttccccccgctcactaatatatgagacctcctcttttatattcaaaagagccaatacctcagcacatgtttgcaaaacaactctttcctgagcaaaaaccttttcttctctaaaaaaaccgcttacaaacggccaattcctctgggttcacaccccatttttgtaccatcgtcgcccacctttcccccctccgaaacaaccttggcccccaacgacaatattgttcccttcaaatcatcacgcgtcaaggcgcaccacgattggacgccacacccaattgtctgcaggaatatctcttatctcttgttctgcgacaaaagatccacataaggtatgccttcactttgctaatggatgaaattctattcccacataattgagtgtgaaacaataatcttgagtctgcatcaagctcctatgcgtattgtttaaattagataccgcccctgcgggatggcgctctgtagatataataatgtaacttgccgtttatttgtaaaacaccctactccgcccccacgcgcctcacgcggtacgaccgcccttggtaactcccaaccagacctgggagagaaatgaagtgaggggcggactttcagagagtccaggggtctagaagaaccgcgatctgccgcacccgtgggaaccccattttttataacggcccacaataaca

SEQ ID NO: 627184 - DNA, 1078 bp, Homo sapiens
ttaaggctatcgtcgaccacggcgtcggtggaccccacgagtgcgggagcagaaactgcagcaggagcgcctggcgctcaagcagcagcgagcagctgcagaagcacgctccgtgtacgctgagtaccagaaacagcgatgaccacctgacaaggcagcatgaggtccagctgcagaagcacctcaagcatgcagcaggagatgctggcatgccaatgcagctagcaggagatgctggcagccaaatgcgtgcagcatggagctggagcatcagcggcatctgggagcatgctatgcggtctggaagagctggagaaagcagcggcttgagcagcagcttgctcattcctgcgggaaacaaggagaagagcaaatgagagttgccattgcccagcaactgagggtacagcctgagggctccaggaaattcctcttgtcgaaagtcaacaggaggccccaaacccaaggcgggcctcaacccattctcttcccagagtaccccaaattgcctggtgagccccaccatggcttctttggagccagagttccccatcccgcaagagcgtgcacaccttgggaccgccatccgcttcgctacaaacttgccttttgccctggtgccctacgacaggtcggacgacgacttttcccctcttccgtgaacaatatgccttatgaaacaccagactttgaaacggagccgtacaagcggcttatacagcagaagggtggtctgatgcggaaggaagccagtcccactccttgcgctcgcagggaattgagacctgttagttagcagaccttttaaagaaggagaggcatggtagacagactcaccagagttgcaggggccccttggggcgtttctgatcccggtgagttattacagacgcgatcagccatggacatctcagtgacgcaggtataatcacggaaaggaggtattcccaagaggtcgaccgctccgggttagaaaatttgggtatacgatggggtccgggtgccgcgagtattccgccaactgaagattgtgcccttaagctgtcgaggacccctctcatttgggaaagggtatgcc

SEQ ID NO: 627185 - DNA, 687 bp, Homo sapiens
gagcggagcggcggctcgacggggtcatccgggcgcaggcgcagtgcggtgttgtctgccggactgacgggcggcgggcggtgcgcggcggcggtggcggcggggaaggatggcggcgtcctccctggaacagaagctgtcccgcctggaagcaaagctaaagcaggagaaccgggaggcccggcggaggatcgacctcaagctggatatcagcccccagcggcccaggcccagccctgcagctcccgctggccaacgatgggggcagcccgctcgccatcctcagagagctccccgcagaaagcccagagcccaccgacgcggaacccgccaaatgctggggctcccagtcgaaaccgtgtgcacaccccgcagcatggagagcatggagatgtgaccagaagcggcaggagatcatgaagcagacgggactacctgaacatcgggggccagggctaccaggcagaaatcgacgacctgtgagaacttgggccgagatggggcagcggctacctgcggccaggtgtggacagatgcgcctaccgagaagaaccgggccacggtcattggccggtgaagccacatgccggaagcatcagggaaccaaggacggagcaccaaggtgcagtcttcaatggcacctggcatgtggtgcttgaaagaggccacgactgggcaccgtaaagt

SEQ ID NO: 627186 - DNA, 1400 bp, Homo sapiens
  misc_feature (738)..(738): n is a, c, g, or t
ggcagagcccggggacgaagggggcggcgaggtcaggtgtagcgctgccctggcgagggcttggatccccaggagtcaagtgagcggtctgctcactcctcagcgtgcaggagccatggacgtgtggagtccgcagtcagaggcgcaacactgtgttctcattcatctcgctgctgagaaaaggtgccacccgtagaggtgaatacgagagtggccatgagtagtgagagatgccgtgtgcagttgacacgacggtagggtgtgtcgacagctgagaggcagcaaggatcctcgacttcggaagcactgagcactcactgggatgctagaagcaccgctgtcttgcggagatggaccgtagtgcagatgcggtggactccgtggggtacctataggcggtttgcctgagggcggtatcgatccgcattgtcgcgtcaccgacatggaagcatagcgtatactaacggctagtcgtgggtaggcccagtatttgcggcccagaagtgtcccttatgcataagggagcgttctaggccttaccgtgcctcaaacggggatagccctctccaaccgcttatgcgaaaccccgttaggaacagggcctctgtggacaggctatccaagttggtgagcaatgcgctattgggaggaaggggccatgcaatatttgttgcggacgcccttcttatttggttagttttcccggcttgccatgtttagtcgcgcgaccttatgcgnaaagacgctcgccttaggcgcgcaggtacgttggcctaatttgagagcgcgaccgccaattggaaaacggggggggcctctttatgggggaaaacctgcagacgggggccaaacgggggccttgtattccaggttgcaacttttacggacgggcaaatttccgcacttgcggcgccgcaccctactttcgactgagaatccgcgaaatgggacattgccccaaatggacccatcgggcttgctgggcgcaacgcaaactttacctgttacgcacacaagcggccgccaggctactactttggaccacggggctaacacactgataccactttaactctgccggggcggcctcccctcaaaacgtgacatactgggggataccgctgctcgctgtacaccccgtttccctgataactgcgctgcgcgacgtcacctcgctgtgggcttgggacgccgctactggcgcccttggcgccactgcatgcgtgaaatttccccgtatgtgggtatgggttggcccctgtccgcctgttggtgccccacgcgtgtgactctgatgctgctgacgggggacctttcggcacacttgcgttgctctgtgcgcggggctcgttttccgggtgtaggctgcgctccgcctcgtggcgccgtgcctgctggta

SEQ ID NO: 627187 - DNA, 1474 bp, Homo sapiens
gtacgtgtccgagtgttatggctatcgtcgacccacgctgtacggtcgatcgaggaggtgctgccgccgctgccgccgccgctgctgccgccgccgcccgcgaagccggagctcgagccgcacgcggggattcgttctgagatgcctgactgcctcgccccgaaggatggcctcggatggagcattagaggcacggcgagacccgggctcccgtcccagatccgtctgtctgttatcgtctgtctctctttgacatcaccgcagatccaccccgctcccgtacacagaccaccaacgccagcttccatgcaggacacagagcacggcatgaactctccacaaacgagatcggatgggaagtaagagatccggaaaaaaacacatagcaaatcacagacagagaaaccaacaaacctgcaccagccaaacccaagctgcacaagagcgacagcgacaagccagaagaaaccagacacaaccaacacaagacacaaaaacacaaagaacacgagacgggaaaaagaaaaacacaaacaaccaagaacgctgagcgcacgactaaacaaaaaggacaacagagcagaggacacacagagaaaaccagacaacaaagagcgacacaatgaaacacagaacccacacggaagacaaaacagcaagacatcaaaagacgcaaagacagcaagaatcacaacacaaccaacgcacacctacacacccgaaagaccaagcaacacaaaagcacatgaatataacaaacacagaagaacaacagtgcactagccaaaaaaagtcaccgaaaacaaagaaacaaaccaagcactcaccacgaaaagcagaccaaggacagaacagacaacgaaacgacaaacaaaacaaaacacaaggcacacacaccaggacaggccaaacgaggacaatacaagcacagaaatgaacacagccacaccggacctcggacgacacaaaacccaccagagacaactaaagatgaatacgcaaaacacaggagaccaggagacacaaagaacacacacaacaccgtcaacagaaagcagccaaaatccaacaaaaagcagaacaaaacaagcctaagaaaaacacaaacacagctcaaacatccacaactcacaacaaaacatcaccactccacagccatttcaacaacacccaacacacagcagcgcaaaccaccgtagcaccagccgcaaacccgaaggaccgtcgcaacacgccggcaaacgacccggagacggtggcagtaacagagaatgcgggcagaagaagaggacgggcgggacaaagtgcagaggcaccgcgcagtcgtccaagacaacacatgaaggggagcagagggtgctgcgagaccactccagacacagcgccagcacaaccaaacacgaagagcgagagcacgcagcataacagggcagagaagagcgggagaaggcgcacccgcaccccacagcggacc

SEQ ID NO: 627188 - DNA, 215 bp, Homo sapiens
atcgttatggctggtgatgggaagtgttaaaactatcgtcctccagcctgggcaacaaaagtgagaccctatctctactacaaatacaaaaattagccaggcatggtggcgcatgcctctaatcccagctactggagaggctgaagcggcgagaatcgcttgagccagggagatggaggttgcacgtgggcccaacgatcacaacactgcactcc

SEQ ID NO: 627189 - DNA, 370 bp, Homo sapiens
  misc_feature (4)..(4): n is a, c, g, or t
  misc_feature (45)..(45): n is a, c, g, or t
  misc_feature (202)..(202): n is a, c, g, or t
  misc_feature (204)..(204): n is a, c, g, or t
  misc_feature (239)..(240): n is a, c, g, or t
  misc_feature (243)..(243): n is a, c, g, or t
  misc_feature (249)..(255): n is a, c, g, or t
  misc_feature (258)..(259): n is a, c, g, or t
  misc_feature (261)..(261): n is a, c, g, or t
  misc_feature (265)..(266): n is a, c, g, or t
gagntaattttctggtttgtgggttgaaataaagctgtgaattantgtaggctgtgtttttgtatcttgtctgtaaataggtccctgcttttttagaagtagctttatggtctcatgcttaatcttgtctcttttttcttttttatgatgttcactttaaaaacaacaaaacccctgagctggactgttgagcaggcctgtntntcctattaagtaaaaataaatagtagtagtatgtnngtnagctannnnnnnagnnangcannggttactaattgtatgatagtgtttttatatggaagaatgtacagcttatggacaaatgtacacctttttgttactttaataaaaatgtagtaggataaaaaaa

SEQ ID NO: 627190 - DNA, 161 bp, Homo sapiens
acgagtctgaaggacgagaagggagtaatggcaggacaagacgtttagaaagtttcttaccactactttgaaccgagtattggttgaaaggagtgactgctgaaactgtaaccaaaggaaggcattatgacttccagaaaatctcaggaagtgcaagcctt

SEQ ID NO: 627191 - DNA, 105 bp, Homo sapiens
  misc_feature (2)..(2): n is a, c, g, or t
gntgatctagaggatccctcgatcgacggttctcatgagtataaaacaatgaagatgtgggccagtggtcacgctgtactccagcactttgagaggcagaggtgg

SEQ ID NO: 627192 - DNA, 302 bp, Homo sapiens
atttggattcagataaaaagatgtcgaattttggcattgtttgaaactgaaaaaatttgaaatcaattgtcaactgaagaatgtactataatatgtttattcattcttcagttgacaattgaagaatgaataaacatattatagtacattctaacaatggaatactacacagctgtcaaaaggaatgggtaaatctacatagtgctgaaggttgcacaacaatatgaatgtccttaaaatgtcactgatctgtacacttaaaaatggttaaaattataaattttatgttatacatattttac

SEQ ID NO: 627193 - DNA, 374 bp, Homo sapiens
gtatatttatacactggaatattattcagccccaaaataaccccacaatgaaggatttgatacatattacaaggtggatgaactttgaaaatattatgcctaagtgaaagaaatcagacacgaaagattacaaattttatgattcccatttatatgaaatgtcctagaatatgtaaattcatacagacagaaagcagattagtggttgccatggtctaggggagggaaggatggagagtgactgcttaatgagtacagggtctccttttagggagatgaaaatgttttggaactaacagtggtgatggttacacaacattgtgaatgtactaaatgccactgaattatacatttcaaaatggttaaaaaaaaaa

SEQ ID NO: 627194 - DNA, 465 bp, Homo sapiens
ctcatctctactaaaaatacaaaaaaaaattagccaggtgtgatggtgcgcatctgtaatcctagctactcaggaggctgaggcaggagaatcgcttgaacctgggaggcagaggttgcagtgagcctagatcatgccactgcactccagcctgggtgacagaggaagactctgtctcgaaaaaaatataaaataaaataaagaaaagcacactatatattactcttggttattattatcatcatcaaaagttattgttactattataagtcctggcatttcgaaactctgaagatgcaagtccattctacctcttgcgagggagtagatggcatctcattaccaaatgtggaccaggcatggtagctcatacctgtaactgagcattttgagaggctgaggcaagaggatcgcttgagtccaggagtttgagaccagcctgggcaacacagtgagacccccatc

SEQ ID NO: 627195 - DNA, 1061 bp, Homo sapiens
  misc_feature (384)..(384): n is a, c, g, or t
gaatgtggtgcgcctgactagaaggggtactggatactgaggtcttagccgttgtctcagagtctagagggagcacctatattcagcctttggatggactgtaacttccgaggcgctcaatggtgcgacgtacagttaccaacgctctcctgacgccgtgggtgcgccccaggtggcgtggcatggaattgcacttatcctagaggttcttcttccggaagtttgaaagagagaggtcacaaaggtctgtgggactctgccaggggatgtggactcgagtaatgtcagaatgccgacttgagattcatttgggacaactgtgacctctggacgctcaggttggaatgaccagggatcctgtgacttcagagattccacagtctngaacactcgggctctcgtgtgatgagcacctttgtacccaggtctgttggatcctgactatatactcttcggggaccaaggacacgactggctttgcgtggcacgcggcatagacaatctttcaatgttggtaggggaggtcgtgtccagagaggagatcttcctgagacccggctccgtgtgatgggtccccgctgacgtcaggaggtggtgatgagcctgtgcgagtgctagtcctccctgctggagtcgatgaaggctgaaatccgggattcgctgtgcatgcggattgtggtccgtgaatgactatctatcctgacctgcatagggtgcgggcttcctggcggagcctggaggttccacgcactgtacaccatcccgcctgtagcgagggagctctgaccggtgccttcaaagtccttggcgctggaggtctgctgagcagaacgcagggcgggtgcaaccccgactggggcagaagcatccagaggatgctggccacggcctgggtgccaaggggagaagcgcgctcagaagccaagaaaggcgctgggaaggtggagcagacacagactcggaggacagggccggtggtggggacgggcccccagggcgcccctctcaagggggccaggggtctgcgcaccctgggggggtggcctcgcccacacacaaag

SEQ ID NO: 627196 - DNA, 4428 bp, Homo sapiens
  misc_feature (4092)..(4092): n is a, c, g, or t
  misc_feature (4099)..(4099): n is a, c, g, or t
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttaaaaaaaaaaaaaaaaaagaaaaaaaaaaanagaaaanaagaaaaaaaaaaaaaaaaaagaaaaagagaaaaaggacgggcggggcgggggccaagcatagaacacccccacgggaggcgccgacacatgaagcgccacactaatatgtgagaagaggggcgcccctctcgagagaggcgatactaaaaacagaacgacggaggccggctcaaaccaaagggtgtgggaagacaaaacacaagcgggggaataaggagagacccacccgcggggggggagatcgagcggccaccccccgagagtgcgcccgcgggaaaaaaaggcggcgggggaccacccatcagggggaaacaccgcgttatcttc

SEQ ID NO: 627197 - DNA, 135 bp, Homo sapiens
ctggggctgtcggccgcggggcggaggcactcgcgcggggggatggcccactgcgtgaaccttgggttcaagctgtccaattccctgtgaacaattttaattgacaagggcaatcagcttccaggcttgacccac

SEQ ID NO: 627198 - DNA, 4112 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 627199 - DNA, 3441 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcgcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 627200 - DNA, 652 bp, Homo sapiens
  misc_feature (390)..(390): n is a, c, g, or t
  misc_feature (639)..(639): n is a, c, g, or t
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtactaacttttgcgggggatacncaagatctctcagcgcccccgggtgggaggctgtggatctgcggccccttggctgctgcttcgtggaagtagaagggattagccacggttcaatccctgggcccctgagttttctgtgggaagttgagttggtctaggccccgttggcccctgcttgtttggcagagaatcccctccaccccagagctttcctctccactttttcagctccttgggttaggtcgtcaggcgttttggaggtaatttggngggccataacccc

SEQ ID NO: 627201 - DNA, 721 bp, Homo sapiens
  misc_feature (416)..(416): n is a, c, g, or t
  misc_feature (448)..(448): n is a, c, g, or t
  misc_feature (484)..(484): n is a, c, g, or t
  misc_feature (524)..(524): n is a, c, g, or t
  misc_feature (529)..(529): n is a, c, g, or t
  misc_feature (551)..(551): n is a, c, g, or t
  misc_feature (569)..(569): n is a, c, g, or t
  misc_feature (573)..(573): n is a, c, g, or t
  misc_feature (585)..(585): n is a, c, g, or t
  misc_feature (633)..(633): n is a, c, g, or t
  misc_feature (654)..(654): n is a, c, g, or t
  misc_feature (713)..(713): n is a, c, g, or t
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcaatcatttgtgacatcaaaggtgaattcatccatgccatcaagccatcnatgaagtaagcatggggacatacaagaattcnataataaggcaaatgggaaaacatgaatcatcaaanttccccaaggaacaagaaaagggacacatgtgaacaaagntttanttaaaaatttttttttgcaccntcaaagaacatgctccanaagntgaatttgatcnaagcgcatcaggcatttgtggtgaaaaaagaatttttgcaacatcagnttcaatcaatcatttcatccnaaacagggggttcaagaatttgtggttcaaacattaagcaaaatcaaaaagaacaatcnccaagaag

SEQ ID NO: 627202 - DNA, 885 bp, Homo sapiens
  misc_feature (43)..(43): n is a, c, g, or t
cacgccggtacagaattatacggacattataatcaaccgcagngcccatacagacgttaacaaatccgatgctaacacaaattctcccatctcgcacccagccggccgcctctaaacaccatactatcccttctgaaccactgtgtaaaaccctgcccgcaacgggtccttaatgcccttaccacacccccctggtatgaactagatgagaattccatacttcacaaaggaacagaggcttctaactccacaactgtgtcctggccacgagtcaaaaccaggccggcttttacccaagtggaccaagcaatacatagttttgaaaccacattataaacccatgaagctcagttaagccaacgtcactaatttgacagactcgacatattgacagtggacatagaaagaaccccaccgtccgcagaaagccgcgagcaggacaaaaattgagcccctgcccagcaacaaactgacttcccaaaggggataatcctgttcctcattgcggccgactacatacaaagggcgtgccgaaccggctggcgcaaatcctagcatgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaa

SEQ ID NO: 627203 - DNA, 435 bp, Homo sapiens
  misc_feature (73)..(73): n is a, c, g, or t
  misc_feature (92)..(93): n is a, c, g, or t
  misc_feature (420)..(421): n is a, c, g, or t
ggggggccataactccggggttgggtgccaatatgagtgaggtaggttttcattcaatcaagatttgctgagngccaaatatgtactccgcnngtcaggtgagggtgactgttgactagtgaaaaaagggacccatggttcacgactgtcttcttactggcagtggaacgacctgtggaaacctgtgatccattctcattaaataaatctctgggtaagtggctaagcaccttcttgagctcatcactaattcttcccagttttcacttttccagtgagttcccagttagcctggtcaattcagcgtagcatttcacttttggtatttcttcgttctctggccaccccgcagccaaaaagaaaaaagagattttaaaaaaatacctaatttctcattacacttagtttaaaactcatctnnctaagtgatagaat

SEQ ID NO: 627204 - DNA, 903 bp, Homo sapiens
gataggctggtgtcaccctagttataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatctcagatccccagaaatgatctcctctcacggagcctgagttcaaatggtcccgcggggcgcattgatcccagaagacttgctgaagacttcacacgcttctaaagagctctcgacggcgggacttatcggagtaaccccatggacctccatcttgacgctgctcat

SEQ ID NO: 627205 - DNA, 318 bp, Homo sapiens
ggggggcaaaaaaattttaaaaaaaaaacccccggaatgggggggttcggggggggggttttttaaaaaaattgatttagccttcaaattttccctttttttccccaataaaaggaagccaaatatttgccccaaaggggcccttttttcaaaaaaagcaattggttttggcccgggccaatttttattttttccccggggtcccccaaaagttttttttttgggcaaacaaaaaaaataaattggcccccttttggaaatgggggaggttttaaaaaattgggaaaaaaaaaaaaaaaagcaggtttggttttccca

SEQ ID NO: 627206 - DNA, 477 bp, Homo sapiens
ctgcaatagcgcggctgggggtgtaccgctaaaatgcacatgatggaatgtccgtagccaagcaggcccctaaagtaggacttatctaatggcgacctcgactacaggtggggattcaagagattgtgacaccgtaatcccaccagtctcgacggaataaaaaaaacagcggctatttttaatgataaggaaaccacctttgccaagggcctgtgccaccctcacgtaccgagtcatttgtattgagcgttacccctttggtgatagggacctttaagggctattgcatggatgtccctatgagatcattccatcgatgccaagtgatcgtgcccgaggagccaacaggccggtccgacatgtgaaatgactcccgtactggcctgaggtcagtgttcactgcagagcagcctctgctcatccaatggttgggtgttgaggtgcatatgactctctgcgattatctccacgggtggt

SEQ ID NO: 627207 - DNA, 4054 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 627208 - DNA, 4114 bp, Homo sapiens
tctgaggggagtcccactgtggctgccgcagcgaatgaatctgactaggccctatgtaggttgaaggttcactccctggcctcgctcagatgggttaaggatctggcgttgctgtgagctgtggtgtaggtcacagacatggctcagcggtcgacggacggtccgtcgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 627209 - DNA, 652 bp, Homo sapiens
  misc_feature (358)..(358): n is a, c, g, or t
  misc_feature (373)..(373): n is a, c, g, or t
ggattggtgtatttcgctggccataaaggcaaaggttccccccttgtgggttgaagcgtcccaaggcctctttccccccgctgaaaaaaaaagtatgatgtggaccccctgggccatggttttcctcgacccttggaaggaccggtccctcccggacacccttctcttgaaggaatgtggccttctgcgaaaggggccagtgttactggctgacaacgtgatctgcccaggtgcgccagacttcctagcacacgtgcgcgggagcagctgctttgagtgccccccctaccaatcgttcctggaatacagggaggtggtggccggcctggaaaaggccatttacaagggcccaggcaanaaaacagggccctgnttgccccccccggcccccctttggggctttttcacccagcctggtactaaaggtgccaaacgtgctcctgttgcccttttgcggctccgggctgtgtcctaaatgcaaagcccccctcggccgaggcctgcgccctgacatgctaacctttttgaactgcaaccctggattgtttttttttaagacccaatcatgacttttttactaccccgggctagctatattatcttaaatactaaaatcatgttttaaaaatataaaatagaaattaagaattta

SEQ ID NO: 627210 - DNA, 137 bp, Homo sapiens
tcccggggccctatgggaaaaccccccccccccccagggaaaaaggggcctttccccccgggcccccccccaaagtttgggggaattccggggcccttttgggggggggattttattaaaacccctttttaaattta

SEQ ID NO: 627211 - DNA, 1345 bp, Homo sapiens
  misc_feature (1192)..(1192): n is a, c, g, or t
ggaggactattctcagacaagtcagactgtcgatattcctagaaaatgtcgatattactcttgaagggacgcacagtatatctgtgaagggcccctagaggaatccctgcgagagggacttcaatcacattaatgttaaactcagccttcttggaaagaagtgaaacgaggctaccggagtagatcaaaatggtgggtgtacactatgcatgagtgaacctggcctacgcgcttctggacttcattgtgttacctcagtgttagcatgacatcattgcactcacatggcgtgtgtaacactagaggcttatcgcagattcacccatacaaattgcaggggattctagtggcctaataggcgtccaactatgcactcgcaagtcaaagcacttcgttctcattccctaggtggaggcagaacttgggggttcttctgtgtgctgtcagacagattccctgcagaggaatttgtcctttggtgggttggtagataccattcaaccattttctgtcttagtgggttctccgggcactttaggaaaccaccgcgcctggtaaggtcttctgccttgcacggtgtacttgccttgcagagggcccgcgcaggaacccccggaaggtgcacacttttctagaatcccccgttgtggacacacgccgacacacttgcaagcaggttgtgcaatgggcttgcggtcagagcagaagtactcttcaatgcccgttgtcctgatatgggatactagtgcgatgtccaatagggggccgagccaataggcatgtctgttgaacactggagccacctcggaggcagtcacttctaacggcgcaaaaatactctcccttctgggtcacgtcgcgggtcacttccatcactcgcgttcccgtccttgtacacacggatacccgggtaaaaacgtctgctttccctaggtcgcatgggaccttggcattgtggataggtaactgcaacttccgtagaggaacgagctctaaccgcgtggtgccctaggccccggaacacagggtacagggaatatggtcccccaggcagttgtaaccacctctttcagacggaagccagtaaacctattgccttggcaattacattccttgcagaccactgggaattcgtcgcgcaatttacacatacgaggcaacctctcacttttgggcaatctctgtgtggccncccgtcttcgtttgtcgttctccagcagcaaaagaaaccctgaacacagaaacccactgaggaccctagcgagaacaaacgagacatactatgagtgagcggccccgaggtggatcgagccctacagaccacacaagaaacctatattcgcag

SEQ ID NO: 627212 - DNA, 285 bp, Homo sapiens
aggaaaggcaacctgaggagagggcttgcagccagagaggggctgaggactgtgggaccgagagctagcagacgcactttagttgcttatagctcttcctgctggaggaggaggtggtggtgtacttgatggtggaacttgccgcctccaacagagctgaggccaccccccaatggctctgccagtgttggaattgaagccacctccaacgccaagaccacttgccataggagtagctgtttcctccacccaggcctaagccaactgccgaacaccacttggcac

SEQ ID NO: 627213 - DNA, 925 bp, Homo sapiens
  misc_feature (267)..(267): n is a, c, g, or t
  misc_feature (427)..(427): n is a, c, g, or t
gacagcagtccgtgccgccgtcccgcccgccagcgccccagcgaggaagcagcgcgcagcccgcggcccagcgcacccgcaagcagcgcccggcagctcgtcccgcgccatgttccaggcgtgcgagcgcccccaggagtgggccatggagggcccccgcgacgggctgaagaaggagcggctactggacgaacgcacgacagcgtgctggactccatgaaagacgaggagtacgagcagatggtcaaggagctggcaggagatccngctcgagccgcaggaggtgccgcgcggctcggagccctggaagcagcagctcaccgaggacggggactcgttcctgcactgtggccatcatccatgaacgccaaggcactgaccatggcaagtgatccgccaggtgaagggagacctggccttcctcaanttccagaacaactgcagcagaatccaatccactgtggttgtggatcaccaaccagccagaaatggctggaggccacttcctgggaagctggttggtgatcctggagctccgagactttcgaggaaataccccctagaacttgcctgtgacgcagggcttgcctgggccaagcgtgggaagtcctgaatccagtcctggaccagccccggaactccaatccattcctgaaggggtaccaattacgagtgggcacacgttgttctaacactttaagcttctatcaatggttacctggggcatccgggggagcaaaggggtccaatgagctgcagacgcgcaacgcccacagaaccctgtgaatgcgccgagctggccttacactccgcaagtgagcatgcgaaaatactcgacctgttggcaccctcgtagaaagcggtgtgcggcagacataacaaacacgaacctcacacgaggaatagtcccaaacacagcgcaccg

SEQ ID NO: 627214 - DNA, 101 bp, Homo sapiens
cctgctttttgctggtcgcctcttgtggatcccccccgttccgattgccctgccgatggccatgttgccccatgtcctgcatggttcggaaaacaggtctc

SEQ ID NO: 627215 - DNA, 1283 bp, Homo sapiens
gcacgggccctttccctctccaggccctctccttatctatgtgaagtcctgctggctacgtgcttaccctcaggaaagcctcagtggcccccatggaggagggcaggctgcctgatgtctactacctgttgcagtactggaattcgtgagccggtatacatatatcgataaaagactgagcacagcgatgtataacaataacttgggagaaaaccgccggctgatgcccgggtctctctctactgctaatgatcctcaatggcggtcaggcgtcactcttttgtgctacaccatgaacccagcgcatgtgtggggacttgttgggtgcagaacttatttggggacttgcaagccctattctataaatgcactgataatataagacctcaaactataatgcctctaaatggactaaatgaacctaaccgaagcgccaaaggtacttgtgaaaaggatgactggaggtaatatacaccacaagtcgcccgagatgatgactgggtattactggcgtaaaatcatgcatggggaaaatcaagctctattatccatctgggatagacatagcacccttcccatagccccgggggcaaaacaggagcaattgaatactaaggcagtattccaagataatctataatgaatgctctcgggggggcatcccccatggacaccgatccatcatatcacaccttactatattccaggtcccccaagggccgatactccaacacatgcaatggcaatggcgatcgacttaggttgcgactcattccctacctatttaatgaccgaaagcgagtcactttcaattaggcacggaaaacagccctgaccttctatcgtttccatgggcacctggccccacggtacattaaacaatcaaaggcgacgagccaccaaagggtggactcccgctataaagcaagaatgcaagttaactctgggaagcgttaccatctataagggtttcccccaaggatacatattattccaagaagaatagactcaacttaagagtggactctctataaccaagataattacttggaacgcaaattcgagacactgtgattgtgcttgttggccattttaaaatcctctttacattaccccattaaagtttattgaaccactatttggcccgaaattctttacctgttgccaaagtgggtctcccttaattttatttaacgctggagctaatcctcaagttggctttggcttggagatcttcctcctgtatccattttagaaaacacgggaggatgcactgcgcgggt

SEQ ID NO: 627216 - DNA, 896 bp, Homo sapiens
gcgcctctgtggttggttagcgtgcgggtctagggcggcctcgtgggggggggctcaggtggtcgtggcatctccgaggtttgcgctctggatcatcgcatcggtggctttggtcctggggtcctgcgacgtcggctggggcgttcgagtcttgctctggacgggggtcgctacggcgattggtggtggcccgcggttccttcgtgtgttggtccttcctaccgtgttggccacatttgggtggcgtgggggatttcccgggtggagcaggagggcgagttgttccatccggcctccctggggatgcccacagcgcagctcctcacgctgtgcccgggaattcacgatcgaaacccgccgtaggaagggcctcagtgaagatgtgagcagtcaggcaaattcgtcgatggatcctattcgttcgctggaacttgccatcaccaggatgttgtgctcaacttaccccatgtgagtgcgtggacctcctgggagctcctgcgtccctacagtggtgctgcaactcctgtacttgaagactgagacctcatatgatcgtggccttcgtgttgtcagagagtgtctggaagctgcttgttgccatcttgtactactcaccaacctccaacccagagcctcagtcagagaggagcatatggcctcctgcattccttctgtggcctcagccgggctccattcccgaggaaaaagtgaggagcttgggctcacagaaagagaagggcgatgataccccaaggggccctatctttgggatttacatggaattgtcattttctacaagtctggaccttagccatagtttgcaagtgaacagaacattctgacctctgttctgctctgctcctttcatcctctctttactccccgtcggtgctaac

SEQ ID NO: 627217 - DNA, 134 bp, Homo sapiens
  misc_feature (2)..(2): n is a, c, g, or t
anttagaggatccctggaggcaggacactggggctcacaggtcgctctgccatacaaggcgtggagaaggacttgtagtcgatgggcaccgggcacggtgtcagggccctgtgtatggctgccatgcgggcgat

SEQ ID NO: 627218 - DNA, 732 bp, Homo sapiens
gctctttcccttcggtgtgccactgaagatcctggtgtcgccatgggcgccgccccgccgtggttaccggtatggtaagaacaagccggtacccaaagtctcgcttctgccgaggtgtccctgatgccagagattcgcatttgtgacctggggcggaaaaggcaacagtggatgagttcccgcttgtgtcggccacatggtgtcaagatgaatatgagcagctgtcctctgaagccctggagtcttgcccgaatttgtgtgccaatacgtactctggtaacaaagtggtggcaaagattggttccatatccggggtgcgggtccacccctttccaggtcatcccgcatcacccaagatgtggttccctgtgctgcgggctgacagtgctccaaaacagggcattgcagaggtgccttgtgaaacgccccagggcactggtgggcccagggtttcacaattgtgccacagttatcaatgtccatccgcaaccaggctgcagacaaccagggaggccaggttgaatgtaagggccccgtgcgcaggggcccagggtccaaggtttacctgtgcccgccagaatgtatccacattctcaccaggacaggggcggccttacacacaagttccaatggctgctgcattttggcacgaacattggggcttgcaaagggctccatcccatcatgcctggggggccaggtacttccccagtcgtgcccttctgacccagg

SEQ ID NO: 627219 - DNA, 717 bp, Homo sapiens
agaggctgaaaccactgtatattaaaagcttcgagagcactgttgggccaggtgcagacacatacatctacatcttcagggtgtgccgggaagctggtcaaccacactctctgtcggcaggcctggttgcaaagtcaacaaaaagtaatgggaaggagacagtggtagggagactcaacgagactcacatcttgcaacgtgaagtaattgggtatcgatgctgatctataaacgggcgtgtgatgtaatatgacgaaccactgtgtgcgaaggatgcagcgtcgtgcacgtggtgatgatctcctgccaactcgacgagcaccctagcggacaattgtataaccctgtgtctgagtgagcgtggtcaaagatccaagatagtttctacctcttttgatggatggactagcaggcctggactgtgcaccaagagatctcccagcctacagtgtgggttccactcttacttgtcactgtactagcatcacgtggattgctagtctatagtagttaggggggtacctataccagcgactggtagtaggagagccaactggaatggagcagtttccccacttagccttctggcaggatcttggtcaaactggtagcagatgagctgtgactttgtctgccgttctaacctcgaaatgtgcctgcagcatatcagaggtgtgagggatgaccagctggggaggatccacaagaaaggatgac

SEQ ID NO: 627220 - DNA, 158 bp, Homo sapiens
gccattggtccgagagaaattagtatattactgtgatggtagtacaatggttgtgttgtagaaagggaaccagagtatgaagaaaatcatggggactcaaaagtacaagttccttgaggacatctatacaggcatttctaatttctctcggaccaatg

SEQ ID NO: 627221 - DNA, 280 bp, Homo sapiens
cattgggtccgatgagaaattaggagtattaaagagtgtacagataagaataaatggaaataaataaatctccgtgcttcagtgtgcatcaacgattaaatgcggaaccatattgaaatactgtgctagataaatacgtgcttggtatattactgtgatggtagtacaatggttgtgttgtagaaagggaaccagagtatgaagaaaatcatggggactcaaaagtacaagttccttgaggacatctatacaggcatttctaatttctctcggaccaatg

SEQ ID NO: 627222 - DNA, 371 bp, Homo sapiens
taatctaccatacactgagtgctacgatcctgtagcaggagaatggcagtcttaggctaagctaccagtagtttaccaaatcgagagtatgcagtctgtgctctaaggaatgacattctatgtattcaggtggaagaatcaacagccgtgatagtctggatttataactcacagttaaatatatggatcagagtagcctctctcaataaaggcagatggagtcacaaaatggctgtcctccttggtaaagtatatgtggtcggtggctatgatgggcaaaacagacttagcagcgtagaatgtaatgattcctttacaaatcgatggactgcagtagctccccttaaggaagccgtgagttctcctgcagt

SEQ ID NO: 627223 - DNA, 786 bp, Homo sapiens
atatgggaggaactaaagcatcctgtttgtatctgtccatactcagttattttctgtctcttgttgtttacttcctggttcagtgatactttcttaaggggtcgagaattgaatgatgtatctccacctaaggcgtgcatgaatattagagtctattacctagcgcccaaatatagagtaatatagcctggtggtgaggacaactgtgagtcttagttgcaatagcatcctgttatgttctatctccagttcattcaacatcatgtgctgctgaatgacactcttaggactcctgaactgttttatagtgcctaaagtcatacatatgttgagcttgtacagtcgagctataagacgcatacgtattagtatagaagcaaagactaaacaaaagtgtttgaagttgtgtatcctctacttactggatgtagaggctattgggacactctttttgactgagtgcctatatagacattctctgattattgtgaccaagctctaaggacctgcctgctttgagtctaaactgtgagaatcatgctgcgattgctctacagggtgtttatttaatgcagactctcagagaactgaggaaactgatgctggttcggtttgcttcttatggatgacagaagatgtctgaagaacgttgcaaaaatggtacgatgtttgagtagctttaagcgcacttccgtatcacttaaatacggggacctgtttaatactggggttcatttgtaaactttattattcgccttattagaagcaactgggaggttaaaatta

SEQ ID NO: 627224 - DNA, 541 bp, Homo sapiens
tcgtcttttgtttcaatgagaatatagatgaggaaaataaaagtgaaggagaaatttagagcgacttacaggtttctgtgttgtgtgatttggtgggaggtaccattccttaagggagaaaatataggaagaagagcaggggcagagaaagggaagatgaagtcggttttggacatactgagtttgagatatgtatccaagtggaggtgtacagaggcttggtgtcccatacagtttctcatttaatcctttctataatactgtaaggtagatgttactctgtttttaagagatgaagaaaccgaggctctgaaagggtaatttgcataaagtcagttagccagacagtgggcagcactaggatctaaatgtaaatattctaattctcttattcttattgaaagagagggcttttttttgggttataaactcatctatattacacctagacttttaagcatctttttaaagttgttatattcattagtttttatattcattacctaatataatttttggtatacattgaaacaaaagacga

SEQ ID NO: 627225 - DNA, 438 bp, Homo sapiens
cccgatcgcagttagtcgctccatccatgtcttcaccgtccgcggtcccagtgtctacaccatgtgctatggagacatggcggtgtcgccaccctgtgtcttagtgtccccaaatccaagcggattcagctgtaccttccgcacaggcctcaatctgctttctgatggcaagatctgctcaccatgcatccacagtaacctcatcttcgccaggcggatagacattcgcattgtctccctggacatcccttatgttgctgatgtggtggtacccctcaacattaccattaagaacaccattgccattggagtaaatccccaggaagggaatgtgtactgatctgacaggaaactggaaaggatcagtcgagccaatctggattgctcacagcatgaggaattcatcaacacaaggctaaagaacaaagataggcaccc

SEQ ID NO: 627226 - DNA, 277 bp, Homo sapiens
gttccccgccgccgcgtgggttgcgcttattgtacttgtcctgcccccgtcgccgcatactcctcagcgctaggtgtcccctccatcccctcgtacgtcagctcctcacagacgcccgcgtcgatctcattgagcgccttccactgcctcgtagggcagccgcagcgcctcggccgctctggatcgtgctccttcagccctggctggctccacaactcggcacggtcccttcacggttcatgcctcctccacgaaactcacctcagagtcacctggg

SEQ ID NO: 627227 - DNA, 731 bp, Homo sapiens
ggccgccctttttttttatttctggattgggaaaaggaaggttttaacccttaaagttaaaaaaagaaaacatttctcacacagaagaataatctgcttgtgagaaataaagaaattagaaggtgtacaaaaaaatttttcaaaccccaaataagtgataaaaatagagtgtatcctcgtgtaaaaatcgtggacgtaaactattcggctcatgcagggttattcagtattcagagcatgaagtgaaacaccgaagagtataaaaaattaaaaaaaaaaaaaagggaactccgaaaatacgtgccgtgtgggtggccggccctcggcgtgtggacgccccgaccagtgggccacgcagggcgctcggcctcctctcccaccttctccgaagaaccatcaggcctctaaagagctatctctcctgtggggcccgtgcctacagtttgggtggcatgtgttccttctctattaaacttgtgcctcaaatgtgcgctccaaaattctgtcgtgttcttccaacccttacaaattttaaacaggggtccatttgtggcgtcccacagtgggggggggcagaagtataaaagtgtgggggagaagagcccttcacaaccttatattaggcggggctccgctgtggggagaccgtctcagatgaggccaaggaggggggcgggcttccacactctttggtgggcagaaattgaccccacagggcggcccccttgttt

SEQ ID NO: 627228 - DNA, 468 bp, Homo sapiens
gttcctggaagcccatgggggttgaggttttcaagactatcccccttggggtggctttgctgtttgtgatataagacaaccagttgcggggggtgtcatcaaaccagtggacaaaaaggctgctggagctggcaaggtccccaagtttgcccagaaagctcagaagggtaaatgaatattatccctaatacctgcccccccccttttaatcagtggtggaagaacggtttcagaactgtttgtttcaattggccctttaagtttagtagtaaaaggctggttaatgataacaatgctttgttaacccttcagaaggaaaggggaatgttttgtgggcccctttggtttttttttttggggggggcggttttaaggtattagtttttaaaatcaggcctttttaatgggaaccacttggcccaaaatttgtcccagaattttgggacccctttaaaaagtttaatggga

SEQ ID NO: 627229 - DNA, 230 bp, Homo sapiens
aagactcaatgaagtataaataaactacactataatgatctatgtagtaacattaacctgctgaaaaacaataaagaaaactagccccagccagtactattctagaaagaacacagaattggttcccagttcacaccagttccctaagtactcacaaaacacccagttaacaattaattactaatagcaggggtaggtacaacctaccacctagcaggccataatctggc

SEQ ID NO: 627230 - DNA, 589 bp, Homo sapiens
gctcgctacctgtggctgaaggtcaatggtacttctgtttatcatgtccatttgtcactttttgctttcgttacaattatttttgggatctttgtcatgaaatctttttccgttcctatgtccagaatggtattgcctaggttatcttccagagtttttatagtttggggttttacatttaagtctttaatccatcttgagttgatttttgcatatggtgtaaggaagtggttcagtttcaatcctctgcatatggctagctagttatcccagtaccacttactgaatggggaattctttccccattgcgtatttttgtcaactttgtcaaagattagatggttgtaggtgtgtagctttatttctgggctctctattctgttccattgatctatgtgtctgcttttgtaccagcaccatgcttttgtaccagtatcatgcagttttggttactgtagccctgtagtatagtttgaagttgggtaatgcgatgcctccagctttgttctttttgcttaggattgctttggctttttgggctcttaattggtttcaaatagattttaatgctctatgcgtctgattctgt

SEQ ID NO: 627231 - DNA, 213 bp, Homo sapiens
aaaaaattgtgaaactccctgttgtgttctgtaccagtgcacgaaacccctgtcacatagcccctagattgctcaatcaatcacgaccctttcatgtgaaatctttagtgttgtgagcccttaaaagggacagaaattgtgcacttgaggagctcagattttaaggctgtagcttgccgatgctcccagctcaccaaagcccttccttttcca

SEQ ID NO: 627232 - DNA, 178 bp, Homo sapiens
gatactgagatctggggtgtctctcccttccaggaatgctgggcccccagacctggccagagtagagagactgtcaggaagggtcggattctgtaaaagcagcatacagtttggcttttttcactattgatcatttctatatgaaataagaagatcctgcatttatggtgtggttctg

SEQ ID NO: 627233 - DNA, 332 bp, Homo sapiens
cacctatccaaaacatccctcccctcgccgccatgtgcggaaaacactaatctattatctttctctgtgaattctctcctattcctgacacttcatataaatgtaatcatacaatacatggccttttgtgtgcggcttttttctcttagcataagtttccaaggttcaaccattttgtagcatgtacttcattactaaatggctaaataactcactgtatatatatatatcacattttgtttatccattcatcactgatggacattgaggttatttccatttttttggccattatgaataacgttgttatgaagaggtggcatcgataaaca

SEQ ID NO: 627234 - DNA, 714 bp, Homo sapiens
accggtccgtccgtagttaatttgtctccacaaaaggttagtaaagctagggcacaatacatcgctgtgcaggtggatttaaacacccagactttttgccacatttcaatgtgtgcccagtcagaagcaaggatacctatgaagattccgcacgtcctcttgactattgttacttgacatacagtatactgtatatctatagagcatgccaatctttcataagtgtcgacgatgcatgtgagtacgcatgtgctcttcaagcattaagtctgttgttcgatgcaacagaactcagaatatcaaaccgtgttaattgagctcatctcacagtatttatgtgtggttgtaaggtggcacagacctcataaggttcggagtgtgatttaagctgtacaagatctcttacttcgtgaaaaaacaccttaatacgctcctatggtaggagtgttaagtaacgtcaatttttggccgggtttttttgtgttagcccgtaatagttcgcaccccttatacattgtacagaaaagggcactgttttacatatacctttaaacattttgagttgattgatctatatagattgtcagcgacatcattgtcgagtaaattgtcatcacggtgcatttatacatcctcggatattcttcccccagccgcagtgtcctgtgtacatagttgatgcacaaggagtaatctcttaatatacgggaacat

SEQ ID NO: 627235 - DNA, 253 bp, Homo sapiens
ccgcaccgcaccttatgaccttggcaacggttacggccacatcgctttcgccgtcgatgatctcgaagcggcgcgcgcgaaaatcgtcgaagcgggctatcagccgaaagacatcaagaacatgacccacgacggcaagccgttcggcacgttcttcttcatcgacgacccggacggctacaagatcgaagtcctgcagcgcggcggccgtttccaataacgatttgaggacaagatggctgacgacgatttc

SEQ ID NO: 627236 - DNA, 529 bp, Homo sapiens
tcgggctgcgccagtggtggtgggatccgaaggccgaatcacgccgcgtgcacgaccctgaacccgggtccggctcggcgtggatcgatgcacacgcgcacctcgccgggcaagcgcgcactcgacatcggcgtgcggcggcggcatcctgtccgaatcgatggccggactcggcgcacaggtgaaaggcatcgacttgtcgaccgaagcactcggcgtcgccgacctgcacagcctcgaaagcggcatctcggtcgagtacgaggccatcgccgccgaagcgatcgccgcgcgcgaaccgggcagctacgacgttgtcacctgcatggaaatgctcgagcacgtgccgtctcccggcgatatcgtcgccgcgtgcgcgacgctcgtgaagccgggtggctgggtgttcttctcgacgctgaaccgcaacctgaaagcctacctgttcgccgtgatcggcgcggagtacatcgcgcaaatgctggcgaagggcacgcacgaatacgcgcgcttcatccgcccgtcggaa

SEQ ID NO: 627237 - DNA, 356 bp, Homo sapiens
aactgcctagtaggggggacttctggtgctcgccaccgcgcctggctcattttttgtattcttagtagagacagtttcatcatgttagccgggatggtttggatctactgacctcgcgatccgcctgcctcggcctcccaaagtgctgggattacagacgtgagccaccgcgcccacctttttgtatttttagtagagaccgggcatcaccatattggcccagttggttttgaacgagatccacctgcctcggactcccaaagtgctgggattacaggcgtgagccaccgcacccagcttggctttgcctattcttgaacattacataaatggaaccacagtatgaactcttttgt

SEQ ID NO: 627238 - DNA, 235 bp, Homo sapiens
atctagcaggatcttatttgcggtgcctttccctacagctgtgcatattcaggtgacggcatggtccggtgggtacagtgaacaccaacacatcctacaaagccctcagcgcaggggggaaacagcccggtgtcgcctgctcgtgggccttggaggccatcaactattacactcacaggtgagggggctgggggctaaagtgaatcttgtggagcttgggagaatcccgggataa

SEQ ID NO: 627239 - DNA, 685 bp, Homo sapiens
  misc_feature (7)..(7): n is a, c, g, or t
  misc_feature (157)..(158): n is a, c, g, or t
  misc_feature (195)..(198): n is a, c, g, or t
  misc_feature (201)..(202): n is a, c, g, or t
  misc_feature (214)..(214): n is a, c, g, or t
  misc_feature (310)..(310): n is a, c, g, or t
  misc_feature (358)..(358): n is a, c, g, or t
  misc_feature (368)..(368): n is a, c, g, or t
  misc_feature (525)..(525): n is a, c, g, or t
  misc_feature (683)..(683): n is a, c, g, or t
gtcgggnggtttgttttagagctactcgatatttataactttttataagcaccggtcattttttgagaactgatttggtttgtccaacaaagtaaacaattttttgctgtgtggcagtttctttttttagaaaacactgagctaaaacacagaatgnntatttgtttagaaaaaaaaaaaaaaaacttttgagannnnaannaccctgaagaanactgaagacatttacggggcatattaaatggtatcttaaatactagttgtatacctcataatgtctaaggcggctattttttttctaaagaaagtngcatttcattcaggggctgcccagggtttaaattcccccatagttttnctttctttcngcaaatcattctttctgttttgcagttttttccaaacagggccatattggtgggacaaaagtttgatgttcatgcccaacaagctctggtattttatggatacatttgtataacgcaggccttcttgctctgaaccctgggtgaccacaaataaatngaggggccatgattattggatgctgagagaaagtagcatacttaaacccacagtacagataatcaggaggcaagcaaaaacaaagctataacttggcagtggtattcacccaccacttattccaaaaacatattttgcttattaaataagggaaatangg

SEQ ID NO: 627240 - DNA, 469 bp, Homo sapiens
  misc_feature (6)..(6): n is a, c, g, or t
  misc_feature (47)..(47): n is a, c, g, or t
  misc_feature (108)..(108): n is a, c, g, or t
  misc_feature (120)..(120): n is a, c, g, or t
  misc_feature (127)..(127): n is a, c, g, or t
  misc_feature (138)..(138): n is a, c, g, or t
  misc_feature (198)..(198): n is a, c, g, or t
  misc_feature (267)..(267): n is a, c, g, or t
aggagncaggaaggtcttgcttggtgagggtaaaactatgccagagntgaagggcaagtctgaaatatgcccttccagtgatcagtaaattcatctgaagcattactnccgataagaaanttacagntcgtgtaccanaatcgattagtggagatttaaaaataactttaaaaatttggctgggtatggtggctcatncctatgatccccgcactttgggagaccgaggtgggaggatctcttgagcctaggagttcagtaccgccntggcagcatagtgagaccctgtctctacaaaaaaattaaaaaattagctgggggtggcagcacacacctgtagtcccagctacttgggtggttgaggtggaaggatcgcttgagcctgggaggtggaggctgtgctgcgtgagccgtggtcgtcccactgcactccagcctgggcgacagagtaagaccctgtctcaaaggt

SEQ ID NO: 627241 - DNA, 636 bp, Homo sapiens
  misc_feature (427)..(427): n is a, c, g, or t
  misc_feature (481)..(481): n is a, c, g, or t
gctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgagctgccaaagccttagacaagcgcaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcnaggagtctcaggccagggatgtcattgaagagtatttcaaatgcaagaaatgangaagagtaacattgtttggttcacgatgtggactagtgtggagtggtgtgaatgtggggggggttaaattcggggggcgggaggaatgcgggtaaattgagagggggctggtgctaaggcggttccgggaacgaagtgttttttgaccagggggg

SEQ ID NO: 627242 - DNA, 644 bp, Homo sapiens
cagttcattatggaggtatcatggcaactttctgggaagacttaaacaaaagacagaagagaggcatagcgtttgattgaacttgggaatggaccatttattctgagaaacagatgaagtgcccctttagaggtcctgccagtctgatggatggattctctacctgtaatgaaagtaataggaaggatccccttgcccaaagcatggtgggaaagctagcggtgattcttgtgggaagaaaagcataagaggaaatttccaaccaccaataccttgggacattctctgcaagtcccatgagcctctgaaagaggttgaacactcagaagtcacttttgtggtgcttgactggcctgacatcttgcaaataaaccttatcaaaagatggtggaagatgcgtactaagtattccgtagtaactgagagttagtcttttttcacagcctttgttggaggagaggtacttgtaattcacatgtgtaaactgctttataatttaaaaattctttggaatatcttacttgatctttatcatagccttttcagacatgaagagtaaaaaataccgttccattgtacaactgatgtgcagagttgtcaaggtttctacagctgaggagtgtcagagctactggacccagatc

SEQ ID NO: 627243 - DNA, 952 bp, Homo sapiens
gccgaacacctgcgtgaactgcctagcgatggagactaggtgccgagtggttgtctggtgccgaacgtgtgaactaatcgtcgtagtgggtgactgtgctccaacgcggtgtctgcatttccctaggagtagcagattttgatttcggagaggcactgtgtgacgatgtggaaggtgttaagcgtagcaatagttagtatagctggttcttgtgagtctatactcggacgagaattcagcacatgggttcagtgggatacctagtagtgagcagatgcgatgccttgtcgatgggagtgagacgtcagcaaatttgaaaacgcaataaaaggttgtagtgcgaaaagagcgaatttacttgcaagattaggcggactgaaatagactgtgtggagaggatgtccctacaggtccaagccttatgtgaggggaagtgagtaaagacctgactgtgcagaggggtgacaaatcgagtttgtccgccgtgtgtcagacctctgttattggagagctctgtgggcaccgtacgaagtgggatacattctgctggaaggaagttgagcattctcgaaaagtgagaatcatcacgacgagtgtagaaagaattccttgagtgaaggagtggggatcagtattataaaatatggggttgaaattttggcctatcgtttcggtgagcttatcaacagtgacagtatccagagtctcctagaaggtcaatgtgagtctgagctgggttcacatggatcgagagcttgtacctggggggcttcgagtatgtgatgttcacagcgtgaaatggcatttgacacgcatgatgtcaaaggaattgggtggttagaaaaccatttttgaggggtctccactgtttggtggtacctagggatcttggtaacaccgggggaattccaagggggggggaagcggcggttacacacattttttaggggga

SEQ ID NO: 627244 - DNA, 764 bp, Homo sapiens
  misc_feature (238)..(238): n is a, c, g, or t
  misc_feature (262)..(262): n is a, c, g, or t
  misc_feature (290)..(290): n is a, c, g, or t
  misc_feature (295)..(295): n is a, c, g, or t
  misc_feature (339)..(340): n is a, c, g, or t
  misc_feature (342)..(342): n is a, c, g, or t
  misc_feature (556)..(556): n is a, c, g, or t
  misc_feature (610)..(610): n is a, c, g, or t
gctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgagctgccaaagccttagacaagtacgtgtatcagtctcaatactgngggttcttgcaaccggaacaaaantgccacccaaggaagaaggcatggagtncatgngtagcgcaaaattctgaatggcatccgtcctacggaaactaggnngngcgcaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcnaggagtctcaggccagggatgtcattgaagagtatttcaaatgcaagaaatgangaaataaatctttggctggcattcacaagcacgcacaaccaccacacaataacatcaaccacacccaacaacacaacaacaacccacacagagcgacaatacactaataacagcaacacacaaacaaatgtggccccccgcccaaaagaagcta

SEQ ID NO: 627245 - DNA, 1580 bp, Homo sapiens
tcccgggtaccctttgtctgacctgcagtttcctgatatatgaaatgtgtgtaagtaagctcatgtgtgcctgaatgtgtgtagaggtcggtgagggattatccaactcataggattattttaaggattgaatggtaaaatgttgtaaagcagctaagcacttcctttttatttccgagctactataaaactgatgtgtgatttcttttagatgttttcagaagtgtttgcctgtttaacatatacacgatcgtttgttactctcctgttaaactagttttaaaaacatcagtgttcatgaaagtcaaaggagagcaagtccggtcatgtcccaactctactcttaattatgcccctatttatgcagattgtgaagtcattaaagatttgccttctatgtattatttgctattttggggtctacacaaccctatttgcattttctcagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 627246 - DNA, 513 bp, Homo sapiens
  misc_feature (191)..(191): n is a, c, g, or t
  misc_feature (215)..(215): n is a, c, g, or t
  misc_feature (243)..(243): n is a, c, g, or t
  misc_feature (248)..(248): n is a, c, g, or t
  misc_feature (292)..(293): n is a, c, g, or t
  misc_feature (295)..(295): n is a, c, g, or t
  misc_feature (453)..(453): n is a, c, g, or t
  misc_feature (513)..(513): n is a, c, g, or t
gctctttccctgccgccgccgagtcgcgcggaggcggaggcttgggtgcgttcaagattcagcttcacccgtaacccaccgccatggccgaggaaggttctgaagactgccctcatccacgatggcctagcacgtggaattcgcgagctgccaaagccttagacaagtacgtgtatcagtctcaatactgngggttcttgcaaccggaacaaaantgccacccaaggaagaaggcatggagtncatgngtagcgcaaaattctgaatggcatccgtcctacggaaactaggnngngcgcaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaatgcaggagggnacccttgttgttcatttgagagtaagctatgcagggtccagccagtgcatgaggattctn

SEQ ID NO: 627247 - DNA, 761 bp, Homo sapiens
accataacctggtcagctcacaccctaataagtccacatcttctcagtgtttagctgttttttcattaggttattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 627248 - DNA, 635 bp, Homo sapiens
  misc_feature (427)..(427): n is a, c, g, or t
  misc_feature (481)..(481): n is a, c, g, or t
gctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgagctgccaaagccttagacaagcgcaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcnaggagtctcaggccagggatgtcattgaagagtatttcaaatgcaagaaatgangaaataaatctttggctggcattcacaagcacgcacaaccaccacacaataacatcaaccacacccaacaacacaacaacaacccacacagagcgacaatacactaataacagcaacacacaaacaaatgtggccccccgcccaaaagaagcta

SEQ ID NO: 627249 - DNA, 288 bp, Homo sapiens
  misc_feature (13)..(13): n is a, c, g, or t
  misc_feature (74)..(74): n is a, c, g, or t
  misc_feature (77)..(77): n is a, c, g, or t
  misc_feature (134)..(134): n is a, c, g, or t
  misc_feature (172)..(172): n is a, c, g, or t
  misc_feature (209)..(209): n is a, c, g, or t
  misc_feature (234)..(234): n is a, c, g, or t
  misc_feature (241)..(241): n is a, c, g, or t
ccgagatggggcngtgggaccgacctgccttctcatcacctacaccactaacgccttccccggagagtacatcnccnccgtgtttgacaactattccgccaatgtgatggtggaccgcaagccagtgaacctgncgctgtgggacactgctgcccaggaggactacgaccgnctccggccgctctcctatccacagacggacgtcttcntcatctgcttctccctcgtccagcncagcctncttatgagaacgtccgcgccaagtggttccccagaagtgcggtcacc

SEQ ID NO: 627250 - DNA, 1912 bp, Homo sapiens
tttttcccctcttttttttttcgcccccctgtaacgacgccagtccagctgcatcctccagttcactctagagatcccctcgcgaacgtgttatcccaacaatgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtggcaaaaaagtatacaaaaaatgagataaacaaacaaaaacatttttgtggggcgcgccataggcgcaactgaaaaaaaggttttaaaacacacacattcaggtgaggcgcgaccgccgaccccccacaaaatgaacagagacaaaaatcagtgtgcagaacacaaacgggcccacgcagaaagaagcacggccggcggacgtaacgcaacaacgacgcggccggcgaactcactccgcaccaaagataaaaagagaaaggccgcacgggggaaaaccagagcgcgagggctgtcgacacaaacaatcagcagaagagacatctgccggagagcggaactaagagaggggacatcatcaccagcgacaggacacgacagacggcgccgagatcataaaaagtaccccgacccgatcaga

SEQ ID NO: 627251 - DNA, 148 bp, Homo sapiens
caggcgttcaaagggggggactacaagcatgagccaccacatccgggcgagcatagtatcttactagggtactttaagtatccaggcacctcacttgtttcccatagtttctgggcaagactcagtgtcttttttgtggtcgtttctg

SEQ ID NO: 627252 - DNA, 1792 bp, Homo sapiens
  misc_feature (1792)..(1792): n is a, c, g, or t
tttttcccctcttttttttttcgcccccctgtaacgacgccagtccagctgcatcctccagttcactctagagatcccctcgcgaacgtgttatcccaacaatgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgcaaaaaaaaaaaacgaataacagtaacaaaaaactggtgtgcgcccgcacggcccctagaaaaagtcttcataaaccaccttggcggtgggcagcgcgggcccaagtaaagggtataggcaggacccttggccataaggcggtccacagagagagcccgggccaaggcactagtgggctggcttttccaacaataaaaaacgcgcgggggcaccgacgcgttctgacacaacccaaatggccgttcagagccctcccggctacacacagggtccagcaagcgattatctgcccgcggggn

SEQ ID NO: 627253 - DNA, 337 bp, Homo sapiens
cctggctctgaacttagtgcatcagatttttatcagcttaaaatggcttgtcgtaactgtgaaatctgttggtaagcctcattttaaccacggagcaaagtcctacagtagttaacacaaaagataaaaagtggggaatcggggctgggcacggtggctcacgactgtagtcccggcactttgggaggccgaggcgggtggatcacgaggtcgggagattgagaccatcctggctaacacggtgaaaccccgtctctaacaaaaacataaaaaattaaccaggtgtggtggcacgtgcctgtggtctcagcaacttgggaggctgaggtggaaggat

SEQ ID NO: 627254 - DNA, 573 bp, Homo sapiens
ggcagtacattgatctggatccaggctgttacattgaataaaaagattcgattatgcactacgttagcactagtataacttcattttagttgttgcgtgaacaaagagattaatcagtggcactggtaatatccgcacaagtagacaataaaggtccacggggaacgcaccatttctgaaactatcgagcggctacagcagctctataagagttccgcagctaacaggcagaagaagaattttaatgaaaaaattacccacgattggctccatggaaaacggagtgaacaggcgttgtccgtgaaaatttagactgtctgtaactctcgaaaacagtcaatgtgataattgaacttaggacggagtttggctgaagtctgaatatggtcaacctgcaggggtaacttatttttgacctagtcagtttttatacaatgtgcatttgaaggagtgtaattaaaagagagccaataaaatgattttagtcattcagtatatgagtactggaagtgaaacatgaggaatgctttagtgtaatgtgggtgaactttgtggtaaaataatgcacgtaaa

SEQ ID NO: 627255 - DNA, 186 bp, Homo sapiens
gtgcatctaaggttgatctagaggacccctagtgtgaaagcgatgtggtgcagctggggctgggtgagaatgtgatggagaggaagaaggctggccgtgtgtactcattccggagagatgttgtgcatggctgagtgctgggtggcatgcacacctgtgtgtctaagcaacaagtggccagtgtct

SEQ ID NO: 627256 - DNA, 704 bp, Homo sapiens
gacaccttgctccagagcgccatcagccacagccccactccacagcgccgacctggtgtcagcatacaccccgccttgctggccccagcagtgagagggccccatccatggcccctgagtatcctgtaccgtgggcattcatgcggtccttctcgagagaacccgaaatcccgaacaagggctggagagcacagaggcgtagtaaggcttaagcaaggggacacgacttacccaggacccgcctcaggcatgccactactacgggagcagaggtacggattcaaaccacgcatagcagtatccacgagaaggtagacacgagagagggaggcgacacgtcacaatactgataatacacagaggaactataaccgaaatacctaccattgaaggcgtatcccgtagagagaagtaagcactctacgagagaaaactatagtccaagaagatagggaacccacagacagcgataagcgcagagacacggtggaaacacataaggaagtaggcgagataagccaatagagggcgcgcagaaaatacgaggagaagggcaaacggaaatgaggaagaggacaacgaggaacacaaatagagacaaaatgcggaaggaccgcaaagaggaaacaaaggagacaaaagaagagagacgcacgatagagggaacagtaggaaaggcgtgaataacggaggcacagcagggg

SEQ ID NO: 627257 - DNA, 192 bp, Homo sapiens
acaggtgtactaacaagtaccatgtataggttctagtagtactaaaggcctactaccatgacacacggatgctacatagcactcctgctagcacatcttgatactgtggaatagtaacatatacttgctttttagctacatactagctgtaggctataatatcacccctgtattcactaggggatacctcta

SEQ ID NO: 627258 - DNA, 111 bp, Homo sapiens
cactggaattacagatgtgagccaccacacccggccagaacttctgataattacgggtgaaataataaaagtataggccaggtgtggtggcatcgataaacaccgggtacc

SEQ ID NO: 627259 - DNA, 433 bp, Homo sapiens
  misc_feature (183)..(183): n is a, c, g, or t
gggcagcagccaccctcgagtacacagttgacacagctaaccttaccttatgagcacgcctctgttggctcagcagtcagagtaataatggcccgctgcttgatcgtaaagattacgcggctcaggtcagctcagtgtagtaatctgatgcagatgtaccagcaaacgaacgttgctcatganccgtgatactgcacttagttcttctatagggtgatagtctggtacactcgagcgttagtagctccgtcatcagcatgatataaagtcagtgaatcgtcgtttagcccatacgctttctccactgcaggtgtcaggagactggcaatcagtgaagcatcatacactctacctgcatgcagtgtcccagcagtcgattcgtctgctcctatggccattatccgatcaaggtacaaggctatctacacgctag

SEQ ID NO: 627260 - DNA, 285 bp, Homo sapiens
gaactatcacctgtcatcataacagaattctgcttgtcactccacacaacaacaggacttaagacaaatgggcctgatgtcatcttgagctcttcatttatattgactgtgatttatttggcagtggcaggcattgtgtttcaagcacaaacatgtccatgtcagttgtctaaaaataaactgcatttcaaactccatttgcgcgcaatgccttttagtttcatgcatatttaacctcccttgatcctgtagtgtacctggcgaagctagagcctgatagtaggc

SEQ ID NO: 627261 - DNA, 369 bp, Homo sapiens
tgttcagtccccgttgaattccccccggagggttgttttcaaaaccaaccttcccgaatgaatgtcgctcttcaatggaacgtttttcttttgcttgaaggcatttttctctgggtgtaattctaaattaccgggtcagttgagctttttcccctccccctagtatccttaccggggccgggaagggccatagcggatttttaatttttggcgaagttaaaatacaatttttttggggtttttcctaaacctatttatttggtggtttgggggggatccccccctaagggaaccttggttgcctcggctattttgctggctggacacttttgtcacttttgaagcctgttaataaatggccctggttta

SEQ ID NO: 627262 - DNA, 339 bp, Homo sapiens
atagactaagaaaggatcaaccagcagaagcataatagaggatgacgcaattagatttccagaagatgcaaattttcttactgtcaactacacattatccatttatcatcataaatgacttgaactccacaatgactaaaatgtagaactttatactcactttgctatgttaagccccaaagtgaagtccaactggaaacagaaaaataattaaaggaaacttatgctgaccaaaaatgaaggctttataaaaacttgcataccagtcattacaacatcctacctagtgttacatgatttttgtgtaagtgccttatataataaagatggtgtatttca

SEQ ID NO: 627263 - DNA, 309 bp, Homo sapiens
tagcatcatcagcacattaaggccaggcacactggcttacacctataatctcggcgctttgaggtgctgaggagggtggatcacttgagtccaggagtggggaccagccaggcaacatagcgagaccccatttctacaaatggtcaaaaatagccaggagtggtggtgtgtgcctgtagtcccagctgctcaggaggctgaggcaggagaattgcctggagaattgcttgaatctgggaaggtgaggctgcagtgagccatgatcatgccacagcactcagcttgagcaacagagtgagaccttgtctc

SEQ ID NO: 627264 - DNA, 374 bp, Homo sapiens
ggcccttttttccccccccccccccccttttttttgagggccttttaattttgggccctttagggggagggggggccccccggtccccctaaatttggttttatctttcccccccccccccttattggggggggtaataaaaccggggggggtttaaaaaaacccgggccctaagggggaaattccttcccaagaagttaaatttggttttcagggccccggtggctttttttttaatttcccccccccccgggggggaaaggaacgggggtttttaaaaatggggtcttgagcccgttttttggaaaaggttttttggaagggttttttttcccccccccaggggtgaacccaaaaaaatttttttaaatgta

SEQ ID NO: 627265 - DNA, 960 bp, Homo sapiens
  misc_feature (960)..(960): n is a, c, g, or t
gagcaaatgcagaagctgctgcgcgatgattcgcccatggatctgaaataagttctttcgtcgtgctgccctagcgactgccctctcacctgtcctaaagcaaaatataacagttgaacgagattttgggacagagtgaacgagctaggccttgatttccaatattattacttcctgagtgacatttggtcgttcaagataaacacacatctgagattctaataagaccatcccccggctatttatttgatagagtggcctggcttgaaagaatgaatgtcttgatctacgaagagttttgctgatagggcttcaataacccttgtatgttctttacaaagaaaaatcgtccatgaggtgttaattgatgaataccttagcatgccactgtatcggtttcatgctttgggacatctcgtcagataccatctatgtttgggaaacgacgcgattgctcaattaacgataaacttttttgaacggttgcgtgcaatggctgggatgccaaagtgcagtgcctctttttcaccggcctgccttctgtgtaaaccgtccttcgtgcatgacttcatatggaaggaatgtccatcatggcaggacttgagttattgtcttgtgagccggtgtcccatttgaactgttgcttgagcctccttatctgggagcttaagcaggtgtagggccgcgccctagtcgtatcctcctgtgtggcgacccgctaggttcgaaaagaggagttgctatctttggccccgatgtttgccttcacttgggcttgcctttgcgggcagacatttttgggcccttttcttaagattattgtggccggaaattcgggcttcgcagtttagctgtgactgggcacctctcgcggttttccggtgtaacggcggtgtagggcgagttaccgcggttctttgcgcactaggcggggtgcctccacatgagcggcatcatggn

SEQ ID NO: 627266 - DNA, 771 bp, Homo sapiens
agcggggaggtgggagggcaggagcgtcgtcttgccctggcagaagaagcggtaggctctgtctgcgtggcagctggtccccagccctaggagagaagctgtctgtcgttgccatggcaggtgtgaaatacccgggacaggaccctgtggatttagacatataccaagctcccacatggtcgactatcagccctacaggaagcacaaatactccagagtcacgccgcaagagcaggcaaagctcgatgctcaactccgggacaaagagttttacaggcccatccctaaccccaaccccaagctaacagatgggtaccctgctttcaaaagaccccacatgactgccaaagacctgggactccccggcttcttcccatcacaggaacatgaggccacgagggaggacgagcgcaagttcaccagcacctgccatttcacatatccagcttcccacgatctgcacctggcccagggtgaccccaaccaggtcctccagagtgctgactttccgtgcctcgtggatcccaaacaccagcctgctgcagagatggccaaaggctacctgctactgccagggtgtccctgtcttcattgccatatagtcaaggtccccatcttgaaccggtggggacccttgatgccattttaccagtaggaaggatgaaaataccttccaaaggctcttccaagggcatgtggaaatcctatgaccttggagtgcagagaggagaactgaaaataaaactggaaagatgttccaactgcaaaaaa

SEQ ID NO: 627267 - DNA, 109 bp, Homo sapiens
cttctgaggatcccaaacgtagccggaggtgaacaccctgaagagaccctggaggaggaggcaagaccacgaggcccagatccaggagatgaggcagaagcactcacag

SEQ ID NO: 627268 - DNA, 353 bp, Homo sapiens
  misc_feature (300)..(300): n is a, c, g, or t
  misc_feature (353)..(353): n is a, c, g, or t
aacccttcgctgacgccataaaactcttcaccaaagagcccctaaaaacccgccacatctgccattcacctcttacatcaccgccccgaccttagcttttaccatcggtcttctactatgaacccccttccccatacccaccccctggtcaccctcacctaggcctcctatttattctagccacctctagcctagccgtttactcaatcctctgatcagggtagcatcaaacttaaactacgcctgatcggcgacttgagcagtagcccaacaatctatatgagcaccctggcatcattntactatcaacattactaataggggctccttaaccttccccttataaaaaaagn

SEQ ID NO: 627269 - DNA, 213 bp, Homo sapiens
ggcggggatcacagatgtgagccatggtgcccagccaagatttacacctattatttcatagagggtatggcaagtggggttgggctcaggataagatgcacatctcaattattttatacctttaaaattttactggacaaaaatggtaccgggaaaatttggtattcccaggggtaccgggttttccttattccctcatccttaggggatcat

SEQ ID NO: 627270 - DNA, 644 bp, Homo sapiens
aagggcgcagtgaaagccaccgcaatttattcccaccatttttattagggacaacacagggggcattttttaaggtggtcaaaaaagggccaaactttcatacccctaaaaaattcaaactttctccaccggtcctgcggagcacccggacaatttaaggaggaaagcaaacccccaattgttgggcgaaatccgaaaaacccccactgattcttaaaagaacacagggtttcttttttggggggcctttccctttaaaaacaatcagcgtctggctccacaagctttaataaaaaaaactggtttttttcatttggtttagggagccgagggaccaaaaaaccccttttaaggaaaaaaaatcgtttatttttaaaactttgcctaaaaacaaaaaaaagggataaatttcttttatcaccggccccctggaaaaaaaactgagccacaccccaaaaaaagaaacaaaatttaatttcccgggtttaaaaaaaacctctttgtgggaaggggtcaaggaactgaaaacaggtgggctctcctccaatttttcccaaaatttaaccctcaacaccctcttggccgggaaagaagagaccccttttggtgtccttgggggccaaaaacaaacaaccctggaaatt

SEQ ID NO: 627271 - DNA, 1133 bp, Homo sapiens
ccaggggtgtctatcgaagatcccttggaccaggatgactggggagctagggaggatagttcacagccacggtgcaggaatccgaggttagtgggggatgatctcacagtgaccaagcccaaagaggatcgccaatggccgtgaaggagaagtgctgctaactgcctcctgcatcaaagtcaagcagatgggctccggtgaccgaggtctcttcagggcgtgcaagctggcccaggccaactggttggggcgtcattgtgtgtctcagtcgtacgggggagactgacagataccttcactcgctgacctggttgtgggggctgtgcagctgggcgagatcaagatctggtgccccgttgtccgattctggagcgcttggccatatgtagctaaccagctcctcatgaattggaatgagggatgctgggcaagaatggctaagttcgcctggcaggaacgttcagaaatgccctatggacagagtaagcggttgggcaggcaaggcgcgcttgcggtcacctgtatggctacacagactccctccccatcgtgtcagctacaggcagctcgaggccgccggaacaagcacttgcagggtgtcccgtgctagtgtagtgcccacaactgtcgtggagttcgtaccggcttccttagaacttctacagaaagccaagcatcccgtgtagcccgtgttggcagcgtctagctttgcagtcgtgtacttggccaagtcatgttaccgtcggcctcaacttccaccaagtggtctagaggcatgggacgcccgtgtcatctccggggctggccacagggctaaatcccggggggtcaggggccaaaataaaagcgccagtgacctggcgaaacacacccaaggggcgcgcccacaaaccacaagggccccacgtacacgcccacccgcctcggacacaaggggccccaagagcgccaaccaccacgcagcgcgccgttaccgcgcctccggaacacgcacgcgactcgcgagccacacagcgggagcaagcgacaccccacagcacaactcgagacacacagatgtacaccaccgcgcaaatgcataaaaacaacagactgacagacgcacagacgatcaacagagcccacagaacaac

SEQ ID NO: 627272 - DNA, 303 bp, Homo sapiens
tggaatgcaaacatgatatagtatcaggaaacctattattatagttcatcatattaatatatttaagaagaaaaagcaaataattgctgacatagatactgaaaaagctgccaacaaaattcaacaactattcagttgtgttcaccttaatcccaagtactggattacaggtcataccaccacacctggctacttgggagctgaagcaggagaatcgcttgaacccaggaggcagaggttgcagtgagccaagatctcaccactgcactcctgcctgcgcgacacagtgagactccatctcaa

SEQ ID NO: 627273 - DNA, 966 bp, Homo sapiens
  misc_feature (425)..(425): n is a, c, g, or t
  misc_feature (496)..(496): n is a, c, g, or t
  misc_feature (557)..(557): n is a, c, g, or t
  misc_feature (623)..(623): n is a, c, g, or t
agcggattcctttgcggaatcaccatggcggctgggcaccctgtacacgtatactgaaacacctggagggcgcttcagaggtctctcatcgctgctcagtacagtggggctcaggtccgcgctgcgtctccggccagccgaccccgaggttccagtgtgtggcgcgagaagccaagccggagcccctgacatttctcgcgtgtaaattgtccgtgcatgcgctgagtgaggtagatggaatgtaatgatgagacaggtcgactggctgacttgagcgccaaggagctgaggaaccccgttcgatgtcacactgccgcaagcagttacactttagtggtcgggatgtacattcttaatgccgacataggtgagctcgcaagtgtagcgatcaactactctctgatgggcgaactggtcccatagtntatcctgggagtacgacaccgtttgtggactgacacgcgcatgcgtgttaggatcgcctggtgagtaaccntctaggaggttcatctgcgttacccgtggaaaatgaacttcgacatctagggaccgtgtcnattgacgcgtgcaagagtgcactcatcaacgtaggagcactgttcactacgcgcacataggacaangtcttgaagcgagagaattgccttcagccgagtagtcatcccttttctaggatagcctaacaatgagctagactcctatgtctctggggagatcgtggtgtctttcccgaaggttaggcagcttagaccttttcgcgctagaatcccaaattgggcaaggtgggaacttacggagatcagtatccactattgtgcggaacactgagatcctggcaagcgaggaggacccagtaccgcgtgggttaccgaggaggtactttatcctcgggaaggtgggccattccagcgaatgtgtggcaaaagtctttcaactcagggcacagactctttccaagatgaaacc

SEQ ID NO: 627274 - DNA, 275 bp, Homo sapiens
  misc_feature (6)..(6): n is a, c, g, or t
  misc_feature (63)..(63): n is a, c, g, or t
  misc_feature (86)..(86): n is a, c, g, or t
  misc_feature (134)..(134): n is a, c, g, or t
  misc_feature (176)..(176): n is a, c, g, or t
  misc_feature (179)..(179): n is a, c, g, or t
  misc_feature (185)..(185): n is a, c, g, or t
  misc_feature (223)..(223): n is a, c, g, or t
  misc_feature (229)..(229): n is a, c, g, or t
  misc_feature (237)..(237): n is a, c, g, or t
  misc_feature (269)..(269): n is a, c, g, or t
aaactngggccccccaagttgtaaaaatgtatgtttttccctgccagttatcccccaggtagnctgtcaagttgagaagagtgaancaataacttgtatttgttttaaaaattaaattaacccttgataagagngcttttttttttaggagttagcccttgccccctagtttgatnccntccccnttttgggtgccctgtttccccagcaggcctgttcctcnccatgnctaactgngtaagggcttaaaatggaataaattgcttttntccata

SEQ ID NO: 627275 - DNA, 913 bp, Homo sapiens
gggcatgaacattgttaccgtaaatggcacatgatcatggactgaattatgtgacttaaaggatgtaactgcccaaatttgcagattctgggtggtctatgtgaccatttgtctcgtatgcaaaaaccccggggctatttggaacccttccaacacttttgtccttgtgtcatagacaagtgtatatataacgttaccaagatgttggctgtccgtggtgtattgccagacagctctctttgggttcccattccaaatgtgctgcgtgtccttcttatgcatttcacaatatcaaagaaaccacagccttcttgcctaagcagcattttatgccttttattccacattaaatgggaattgtgcctacttaggagtgcccctccaattaacttgacatgtgtccagagaataatccaagctagagacgcaaggtgggaaaaactatttcgaagaaacaaaaagtccgcttaaggcctagtgctttggtctgaacacggtattttattcacaccttggacaccttatatatgaggctataggagctgcaggtggttcatcagggtaaaattgtaagaaaggggaaggatgtgggggttctatgaagaagattatttgtctcattttacccttttcttttattatcctctttgtaagacagagttacctctccaaattgtctgctggcggattcagggagcctttgcaaaccacgggcggcggtccacacattacggctggggcaatacttccggaggtccactgaattgtaagtttgagagttcaataccgcggtggtaatttcgcggtggctagtgtgcctaataaagactacatgttgctttagactctaccccgttttataaagttgtgagagaaattgctacgctgtgaagacacacactgtgtgggcaaa

SEQ ID NO: 627276 - DNA, 234 bp, Homo sapiens
  misc_feature (213)..(213): n is a, c, g, or t
gttgtcgtgaggtaggaggaagacagatcacagcactggtcttgtagtatctgagcgcccggccagccgggccaacaccgtgaggagcttccatccacgagagcatcatcccttagaacgaggcgatctcctctgtcagagcttcggctcttccgggcagcaggtggaccacgggccctgacttgggtaaaggggcttccaccggtataaacnatttatcgaggttatagaagc

SEQ ID NO: 627277 - DNA, 898 bp, Homo sapiens
  misc_feature (330)..(330): n is a, c, g, or t
  misc_feature (340)..(340): n is a, c, g, or t
gcattcatcgtagaaaatgctacaaagctgtctctcttccccttctctcatgtttccctcttttcatcaagatgaaggctgtggggtaagaaaactaagtgatttaacaaattcatttatgatttaaatctttaaggaaataaaacctaaggaatttttgtgggtgttcccttttattcataagcggggtttgcaactggtatattttaactggatttggttagaacctttggaattgggcttctaggaatggtggcactggactaaaccctgtgtgtgtttttaacttcccttttgtggtgtcttggggttctcgggacaacgataatncttcccttgntgagggacgcttctgtgttttaggaaatttttaactactctggttaggggttaacttcccctggagacttttaagtgtgggaaaacgaactatttaagacggtattttaactaatatggggccaggttaatttttatacttttaaaaacctaaatttaaggttctatcttcaaacccctttcacacggcgttagttcacttccttttgtgcaaccatctttctaagggttcaccagcggtggtgtccccacaattataaacgcaaaagggaaagggacattttcccctttcacaagggatctctcggcgagttggtggcactttcaccagcgcacacggagcagcgacacgaccatttttctcgtgggctgggggtacacacatttcaaacgttggggccgacgggtcttcccaggggactttaatgggacttcccaatttaaacacgtggggagagccccccaagagaaacatttcgtggggcgcttccactacgcgaaacaaggtgttgcccacttttcccattaaggacttgtggttttcgtctcaacaatctag

SEQ ID NO: 627278 - DNA, 486 bp, Homo sapiens
  misc_feature (164)..(164): n is a, c, g, or t
ttcattaccacgaggcagagacgctgaaagacatagcaaggagatgagacattaggaaatcagctggcagaacaaagcctcctgggagcagtttttccagatagtcccaatagctaacttggcagcagcaggcatatttcagacatgagccatagaccttttgnctcctatgggcaatgcttccgattctctggagttaatattcgatcccgattttgttcaaagagttctaacatcctctccatgtggtggtcagcctcaatcaccagaacaggggctggcatggggaaaaggctagctttgatgagccactcctcatggagatggtgaattgcttccaggtattccagcggaatgaccttctcctcttccctgcatctcttctttaacctctggtaacaagtctcaggattggtccgaaggtaaagtatcaaatcaacagacacgtccatgttcctccaagatccagtcaaaccattccgagga

SEQ ID NO: 627279 - DNA, 1008 bp, Homo sapiens
ttggacaggctgatctcgaactcctgacctcaggtaatctacccgccttggcctcccggaatgctgggattgcaggcgtgagccaccacgcctggcctattttgttatttatttattttgagatggagcctatctcggctcactgcaacctccgcctccttggttcaagcgatcctcctgcctcggccctgctggtggctgggattgcaggcacatgccaccatacctggctggtttttggatttttatgtggagatggggttccgccatgttggccacggctggtctcgaacttctggcctcaggttatccacccgccttggccttccgggcatgctgggattgcaggcatgagccaaccgccgcgtggcctatttttttattttttattttgagatggcgctgatctcggctccccgcacacctttgcctcctgggttcaagcaattctcctgccgcggcctcccgagctggctgggattacaggcacccaacaccatgctgagctaattatctcttttattttgtctttctgagacagaagtctcattctgttgcccagcctggttgcgttggacacgatctggcttccttgaaccctccactgtgttcgcagtgatcttgtctgcctcaggcctcctgacgtggatgggatcgcaggtctgtgccaacacacttccggctaatctaccatttatgcacaacctgggtttccccattgtcgcccaaggctggtcttgaactcatgaccctcgcgtgacttcacctgcttggctatcccaaagtccatttgtatacagaggtgagcccaacgcaggctaaatctcctccctcatgaaccacgtaacctctcggacattagggccctgtctgtcgctcaacccgttcggacacactcccgcctcgccggacgcgcactcccatacctctatgacctcactacacacgttcgcacactcccatactcacgtgacagcatcatactgcttcctctccttccactattcc

SEQ ID NO: 627280 - DNA, 106 bp, Homo sapiens
  misc_feature (53)..(53): n is a, c, g, or t
cgactctcgcaggcatccccttctgccttttttggccagctttgcacattccntccccaagcacacacatgttcttgtttctgtttattttctcacccaccatggg

SEQ ID NO: 627281 - DNA, 163 bp, Homo sapiens
cagtgaagccacatatgacgaaagaaagagctctatctctctatactacatctccctacaagatctccttagttataacgattgcacagccacagaactaatcatattttatatcttcttcagaagccacacttatccccgagcttggccttgccatatgcaa

SEQ ID NO: 627282 - DNA, 462 bp, Homo sapiens
  misc_feature (415)..(415): n is a, c, g, or t
atggtccaggtgcctggacgtggggtaagaaaagcccaaaccggcatcacaggggtcaagggactctttaggaaagcccatctaactggccccagagttagtatgcttcctgtgtatttttttctggctacgcgataacaatattaacttgctgtatgacgttgtcaattgacttttttttttttctattgggtgtgtcttactttcccctatttctgaaatgagtgttaaatatggaggtgatatatatccatcctggaatgtaagcttcactggaatagcaattcctgtttattttgttccctgctgtctccaaaataccagaaacgctttctcacatgtaataagtgctcaacaaagatttgtaaaaacaattaattaagttacaaatttcggaatccaagtatctttttanattgtacctttcttcacattataataaaataaatgattataattaag

SEQ ID NO: 627283 - DNA, 785 bp, Homo sapiens
  misc_feature (282)..(282): n is a, c, g, or t
ggcgagaatgaagactattctcaggcaatcacgactgtcgacatttccagtaaaatgtcagactagttatcctcgtgcaacgggaacgcactagtttactcgctgaagggacccctagagagaaaccctgccgtgcatgcggaacttcaagtctagcatccaagtgtcaggaagctctagtctcttctctcggggaacacgaaacagattagaaggagcgcgtccagggttgactaaatgcgcttgggcgtaacgagcacagagagaagctggcctcacccngaactggacgtattctgtgagtcgatgatacgagcacaccagtgcatctcaagggctgtatacgactaggcgcttgccggttgagcagagatggagcgtctgttggtatgcgtcagcttctccacgatcaacgattgattcatccaagtgacgaatggggtctcttggttgaaaatccgaaaaatttcataggagtgcacacataatagtatccgcgagggtctcggcatgagcaccaggtgattgctatgtatcacgtatctcacagtccctagataacggatcgaattaaatccttgagagtgaagatgagccatttggaggcttgtagttatccaacagtttccaggcggggcctttcgagttccagggcatagcccacaaacgacggttaataaacaccaagggattatccaaggaacaatccttatgggatggggtatctgatgcttcttcttgaaataacggaaaccgtgtccaggcaggctagatgaactaagatc

SEQ ID NO: 627284 - DNA, 1696 bp, Homo sapiens
  misc_feature (250)..(250): n is a, c, g, or t
  misc_feature (404)..(404): n is a, c, g, or t
  misc_feature (1008)..(1008): n is a, c, g, or t
  misc_feature (1686)..(1686): n is a, c, g, or t
gagccaggaccttcgacaaaggacgtcaggagtgtattgaatgtgcatcgcacctgctatcgtcatatacggggagtattccccaaaagcatgggctgtgtggctcacaggggtgccttctaccgccggcatacacctgcataaggctctcatggctcctggtcgccgttggaagatcataggaaagtccaaggaagagcggtctggacaacccttgacgcagagattactatcgttgcgcactcgcatntgtagtgctcttacccaatcgcgaacgactatcgcatctgatcgccaggatcacggtaaaccttagagacgcgaaaaggcaggcttgaatttgggcctcctagttatccacataaaaacacaacgagcatgggacgagcgacctgcgcgtctgnttgtcctcgtggcgtaccaattgcccatcgctcagagttccaccagggcgaaaattttctcgcgcgaatgggacatcgtagacgttcgtgggtcggagaaatccaagccgagggggttggcagaccactacctacgcaatgaataacattctcgtgtgcgcccagagccactgtgtgtgaacacaaacaccctcgggttgcataacgactatagaaaaacccatgcatagagatacacgttgtactcgttgtgggcctacttgggggttgtgtcggctactaggaccctggtgagaggtccccactagggactgagcgtgccggaagggaaacgtggccttttgcaagcggccaaagtgtacgtaaagctaccgttcctatggcatagcgcttgtatttggaagtgagccgccgccagaggtggttggcgaatgtgtccaacggttcactggaccgccacctacgggttaaccggctaccttggcaacgttgttgcccgaactcgagtggggctgggaagctagcccgaggcctatggcattgtgcctacatcgttcgattcaaaattcataggccccaaaaaaattcacccatagggggaggngcgccgaacacgcggttccccttggagagagaacacatcccccggttggaatggcccgaagggctcccaaagaggcgcttttagaggccacccggttttagcgcgcacgttaggtatataccctgggggggggccacccacaaacaaaagggataggcgcaccacacaccaataatacacgacgaggagaaaggcctcggaaataagtagaaaataaaagaacacacacaaggggcagaccaagggccgccgacgaacccgacaatgtaccaccccaaccagtggtgcgcttgacaatgtgggggaccaacaagacagtggccaaacggcatagtgcggaaaatttgtactggggaaggccagaagggggaaacccctattaatacatctatgggggtggggggtaggattgaaccaaaataaaatttgtgggcgaacaaaaacagataacctgataagacgaagaagaaaattatacaagagagccagacataaagaggggtaaacaaatatattgactgacgttgttagtaaagagaggtgatcttaaaagagggtgatctataacaacaataagggtggcacatagtgatgcatagttgatggacgaatatgagacatagaatgtagtgataggaacacagcgaagaaaatgagacataatacagcagagacagnttgttatacg

SEQ ID NO: 627285 - DNA, 385 bp, Homo sapiens
tgtacatcatacattggctgcaaatccatggaacgaaatactccgccttcgacccatcaatggtcagtgccgaggagcttgaggtgcagaaaggcagtcttcgcatcagccaggaggagcagtagtgtgtctctcgctgtcaatgatgagttgacccggtgtgttcttgtatagtcagtggcatcagcacccgtcaaccggccttttccttcaggtacgtcaggctcaccggttctcactgtgtctgggaagtaggaccgatggtcatcttcatgacaggcggcatctccactaagcctgtgtaactgttccctctttggttttcttagcttctgaatcagacgacgtacttttgaagactcccattttaagaaccgtgcacatt

SEQ ID NO: 627286 - DNA, 117 bp, Homo sapiens
ggttctgagctaggagcccgaggaagagaacccgatgctgggcttccgcggcgcttcgcgctacatcgccgacgacttcgccgagtgcttccgcatggaatgcgaagcgctcaagaa

SEQ ID NO: 627287 - DNA, 417 bp, Homo sapiens
  misc_feature (16)..(16): n is a, c, g, or t
ggaaatattcagatgntgctttggatccacaggaagtaggattccaaattgggggccctcagtggaggacaaaagcattttgcatattgcagtttcattttaatgatggaaagtggtatcaatatagcagttgattagtaagagtgtgtaggtgtaattaggttaaaacttgttcttattgccaagatttttgtaccttaaatgattcactacattttacagcaaagtataattttagttaggcaaattgatgtaaataatacaaaattgaggagagtgaaaaataaaaccctttcccttgtgtgctttcctttgaaattgtttttaagcaaatttttattttttatggaatgttcagaaaagaatgataaattttctaaataaataatccaaataaaaagaaactctgaatgatga

SEQ ID NO: 627288 - DNA, 341 bp, Homo sapiens
caatttaccccttttcctgaataaatttcccctggggtatttgaaggattggcccattttcagagttctgaaagggttaatcccgcccagctttgcaagggccctagttgttttaacccatgaaagaattttccatccccctgaggctctcatttcccctcccatctcccatctattgccttttatttgaaaaaaggttaaattaatattggattcctctagggcaattttctcccctaaccgcccttctaataaatggtccaatggttttttcaccctttttctaaatcctatataacccttgcatataaaacccgaataaaagaccgggttaaaaccca

SEQ ID NO: 627289 - DNA, 164 bp, Homo sapiens
catcctcatccacctcgcccatcccatccctacgcatcctttacataagcgacgaggtcaacgatcccgtcccttaccatcacatccattggccaccagtggtactgaacctaacgaatacaccgactacggtggaataatcttcaactcctacatacttcccc

SEQ ID NO: 627290 - DNA, 873 bp, Homo sapiens
agcggcgggccctgagcctttaaagaatgaaagccctgttatctcagcaccagtcaaggaccacaggtccctcggtcccagttcctccaaagaatcaaagtcctatggttccagcagaaagttaaggatcaaggctctgtggtaccagagtctcgtacagaggatcaacggtcctatggattcctgagccgtgtgaaggaatcaaagcgtcctagtggtcccatggcatcctgtcaaggatgaatggtcccatggatctcagcaatctgtcaaggatctagaggtcccatggtctcagcaccttgtcaatggatcaatggtcccaatagtcaccagtcacctgtcaaagggtgaacggtcccatagatccctagcacctgtcaacggatgagaggtccctatggtgctcagcgacctatcaaggagtcaagatcccatggtcccagagtcgatccgcaaggatgaacagtgcgcatgggcacagcacccataaagaatcaaagttccatggtctctgagcctgtaaagaatcgaaagtttacgtggtctcagggcccacgtcacaggatcaacgatgtggtagtcccagagcagtgcgaacaggttcacgattctgctagattgtcggcgacctgtagaggaatcacaggtcctgtggtccccgagtccgtgaagaatctaagacccccatgctcccaagtactagttaaggatcaagggcccccacagtcctacagtcgtccaaggaatcaaggtcgtatagtccctgaacctctgaagaatcgaagtgcctataagtcccagtgcctctgcaggatccacgatcctctgggtgccagtaccagcaaacggaccgagggtcctggcagtcca

SEQ ID NO: 627291 - DNA, 161 bp, Homo sapiens
ctgtgagagctggggtggagtgcagataggactgacctgtgatttcatggtccacaccaaatcagtcttctagactcagagctattgttattgttgctgtctaatacatagtgagcttttattgtttgccaagtaatccactctccttcactcgcctttcc

SEQ ID NO: 627292 - DNA, 382 bp, Homo sapiens
attcatgcagtgccggaggctaatgctgcgcattcattcagcgccgtccgtaaactgtctgaggcctgctggctccactgaaggcatagttctggaactctggtggtcttcttgtccttctgttgtcctttggctcttctggcactttctttttttaatttatttttgaaacatggtcttgctgtgctcgccctatgctgtactgcagttgtcatgtattaatcctgtgcgtggcgagataacccgtgggctcaaggcgatcctcccacctcagtcctcccaagttgctgggactacaggcacgcaccaacatgccggccatttatttactttttgttgaattttaagggacctcaagtgaaataattatcggtgaattcag

SEQ ID NO: 627293 - DNA, 514 bp, Homo sapiens
  misc_feature (28)..(28): n is a, c, g, or t
  misc_feature (113)..(113): n is a, c, g, or t
  misc_feature (192)..(192): n is a, c, g, or t
  misc_feature (197)..(197): n is a, c, g, or t
  misc_feature (247)..(247): n is a, c, g, or t
  misc_feature (277)..(277): n is a, c, g, or t
  misc_feature (316)..(318): n is a, c, g, or t
  misc_feature (320)..(320): n is a, c, g, or t
  misc_feature (323)..(323): n is a, c, g, or t
  misc_feature (339)..(339): n is a, c, g, or t
  misc_feature (344)..(344): n is a, c, g, or t
  misc_feature (346)..(347): n is a, c, g, or t
  misc_feature (372)..(372): n is a, c, g, or t
  misc_feature (376)..(377): n is a, c, g, or t
  misc_feature (384)..(384): n is a, c, g, or t
  misc_feature (387)..(387): n is a, c, g, or t
  misc_feature (458)..(458): n is a, c, g, or t
ataatttaagtaatatttacaatttttntaagaaagagggcaaacaggctctgagccaggcctcagctttagaggcccatcctggagaggaaatggcacttgcagggaacatnagcccaatcactattgctcactaagcacagggtcacactggagtaatcttagggaggctgcgaggaagaaaagggagtncacanagccatgaagcaactactttaaattctgaatcttgctgtgttcccactgngcatgctgccttcctagagcaggccttggngccatcccagggactaacacagatccttcctggggcccnnncntcncacactagcgtagggngcctngnncatcctcatcattgtttatcatcanaganntcgttcngcnggccagaaatcttccctacttgtggctttaaaacaccagcagggggggagtcaaggaatgttcttgttagnataaatccatagcaaaaacgatttgagaactggatggttcccagggttgggagggg

SEQ ID NO: 627294 - DNA, 461 bp, Homo sapiens
cttgacttgcttctgagaacgggaagaactccggttccgggagttgtgtggcttctggggatacttgcagtccttggtcttccgggagcgcgaatctcagagcctttgtagggcgctctgcggggtcctgtctcggtgggtagtcactcctgctccgggagcggctctgcggtttggacccaccagatgtggagccgctgtcacttttcctcctcttaggagacgctgttcggcgatggggacctcgagtagctctgctcgcggctccggtccgacttccaacctctcgcccctttgcaagccgtcacggtggctgtccgacgttggtttgttggggccctccagtctcctcttggtgtacttcacagacagtggggaaggcttgctccctttaccttctttgggggattccaccagcttgggtgcaggatagtacccctaaggtaccatccagcacctat

SEQ ID NO: 627295 - DNA, 1053 bp, Homo sapiens
ggtgaactggaccgagcactagcacatggtgtcttgtctgtgtatgcctgcgctacccggcaccccaagcgcagggtctgattgtgaacagcgtctcctggaactccactgtgctctgtgtgtggcctgtgccatacgcgtcggtgaaccatggggattggagcacgcttaagtccttcgtgtgttgcctggaacctggaacgtacgagacctgcgatgctcagacatagcgctcggcctgtggtgtaggtctcccctggcgctgtctgtgtgtctgggactctccagcccactcaggcctcccacgtcgccggagggttgtgctggtggtgagggtgtcggtgttggaggttacgctgtgttgagtgccgggctgttcgaggaggactgtgccgtgaccgactgacttcctctatcagttgtagactgtgggttccacgtgttcgggcggtcggagcccgaagggctgtgctgacccgtacatccttaggggcgagtgcgggttctttcggtctgtggcgcgtgcgtgtggctgtgcggagagtcgtcgttcttccacctacatgccgggcgcctgacgtcttcatcgctgtcttgacaccatcgatgtactgccgtgatcgacgtgcatggatggtcactcgcgagtgatgccggtgtgcgcgactctagcgatgggctggtccgaagtttccgctaggctgtaccttctgggacacgcgggggtggccgacccactgttcacgtgaggcccaggagaagggaagtactaaagcaagaaaccatgccgagataccttgtgtgccagctaaccgggcagttgccccgctagaggagatatgttcttgggcgtgccgctccaggagactcttagcgctggacgggggatggtccactacaggggcagcccattgtgtggcccgcagattgtgtcttgtctacatcacgttttactcgtagatgagtctgtctaacaccacttacagagagcgtctatgaactttagcagggtgacaccgtcggacatcttgtaaaatatagtcataatggctc

SEQ ID NO: 627296 - DNA, 808 bp, Homo sapiens
ctcaagcctctaatcccagcacttgggaagctgaggcgggcggatcacgagttcaggagatcgagaccatcctggctaacatggtgaaagcccgtctctactaaaaatacaaaaaaattagccgggcgtggtgtcgggcgcctgtagtcccagctactcgggaggctgaggcaggagaatggcgtgaacccagaaggcggaacttgcagtgagccaagttcataccactgcactccaacctgggcgacagagcgagactccgtctcaaaaaaacaaaaaaaacccagaattcttcttttttttttttagacagattctccctcgtggtcccccaggcgtggaggtgcaggggcacaatcacagctcacgtgcagccttgacgtaccgggctgaagcgatcctcctctctctgtctcccaagtagttgtgaccacaggcatgcaccaccatgcccagctacattttgaaatttttggtagaaacagggtctcctttggccccttttctcagcctcccaaagtgctggaattacaggcatgagccactgtgcctggcccggcagtattctatctccgagcttgggttggactccaacgcagtagagcgttggaggtacctgggtccgtctatggaccttaggggtcataacaacccatggggagcataacagattgggctgctggccaggactcggcgaacatgggacacgacttctgcagaagtcactcgaaggcagcgcggtgctacacgggggctgccgcggtgtccatggcccgggcgtccctgccggggcacggcggggcgggaa

SEQ ID NO: 627297 - DNA, 936 bp, Homo sapiens
  misc_feature (293)..(293): n is a, c, g, or t
cacagacaggtcgtttgtctgctctgaatctcgttaagtgaacgcgttgggttactccggcgcgtcaccgtgtagaccccccggtggaggaccgccttgctgggtatgacgcgttttctgggttaattagaccgtgttcccgttaagaatcataaatggcccggtgtttttagaaaaatacgggcggggggggaaacagccacaagagcgccgggtgtttccttgcaagcccattacacgggtattatgggctaaaaacgcggcggagatatctgcacgggtggcccctcgcntctaatgtgcctggggttcctccccctctccgacctttacaatgtgggggcgtaagcccgcagaacgaaggtgcccccgttccagacgccgaaaggggggcccgagcacagccgggagagaagccctgagccccacacaagagtgacgggaacgaatcccgggtgaatatcacaatactggctccaacgaattccgacgaaccattagtcagcaaacacggaggggccaaccatcggtttataacatagaaggctcccgcgccccccccttccaaaaaagggacgccacccaaagggcgacggccaacaagttggcacctatatccggggtcacttttgactcccccccatgtacacaaagaagggactcataggatgccatataaaagccgataagatgactgcgacacattcctgatggaagaagaagcagaacgcgtgctcaacctgaggagtggtgctattaagaacaagtgtttttgcagaaaaaatgcacccctgtgcctgaagtccccttgtccacccacaacaggttatgtcgaccagactgtatcggaagagacattttttcagtaggggtaaacatcaaggtaactttaaaaagcgaaaaaaaaacagttacacttttcgcccgacatgacaa

SEQ ID NO: 627298 - DNA, 326 bp, Homo sapiens
  misc_feature (72)..(72): n is a, c, g, or t
  misc_feature (189)..(189): n is a, c, g, or t
  misc_feature (209)..(209): n is a, c, g, or t
gatcgagctcgtaccgctctctgtgctgatgccagaatgtatggtgttctcccatggatgctttccctggcnaggtttgtggctccaaccttctgtccatctgcaaaacagctgagttccaaatgaccttccacctgtttattgctgcatttgtgggggctgcagctacactaggtttcccctgctcanccttcattgattgctgccancttacaatctttgccgtcctatgaaactcatgggcctgaggcaccaatgttcctgatccccgcgtagaaaatcccccctattctctaaatatgcgagtgctctaaaccacgacagcc

SEQ ID NO: 627299 - DNA, 798 bp, Homo sapiens
gcccccggtataccaagggaggctcccttctcctagatgggtgtgagtgcatggtcctatctgtacacacacccatctgcatgagggagcccccggtataccaagggagccagttgtgttcatacacaaacatcacagcttgaatcactaactgatgcctttccatagctccacagcttcccacctcctccccaccaataccggggttcgtaggagttaaggatggggggaggcggtattatactgcctctgatctgtactccttcaacctctcgtcagctgtttgtacggggatgagggggaaagaggagctgcctttttggaggcccccttcacctggcagctatgatgcccttccccttctcccctgtcgctcaccatatgccttatccccattctactccctctgtctatgctacagtgccctctggtgtgcttggtccgaacccccttcagcaatcaagagctcatctggggaacgacgagtaatttgaacgaagtgcttgacagtcagcgtctgcctacttccagaagatgacccctcattcttcctttgcgggtatgatgtggaagactggtttcagcccaggaccaccacatgaggagaggatctagacaggtggttgcctagttccaaggggcccttcctggcctgtagaaggcctttgtctgactcaaaaatatacatcagcagacctgcacacatatcacagtttcagcacgagcccctgattgattctctgtacatctgtctgttctattaatcacgattggtcgacctgttcaccccaaaaacaa

SEQ ID NO: 627300 - DNA, 1657 bp, Homo sapiens
tgatattcaagccagagaagcaactagggaccctgaaaactagtaccctaccccagcccgctaccaccctactctgtagccctggatcccctatgctagccatgataggcatgctagtatagtagatatagctagtattagtataatatgatccaaacatagtatatttatcatactaacacaactgtattaggatcgtagcaacacattcaaagacgcactatacatatatcagcaaacaacatagagatagagaagacaagagagaacagagagaagatacattatagaaaaacaaccaaacaagcaaagagaaaactaaacacatacaagcgtgtgcgcggcgagccctgcctccacagaacattaactccactcacccgaccgcgcccggcgccgcccagcagtagcccgccgccaacaacgagtcggtagcttggatgagctagacaaaaacaagaggaggtcctcggacaggaagaagcgacaaggagaattatgtctgagagtagagtgtgagatagtcattgtgtctagagcagggccgttagcgtcgtcatgcggggggtgcataagtgcggtgtggtaaatacagagcgcccgcgccgtgcgggttgtggttgcctgtgctggtggggtggtggaggtgtcgcccccgcgtctgtagcgcgacgtcgtgcggagtcgcgatgtgagtcgccgctggcagctcggcagcgcggccgcgcagccgcccgctgacacccacacgcccccggccgcgcttctccttcgcctccctcccgctcgcccagtgaagcactctggccagctctgacacacgcagcacgactgtcgtccccccccgccgccggcatcaacaacaacgacaagacagtagcagacgaaacacatgacgacgcgcgcccgccgatgtgcagagagactcacggatgcaacaagcaacacgactgacatacaaacaccgcacgaatcgattcgtccgcatgcgtaaccgcaactgtcgaccacactcaccaccatagcctacaattctccaccaacctatacctcatcatatctatgaccatcaccctcggcagcgcaccaccacacaaccggcagccaaaccacggacgccgagggtggtacgcgccgtcgaccgcagccgccgcgcccgcgcgcgatcgcctccgcgcgacgcgcgccgcgccagcgcctccgcccaacagcacgcgacgggtgccaacgcacgtacacgcccgaccggccaggcagaggacaccccacgccaccagcacgaacccaacgatcagccaccctacacccacccgccgcgcccggccccggaccccagtccggctgctcgcgctgccagtgcgtcgtccacaccggcagccctccctcggctgtgtctggctgtcgcttccgcccccgcccggcggcggtgggctcgcgtgtctgcgcgggcggctggtgcggcgtctgcccggctcggcgccccctcccctcacgcgcgtccgcccgccgccacctcagcgcgcactgcgcgtagtggcgccgccgcgtcgcggcgctgccgcgctgcttctcggcggctcgtctggccgctccgtcccggctcgcgcgccctcgcgcccctcgctgaccgattcgcccccctctcacgacgtctctc

SEQ ID NO: 627301 - DNA, 318 bp, Homo sapiens
gcacgaggaaacatctccaagctcaattgaaacaaaactgaatgcaacaagtgtaatcaatgaagaggggcaatcaaaggtgacgaaggaagctgatattgatgacttgtccagccattctcaaaatttgagggcctcattggttaaagcgggcgataatatatcagaagcaccatatgataaagaaaaaaaaattcttgatgttggtaataccttagctgcacataaaagtaatcaaaaaccaagtcattcagatgaacagtttgatcaggaagatcacattgatgcccccaggagtaattcatcaagaaaaagcga

SEQ ID NO: 627302 - DNA, 196 bp, Homo sapiens
gcctggccaaagtggtgaccaccgttcctactaaaaatacaaaaattagccaagcctggatggtgcacacctattaattccccgctactcagaagcctgaggagggacaatcaccttgaaccttgggaggttggaggattcaggtgaggccaagatcatgccacttcactccaggctaggttacagagcaagactc

SEQ ID NO: 627303 - DNA, 198 bp, Homo sapiens
gggcaggttcagaaagcctaaccatataagatgggaaggacatgagggttgacaaaatatgtatagggtacaatgtatcactgtttgagtgatgggtccactagaagcccaaactatcaccattatgcaatgtaccatatatacgcaatgtaacaaacctgtacatgtaccccattcaatctgaaataacagttgttt

SEQ ID NO: 627304 - DNA, 351 bp, Homo sapiens
agtatcacgagctctggaaaaggggacggacgtaaacgtgttcagttaccatccttaccaccagaagctatccacagactctcagcgatgagtgtgtcacgaagctaaccatgtacagtaggcatgagatgaacgaagttctggacctggagttgaaaggtgacatagagacctgcctcacagctatcgtgacgtgcgccacacagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatc

SEQ ID NO: 627305 - DNA, 189 bp, Homo sapiens
tctaaaggtatgaatgtatatactttctcactacttgctaattactcctcgatctcttataatagatcactctgacatgtatatattgcttatttgattattgactataccactaccatgtagacttcatgaatccagatatctcatctgttttagttaccaatgtatctccatgttcttaaaaacagt

SEQ ID NO: 627306 - DNA, 150 bp, Homo sapiens
ctgggttctgctaacatcactccagtttagatgtatcttagcagagagacatgcttgttcctctggattggaacagatgatttactctcgggaatcttctctgtcagcctgtacatcttaaaggcatgaagcactcaaattgggcaatta

SEQ ID NO: 627307 - DNA, 193 bp, Homo sapiens
  misc_feature (165)..(165): n is a, c, g, or t
ccatggtcctgaccaccaactatgacaacctgcatggaggcctttgcgacaggcagaacaagcccatggagtccctggacttgaaggacaagaccaaggtatgggctgggggtgcgggaggccatttgcgacaggcagaacaagcccatggagtccctggacttnaaggacaagaccaaggtatgggctgggg

SEQ ID NO: 627308 - DNA, 374 bp, Homo sapiens
gggctcccataagttgctggggataacaggcatcgagccatcatatctttaaaaatgtaatagaatggaaaatggcaaagcgcgctgcttatcatagaagagactatcgcattggggttcttctgttggccctgcctgtgctagcacgtcctgcttcacagtgtaaagcgcaactcttgctgtgccttattgtaacaggtatagggtggatgctgccatcatgaagagagaggagagctctttgcttattataataccgtagagtggagaacaggatgtgccggcttaggagagggaagaggtacaggcccgctctgcccgagctgcagatgggacacacatatcccgactcagaggggagtcgagtctttctc

SEQ ID NO: 627309 - DNA, 367 bp, Homo sapiens
  misc_feature (317)..(317): n is a, c, g, or t
cgtaagcctgccatttgcattgagtttagaaaatcctcctttagcctcggaggagtttgtattacccaccttctgaagcctacgttctgtcaattcgtcaaacgcattgtccatccagtgttgttcccttgctggcgaggagttgtgatcctttggagaaggaaagtcattctggtttttgaaattttcagcctttttgtgctggtttctccccatcttcgtggatttatctaactttggtctttgatgttggtgacatctgtacggggtctctgagtgaacgtgctactcctttctgtttgttagttttccgtctnacagtcaggcccatctgctgcaagtgtgctggagtttgcttgagggttca

SEQ ID NO: 627310 - DNA, 129 bp, Homo sapiens
  misc_feature (25)..(25): n is a, c, g, or t
acaatgcacttgttattaacccacnaagtgctttacggtgcacaccagtgtctcttgtctggagaaaagaagccattgaaccactaattaaatcatatttcacgtagagacccttgttcttcctctctt

SEQ ID NO: 627311 - DNA, 438 bp, Homo sapiens
  misc_feature (84)..(84): n is a, c, g, or t
ttttatgtcaaattgactttatcctagtgaaaggatagtatgtgaaataaaaatatcttaaaaatggaattgtataaagaatanaatgtctctttttctacacatttattgatatgatttggtggtgtccccaacccaatctcatcgtgaattctggttcccataatcctcacgtgtcatgggagggacccagtaggaggtaattgaatcatgggggtggttaccctcatactgttcttgtgataatgagtgagttctcctgagatctgatggttttataaggggttttccctccttttgttctgcacttctccttgctgttaccatgtgaagaaggacgtgttttcttccccttccgccatgattgtaagtttcctgagacttccccagccatgctgaactgtgagtcaattaaacctcttttctctagaaattaaa

SEQ ID NO: 627312 - DNA, 267 bp, Homo sapiens
tgcagggtcagaaagggatataagatgaagtgatagggtaaatggtgaaattgaagtggtgcataacattgccaaaatagtgtgccagtagaaatggtgtaaaggctgtcttttttttttttttaaagaaaagtaataaccatgtatttggtgaggcaggttaacaaaattacaagttttgatttaagaaggaaagaggaaaaaagaaaaaaaacaaatacccagattaaaaaaaaaaaacacgcgccatggtctaaggagtccatt

SEQ ID NO: 627313 - DNA, 246 bp, Homo sapiens
tcgtttctggctcgggcattgcaccacgcctggctagtgtggtattttagtagagactgggtttcatcatgttggccaggctggtgtcgatctcttgacctcatgatctgcctgcctcagcctctcaaagtgttgggattgcgggcgtgagccgcatccagctaattttgtatttttagtagagacagggttttgccatgttgtccaggctggtcttgaactcctgacctcaggtgatccgcccgc

SEQ ID NO: 627314 - DNA, 598 bp, Homo sapiens
atatctttagactttataaaaacttttggcatatcacttatatatttcatgtagtcaaacaataatcttttcctttatggattccaatttttaaatgatttatatttttaactaaattttcaagactgaaaataaaaatatgaatgaacaaacccctctcaagcaatcatatacaaccaccctaaacaataaaatataatacattcataatacaaattaaaaaatatcatgacatacacacacatacaactgttaaaattccttttcttaataaatgcaaagaatcaagacttcttaattacttacttaaataaatattatacaaacttcattcaattccataaaaactcatagattacactacttcaaaatcaaactatcaacaaatccgcaatacactttttaactgtacattgttccaatacacatttataaattttcaatcaacaatatactttcaaacttaaaacaaaccttttactcttttcaagaaaatagacatcttatatcaaattctacatcaatatcatccctatcttattaacaattaccatttcctcccatagtcatattcaattacaatcaacttccagatcct

SEQ ID NO: 627315 - DNA, 154 bp, Homo sapiens
gaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtgacacgagaaccag

SEQ ID NO: 627316 - DNA, 133 bp, Homo sapiens
ggccgctgccgttcccgaagaggatgaggtttccagcacaagcgaaactgctgcccgggtcggccatccaagcccttgtgggttgtgcgcggccgtggtctgggcgctcctgcttgtgtccgccgtctatcca

SEQ ID NO: 627317 - DNA, 343 bp, Homo sapiens
aaaaaaaaaggaagcactagatgaccaaaaacggggtaattggactcaagtcaccttgaaccttatcatctgacagctttaacccacctacttgacttcatgtcccctgcaggcctcgcacctgagctctacatgcatctgtccaggtgtctcttaaggtgtatcatgtctcatcaaacaggcatctccacattgaggtgtccaggagtggctttttaaacccccaaacacatttcggtgcagtctacacatctcagatgagggtgtggatgtacctccggaaactgccgaacttgacagcactgtataatataccctgtgaaataaattaccctttttgcta

SEQ ID NO: 627318 - DNA, 209 bp, Homo sapiens
gcgatgtgagagataccagtgaagctatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtg

SEQ ID NO: 627319 - DNA, 193 bp, Homo sapiens
tcgatcagaccgtgacggccgcctcggccgacccgaagctttcgcacggcaagggcatgatcaatggcgtgctgcgccggttcctgcgcgagcaacctgcgctggtcgcagacatgcaggcggatccgtcggccgccaccaactacccgatgtggtggatcgacgccgtacgcagcgcgtatcccgacgcctg

SEQ ID NO: 627320 - DNA, 135 bp, Homo sapiens
agggtcatggcatggcactccagctggggcaacagagagacctgtgtctcaaaaaaggaaagggaactccaagttcggaaagtaaacaagttatgcagtacatgatgcgggggagaggatgtggtcaccaacctt

SEQ ID NO: 627321 - DNA, 372 bp, Homo sapiens
  misc_feature (22)..(22): n is a, c, g, or t
  misc_feature (76)..(76): n is a, c, g, or t
  misc_feature (98)..(98): n is a, c, g, or t
  misc_feature (109)..(109): n is a, c, g, or t
  misc_feature (167)..(167): n is a, c, g, or t
  misc_feature (172)..(172): n is a, c, g, or t
  misc_feature (174)..(174): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (190)..(190): n is a, c, g, or t
  misc_feature (194)..(194): n is a, c, g, or t
  misc_feature (219)..(219): n is a, c, g, or t
  misc_feature (233)..(233): n is a, c, g, or t
  misc_feature (244)..(244): n is a, c, g, or t
  misc_feature (255)..(256): n is a, c, g, or t
  misc_feature (279)..(279): n is a, c, g, or t
  misc_feature (318)..(318): n is a, c, g, or t
tttagaaatccccttacgctgnttaactcaaaagtcccttcagagtcaagaaccaacctttcatggtccataaatntggtatttctggtttcctgttnagggggcttgnaaacctaaaaatgttcttccttccaaaaactaactaacctgaagtataaaacctcagncggcngnattttntntttntggnaaanctggctgcgctttgtttttgggacncagtggggcaagtncctgtggcagngaacgaattgnnccctcggcctctgtatgtgagancagcccagccacacccaggaggaggcatcccccgatgcnctgcagcgcatcctccttagagagagaacgcctgtcaggtttcggcaaagaaaa

SEQ ID NO: 627322 - DNA, 387 bp, Homo sapiens
actggacacgtaactcactgtgtgagaggccccagtgaggactagaccatctccacctgccccagctcctgcagggatggggtcctgaacactgatggcatgatcttggtgcatgtgcttgacccatgcagacacacttcaccctgcccacgatggctccagcctgtcacctcactgacacacacctctggggtgcagctctctgccagccccgagaccggctttgttttgttgggcacgggtcttcgcctcacttggagaccagccggctttcctgggggacacacggggcccccggattgcctctgaggagccccagaacaagcacagacccgtggactaacgatccagctcgaaccatgggccccgagtcaggaagacatgcgt

SEQ ID NO: 627323 - DNA, 168 bp, Homo sapiens
gctcggcccggataagcggctgatgcttattcacattaacagaagggtggtaacacatgctaaaatacattgaatcatctcaggtttctgtataatgaggcctgcattcaagttcagcaagataatgatccttaggaccaaggggaggaatttaagggaaaaataacg

SEQ ID NO: 627324 - DNA, 170 bp, Homo sapiens
ctggaatataatttgcatgagggtaaacattcttgttttacatcattgccatattttcattatgttgaacagtgccttgctcttagtaaaggttcaaggacatatataagctcctggctgactaaattaggttgaggaggttgggggacaattctctgcatatatacaga

SEQ ID NO: 627325 - DNA, 551 bp, Homo sapiens
ctagggggaaagcgaccgtgaacccggggagagagctggcagtgagccggagatcacaccacggcactccagccggggcaacagagcgagactccatctcaaaaaaaaaacaaaaaacaaaaaacaaaaacaagaaagggtgcagccactctagaaaacagccgggcagttcctcagaaacttacacatagaattaccatatgacccagcaatccaacacctaggtatataccctaaaaaccggaaaacagggacacaaatacttctaccggtatttcatagtagcacttaacaatagccaaagggagggaaacaagctaaaggtccaccaaatgatgacgggataaacaaaatgtaaaggtagcctagccatacaaggaaatattactgggccataaaagggaatgaagtttagccaacaggggtggctgggaacggtagtctcagctactcaggaggctgaggcgagaagattgcttgagccggggaggtcaaggctgcagtgagctgtgatttacaccattgcactccagcctgggtaccagagtgag

SEQ ID NO: 627326 - DNA, 158 bp, Homo sapiens
aagagtacattcttcttgagagtagcctctataactctgaatattttatcactagtattccttatggctgccactcttatttacctttaaataatttctgaaatgtaaccttttcagaactgcattgttgaaacaagataaagatcgcctttcgatag

SEQ ID NO: 627327 - DNA, 981 bp, Homo sapiens
  misc_feature (21)..(21): n is a, c, g, or t
  misc_feature (77)..(77): n is a, c, g, or t
  misc_feature (84)..(84): n is a, c, g, or t
  misc_feature (89)..(89): n is a, c, g, or t
  misc_feature (235)..(236): n is a, c, g, or t
  misc_feature (239)..(239): n is a, c, g, or t
  misc_feature (243)..(243): n is a, c, g, or t
  misc_feature (255)..(255): n is a, c, g, or t
  misc_feature (261)..(261): n is a, c, g, or t
  misc_feature (274)..(274): n is a, c, g, or t
  misc_feature (285)..(285): n is a, c, g, or t
  misc_feature (625)..(625): n is a, c, g, or t
  misc_feature (764)..(764): n is a, c, g, or t
  misc_feature (767)..(767): n is a, c, g, or t
  misc_feature (860)..(860): n is a, c, g, or t
ctttttcttcacagcttgtantgaacacaatattgcccggttttaaaaaaaacaaaaccaaaacattccgaaaatgntccacancctcncgcctacctgcccttcccctcacctcttgcgcctgggctctccccctatgcccccatccctccttccctcagattgtctgggttgccgtagtgtgttgggatgtagtaggagattctcaaagtcgtgtggcgcaggttgcccaggnntangtgngcacttgttgtngtgtgngcgtgtgtgtgcnggtgtaggggnaggcaggggggtgggggggtgtggggtgtgggagggtgggtggggggagccagatgaaatgaacagaaaaggggaaaaaacccagacgactgaactgcccacattgacttacttgtcccagaggcgaaagtcagaagcaagggcacggatcatgctctccgctgggggagtatgggggcaggcaggtgggcgagggaagaggcagggaagagggcacggagcacagatgtgaggaagcggcgccaagtcaccacggagaagcgggaggtgctggcggaccaggacgcagaggctgctgtagctgccgtcccctgggcagctggccgacaagactgttttnttgcagagtgcgttctcttgagagcgtggtggggcccatcttccctctccccaccctttagctagcccagcatggttctgaacaaaatgaaagtcttaagggccatagaggggaaagaaaaaaaaagagaaccagcacnttncaaagcgaccatccccacatccattcctaggacgggccctcagggcggtgggtgcatcgtgaggagggagcggcatgggatgttagcaccagntatttacagaacagctcgagagcgcttcaggaacgcgggcaagtccaatctgcagagtggccaaatgagcagtccccacccagccaaacctcagaaagccaatcagatggtttcagaacag

SEQ ID NO: 627328 - DNA, 1420 bp, Homo sapiens
  misc_feature (1)..(1): n is a, c, g, or t
  misc_feature (947)..(947): n is a, c, g, or t
  misc_feature (1081)..(1081): n is a, c, g, or t
  misc_feature (1090)..(1090): n is a, c, g, or t
  misc_feature (1094)..(1094): n is a, c, g, or t
ntactacggggctgctttttgtgtgcatccctctgcagttgccctcggcggtccccgcatctcaccgccgtggttgttggccccttcccattaggaagagccccgcgtggtcccggttttctgctctctccctggagttttttagctcctttagcccccgccggggggccggtgattacccaaattttgtccgaccacacccacggggaacccgccttgattgccccccacttttaggcccctatattttttaggggtgccacaccttatgtgaggacaacaagggttgtgtgtgccccaacaaaataccctactggccttgggtgtaccccggtgttccccgggaaatttttcccccccggggattatttgctgtctgagcccacacaaggcggtcctctcgcccacacttcgggccaagggccgggggccaaaagaaagggaggagattcctcccgggggcgggcgggccccggtgccgttgggggaagacccccccggggggaacacacaccacacaatggggtaaaaagaaaagcccgggaaaaaagagccccgccgcttcgcttgtagtctgaacttctgcggaaacacaccacagaaggacaacagccgggtcacagcggacggcaggagaccccctgtgaatcacaacgaggacttctctctgggtgcccccctcgggccacaaaagtctgagataagtgcgcccaccgctggagactctctcgagagggagagaaaagggagggcccccccctcgctggagaggtccacacccgctctgacaaagacctctcggtgcacgagaactctcgcgagagacacgctgtctcgagcacacagtggagacggagtggagagttggacacactttgtgggagagccacacatataaaaagtataagagaagagataagggaggaaaatagccaccgagaaaatantatagagagagaagagaaggggagacacccactgagaagagaaaccacgggcccacacacacacaatctggcctccctccacggccacgtttcacgagccacaaagacacacgttttcacagctcgaggaggcntccacagcncccntcgagagggagaaggtgtataagtgtgttcacagagactctctcgagacacagcacacccacagcttcctctctttccacagtgtcacagagattcacagagactctctttcctcacgaagaatgaaagaagtttccactcgatgggctatggaggaagacctccactgggaggatgagggagagacacacgggcccgctctggagaacacgatgaccacgagaaaagaagaagagagcccagaactgttcacaatcgcacataagagaagagggaggtgttgtaaaagaagatttgaaatccagaaaaaacttaaaaccagccca

SEQ ID NO: 627329 - DNA, 689 bp, Homo sapiens
ggtcagtcaggctgtgcgtagtcgagcattacatcgacgtctgtgctgcctgtgaccgtgagtggccttcacgatccgtgagtacctttgaggctcgagcgtgtcgtcggggtgttgcgacaccatcaatgtttccgtcctagcatatcgtctggtgttccttggttgagtgtcgaagctggtgctgctgtggatgtgtgtgtgtgtgtcgctagcccggacggccgacgcagtcgtgtctggacacacgacgccgtgagtgctggcgcagcgcgcagagcaccaagcacggagaggtggatgcctggcccggccagcgagtagtcgggtcgcaccgtcagtcctgcgtggcctgtcgccacctgcccctctccttcctctcctccccggggcagcgggcattgctgctgggcgaagctgcccgtatcctgtgagaaggtgggcgagcggggctcctgcgagcgactgccagcagatgattgttaagctgggtggtggcactgccattgccggctcctgagcagtcatggctcaggccacctcctccacctctactctcgatttctctctctccccctcagcagtcttcccgtgtggtagtggctggggaggagccttgtctggttagctgtcagctgtgcgaggcgttctgggtgactcaggcgcagtgccagccctgggcatgaggc

SEQ ID NO: 627330 - DNA, 102 bp, Homo sapiens
tcttattgaggatccctagctgcatatggtgtaggcatcactggtggctgatgcagtggcgcctgccttggtgaccagagcggcacagccaagccccagctg

SEQ ID NO: 627331 - DNA, 184 bp, Homo sapiens
  misc_feature (103)..(103): n is a, c, g, or t
agcatacgcactatgcctaggttcatttgtatcatagtagagatggggctatcacaatgttgggcaggctggtctcgaacttctgactcaggtgatcacctgnctctgactcccaaagtgctgataaatatctaagaactggccgggcactcaggcctgtaatcccagcactttgggaggctat

SEQ ID NO: 627332 - DNA, 1337 bp, Homo sapiens
  misc_feature (1)..(1): n is a, c, g, or t
  misc_feature (312)..(312): n is a, c, g, or t
  misc_feature (463)..(463): n is a, c, g, or t
ncacgccaccccccccgctcgttgaattggggggcgccccaaaagatagagagaggaaggaaaatataaatgttgggggcgcaaaagacgaacaagcgtcgttctgtgggtctccaactccccgagggggggacccctccctctaatgaggggcgaccaccaccaacaagaacgtctggcggcaaatcctgctggtagagtggggggtgtattctctccaaaaagaggggattctctcatggtggtggtttttttgggacaagaagatgggtagatgggatcgttcttttttccgctgatgatgaattttcnggccccaaggagatataggagatagtgagaaagtgtcgccgcaagatatttttgatgaagaagaaaattgttctcatacgacgctgtgagtattgttcctctgggaaaagagagtatgttttcctcagggggggggtgtttagaagaaacntctgcgcccgctccttcgggacgagattgtaaacaagatgtgctccactactaggcgccgcatctagaagggagtactctggtggaccaccccccggtggcgacacacgaaaaaataggaggggggcgtctcacaatgggggtctccccagatatatagtgcggcgcgacgcgacccacagagagagtgtgtatagactctctcaccggtgtggagagggtctcacagagacacttacaccggatggagggtaacactttgtggttctgtgtctctgtgttctctgtgttgtttgtggtttgttacagtataaataaaccgccccccgcccatcttctaagatatatctcgcgagaagagcctttctttatatgcgctctatggcgcgccccaccacagagatctccgcccaacatatccccggagaagagaagagatgtatgtgtgaaaaattatcggagccccgaagagaggtgccacagagcacagaatgaacttgtgaaagaaaggtgggtctcaataaaatggaggttccacagacgcacgcacattgtggaaaagaacacaataggaaagggctgttccacactctttttatttctcttcttccacatgagaggttttctggtagaaacaagattaaaatagttgtaagaaagaccccacgatttgtaattgtgggaagacttcactggggactttcactggtgtaagagcccgcttgatttctgggaaagacccctggggaaccaaacccgcggtgcttaaattgttacgcgactgatggatatggaccccccggcccccgagatttgtttttaaggttccagacttccaattagtggccacaattaaaagtgctatttttggaaaa

SEQ ID NO: 627333 - DNA, 270 bp, Homo sapiens
  misc_feature (189)..(189): n is a, c, g, or t
aacgatggtcctcagcttccttgaagtagcttggccaagatggcgaaacccatctctactaaaaatacacaaattagccaggcgtagcgtgtgggcgctggtaatcccagttactcagggaggctgaggcaggaaaatggtttgaaccagggaggcggaggttgcagggagccgggagatgactcgcantgtgccgtccagcctgggctgacaggtgcgaaagctccgttctcaatgacatacaaaacaaaacagaaatttcgggtgtag

SEQ ID NO: 627334 - DNA, 1022 bp, Homo sapiens
ggagaactagtctcgagttttttttggggttttttggatgttaatgactttactttgagaatatgatggaaaaatattacaggtacacttggaaaagacttgatcaccaagtgaaaacaatctaaccaaaaagctttaacgtctgtcagttaagctgaagctgaaattcgggggagctatgactatgctgcagggccaaaaggaatggataattagttattcctctccttcttcctacacccctttatacccccttctagagccaaaaatataaaaaaaacaaaaaaaaaaaaaaaaaaaaaataaaaaaaaataaaaaaaacaagataatcctggagggataattattatttgggggggggtggagaaaaaaagggagttaataataagatgagggaaatgtgtgtgtaaaaaaggagtagtgttatctataaacaaaatattattttgttgtacaaaaagaggtggtaaaatactgatgagggacgtccctataaaatataaaggagacctaagtaaatatataatctctcctcaataaacccgcgagaaatacaccccctgttttatatcattcttctcaacaaccaacacatatatatacaacaaacaacaacaaacaaaaacaaataaaacaacactaactaaaaaaaacactaagaaaaaaaacaaaataactaacataacacatacaatagtatgaaaaaaaaacaaaaaaataataattacacaaaccacaacataaaaaaacataataataaaatacagtaaaactacaaacaaaaaacaaaaataaaaaaaaatatattagaaatgaaaaattaacacaataatatatcaattatcataattatagattaaactaataattaattaaataatacaagtatagcaaaataatgagaagataataggcaaatagacaaacacgagacgcagaaataagagaagaaacaatcagaaaaccagcagagaaaaaaaaacagaaaaaaaagaaccacaaaaaagtaaccagaaacaag

SEQ ID NO: 627335 - DNA, 369 bp, Homo sapiens
tcagcattaacattaaaatagggatcctggccaggtgccatcgtcacgcctgtaataccagcactttgggaggctgaggcaggtggatcacttgaggtcaggagttcaagagcagcctggccaactggtgaaaccccatctctactgaaaaaacaaaaattaatcccagctactcgggaagctgaggtaggagaatcgctttaacccaggaggcagaggttgcagtgagccgagattgtgccactgtactccagcctaggtgacagagcgagaccctgtctcaaaaaaacaaaacaaaacaaaacaacaacaacaaaatttagagatcctagtcgaccggccgcgaatttagtagtagtagtagtagta

SEQ ID NO: 627336 - DNA, 196 bp, Homo sapiens
tccagtacccgagcatgcatgcctgcctgccggtcgacgtgtattcaacactgcggtgcatgcctccctgaacaagttccgtcgaaacgatgagcaccgatgctgacctaccaaatatcgtaaaagctggagccaggtcgacgtgtatacaccactgcgatgcattgcctccctgtaacaagtaccgtcgaccacg

SEQ ID NO: 627337 - DNA, 137 bp, Homo sapiens
tgtattttcagcaaggactggtctattctatactacttgtaattacactgaattcacccccactgaaaaagatgagtatagcctgcgtgtgaaaccatgtgacttatgtcacaaggccaaagacataagttaagtgg

SEQ ID NO: 627338 - DNA, 152 bp, Homo sapiens
agctatggtatgcaagtccctaacacacagttccataaactttacctcaccctctttatcaccctaataaaatgtttgcatttgggtcaaaagcgatggctcacgcctgtaatcccagcactttgggagcacaaggtggggaagcacacagg

SEQ ID NO: 627339 - DNA, 1185 bp, Homo sapiens
aaacacagaactaaaagaaaaaatccaacggtggcttgcagagaggaaacaacaaaaggagcaacttgaatagatactgtgaactaaccaaaccaaaaccaaccccagagtgcagataaacaatgtttgtggtttctctctttctggttctgttccttttctttcttcttttctttttctttttttttttttgttttaactaaattagaagaactgggtctggctggaaattatggatagttaagattcctaaagaacttgacaaggtgtcccctgggcttgcagggaaattatacttattatagcatcaccaagtttagaaatcatcactaattttcaccctcgtggtgggtctcgttcaattttcttcttccttttcctaaagtgaaattatagttatttcaactactaaaagttccgggcacccgggctattgctcttccaattacgggttcaaacattttggggtgaggtgcggctttgataacatatgtgagtgtcacatatttcaggtgacagcgtgagtgttatcgagaaaaatccgggtaatccggggatatatactagatcctcagtgatctagacgttaagccgttttcgtgtgttacaggagtaacgttcacataaaagcagataccttcaagtttggtgtagacttctgaatcacgatgatagaagaagaaatttgtttaacacgggattcaagggaatctgtgcacactccgtgggaaaaagcattaaacatgggtaacaaggctttaaagcgagcactggctagggcaaccgaacacatggatggggcctagacaccgttgcgaccctatacgctaggaaatcggtcacacaggacaggcccaagaattaggccagcgatcaacccagaaacgcactaccaccaatcaaagcggaattcagggagaaatacatagatcacccggcatcaggggaactggaaagcacaaattctcagaagatcatgatcggaaaacacaatactgcgctcgcaaattacgagcgtgatagagctcctagaaaagtgaaatattctttttttttctttcttttctttccttctctcaagaaaaaaacgaagaaagaaaagcaaagagaagacagaaaaggaaagaagaagcgaacgggaggaaggaagagagaagagagaaagagagaaaggaaagaagaggg

SEQ ID NO: 627340 - DNA, 269 bp, Homo sapiens
catgatcagagtcatagttctaggaacaggaagacaaacccagattatgcgcacacaagtgtataagtacatgtgagccctcactcatgttcatacaacatggcagtgacacacatacattagacaagagattattacacactgagactccacccagtctccctatatatcctcccatgggctcctaattgatgactaaacagtgcattgctgggtggctaccagtagtttcatacttcacctaagctgaaactatagaactgacggtg

SEQ ID NO: 627341 - DNA, 928 bp, Homo sapiens
gctgtggaattgagttgacaagagcatgaaggcatattcccagtgtcggtctgatactatttcgcatctgaagaatgggttgactcaagatcttgggttaccaagatgtcttcaatgtgcagtgaatatcttgcttacagtccagtagctctaggagcatgttgctgattgagtatccacacttatagatacgttggggctacagcttgttacctagaatttgagatactaagagcaagtgcgagtttgaaatgcccactgggtttctatctgtgtgtatggagagagggtctcattctgtcacccaggctagagtactgtggggacacgggtcatggctcactgcagcttaagctcactgcctgggctcaagtgatcttactccagcctcccaagcagctgggactacaccacgcacaggtatgcaccacatacctggctgatttttaaaattttttctagagatgaggtctcactatgttgcccagctggtctcatactcctcagttcacgcattcctcccactccactcccaaactgtgggattacaggtgtgaggcacatgccaaaaccactgatctttaatcccacatgtgggcataaagaagtcactatattaatgttcacggaaagccaagaatttaacgaacatttctgactatggaaaaaatgtgtcctttcagttgtctggtgaatttctagacaaagtgacggttgtcaacctcagagtaatattcttaaaatgtactctggttttatcctgcttcttatggaattggatattgggtgaattattacatgttcatacagggggttgatatggcccatgatttaggggcggttaacgaattacccaccggtgacagccaccgaggacagcgtggggacccgggtatagggtcatacaaaaaaatttggccgagtacag

SEQ ID NO: 627342 - DNA, 394 bp, Homo sapiens
ggcaatgcatgtgagaggcgggggcacgacgacggaccctcaccccagacaccatgagcaccaagcagatcactagcaggtattctatgcatagtgcgtgtagggaaggatgtcaatgcctattctcacatgacttggccaacagtagaccgttcaccatctgcatgtactaccagaagggctactgtgcctatggaactcgcgagagatatgaccacacgacgccctctgctgcagctggaggtgctgtgtgcaccatggaccactgtgtgccctacccaagtttgcacaattctcagcctagttccgagggcacatgcgtccattgtgaagactaactgacatgatccaggatagcgtgaaatgagcattggttcttagagccgtctctctg

SEQ ID NO: 627343 - DNA, 609 bp, Homo sapiens
  misc_feature (345)..(345): n is a, c, g, or t
  misc_feature (348)..(348): n is a, c, g, or t
gtcctcatgggctcctgccctgggcctggtggtaggttcacatgtcagcaacacgagctaatctcacctcacagttactctaatttctcgtgtctgtcaagtttcccaaggaggagttgttttcccaaatcagcctgtttctttttataatataagctgtttagaggccaggcacagtggctcacacctgtaatcccagcattttgcgactcccaggcgggcagatcacctgaggtcaggagttccaggccagcctagccaacatagtgaaaccccatccctaataaaaatacaaaaattaggtagggccaggtgggggcccccggggggggttgggggcttcancgncccataaccccaggactttgggaggccgaggtgggcagatcacctgaggtcaggagaccgggcctggccaacatggcgaaaccctatttctggtaaaggtacaaaaattagctggtgtggtggtgcacgcctgtggtcccaactactcgggaggctgaggtgggagaatctctagaacccaggaaacagaggttgcagtgagccaagatcatgccactgcactccagcctgcgcaacagagtaagacactgtctcagaaaa

SEQ ID NO: 627344 - DNA, 1564 bp, Homo sapiens
  misc_feature (1205)..(1205): n is a, c, g, or t
  misc_feature (1358)..(1358): n is a, c, g, or t
ggattagacggcgaccgtttgatcgtacatcgtgtgtcacgccgccagacgtctgatggtctcgacaagtcactggcgtcttgtgatccgtcgtgtcgacctctcaccatggtcctagacgcatcattggtgcgtaccgtagatgtatcgtgccaatagagattagaggaacagattccaagcacgccataaaggacgtactcatcgaacccgccttgtgatagaccataggcaccctgggtacttgtcagagctattcaaggggactgatggagccgatatccaatcttcaatcactcgctggcacatgacaatggttgccattcgccctgtggaactatcaatgccacgatgtccgcgcacaatgttgtccctcgtaaaaaacccagtgctagagatctatgtcagtacgatcacaagtcactagggataataaacgctgtgggtcctctcaccatgggcgttatcaatgaggcccagtacgtcactaagaaggcacaaggaacgcatagaatacgacacgtaggtacctggggtattgcgaacacgcagagagacaccgacggcacatgtatagcggccttgtggtgtagagggaaagcaccgagtggaaaccaggttgggcctagaaacgtgggaagagcaccgcaccctaagccttttgatttggcttatgctcgattggaccatcgtgactgtttcgccaacaagcaccggtttctacgcgaccccatgtaggggcatggacacgcacatccaacacgaaaaactgtccttctaatgtcgtaggagaatgacggttgaaatcatgatggcaagcagaagcaagttatgttagacttccccaccaatttgctgtgagggaccatagtgtgtatagacacactttttccttatgggctctttatgggcccccgtggcattaggttcccaggtaaaacggatcaggtttagcgagggggaggatcccccccgtttaaccacgttggtcgacttccaatattccaaccagtggcgaacaacaccggggccatacgggaacctttgtcaggaaccacggttctttgacggattcacccaaccacatgcgtgcagattagaccaccccttgaggcaacaccaaactattggtatacgacgacccttgttctcacgccaacacacaggtgtttgaaaaatcattatccgcagggcatacacgaccnagaacaaagaggcaggctttttttaggaggcatttaaacagcactatggagtagaggaaaataacgcttatttccaacagcgaacctctaattttcacaccaaacattaggaaccccagaatcttaccgcggcattagtatagcgaaatctcnccaggaccccgggtaccacaacattagtaggaaggagtgcaggccacactaggtgtccctcttaggcatgagtcaccccaagacgagggtcctgtgggtgacggacgacacgggttaatttccagagccagaagaagcattaccgagagagcagagtcgccaagtacacgggcgttaacaagcgaacattttgagactccactatc

SEQ ID NO: 627345 - DNA, 397 bp, Homo sapiens
atgtacagagttcagcaaaggacaatagaggcccacaaaatactagttcacatccacttggatggctatataaaaaagatagaacaataacaagtgttcacaaggtatgtggagaaataggaaatcatacactgctggtggaagtgtacagtattgcagctgctttgtaaaatagtttggtaggtttttaagaagttcaatgtagagttacacaagacccagcagttcccctcctagatatatacccagtggaaatgaaaacccacatccacagaaaaacatacacatggatgttcatagcagccttatttaaaatagtaaaaaagtggaaacaatccaaatgtccacctcttaaattactacaacaataccaataaagttatagcaaatacagtct

SEQ ID NO: 627346 - DNA, 790 bp, Homo sapiens
aagagcacctttcacccgcactgtttagttcggcccaccctacccctattaaaggttggaaaattcctgtttaagggctttatataccgaaggggggtttctcccgcgcaaatagaattcggtttgggcctagattaaacatatccagaaccagccagccggcttttataatttgtgccaaggaagtaaagttcaagcccagtcttctcaaaggggcaactttaagggtaataaacgcccccgcagtctcggccattgcttctctataacaggtatcgtatgtgcagaaatccaaaaaaaactgtacactataacctaggggtaaaggttgggtactagccggatgggatcgtgggcatttcacgtaacaagtcctggccgtgctctaaagtggaaatgtcaccaaacaacaggtgcatgccagtgaaatttgcagaaattaaatgggcctcatagagctgctcgttagtggaggaccagtccgtcctagccctttaataattctgctgcctaagctggtgggggaagcctacacttccgtttcccaactgtagctgttaccctcagcttgttttgatagaaccacaatcagcacagcaagatagtgttgtaggccagccagggagcacttgtgtcatagaggcgtcatgcccggccctaggtttatcgggatttaaacaggcccaggagtggtgttgatgcgtgtagtccatgcccgtaggagcatgactttgagaggtccacttgggcagatatgttcggtcccagcctggacaacagtctgagcccc

SEQ ID NO: 627347 - DNA, 780 bp, Homo sapiens
cttcctttcaggacgaggccttttaccccccctggttaaatggacctgggtccccccactgtgttatatcttgtagagttcttaaatgatttctaccccgttccccctttgagtgtagagtattaaaggttttcacgggcccacctgtttccttgtgctgttataatgtctggttacctcgtctagtatacatttgtcttttaaagttatggagtgcttttttaaccacgccctcttatgaaggccgcctgcctgaaacattgaatatctgggggataagggttaccccgtatgcctcttctatgagccacgaaaaaggggacagaagacgcgtgtctgtatcttcctcggtttggtaaccctccacgtctccctgtacagagcgctcctaaccacacactggcgacggtatatcaccccatcacggagaagggtatactgcctgcaataggaggcctcgcttgccgagtgtacttcccttccccagtattattcatccacgacttatgccaccacgtgcaccacaaagccaacctgctaagagagccacgtggacaccccagcttttcccccgctaggtgccttttacatcgggtttgttctccttccctggtgtgttgctgaccttgtccctgagtcccctgtgaggtgctggtgagtattacctttcatctgtgccctgctctagaaccttgaccttgatagttcaccccctctgatggatcccctgttttaaataaaaaccattcacctttcaagccttacaccaaggaaaaataa

SEQ ID NO: 627348 - DNA, 143 bp, Homo sapiens
cgaaaattaactttctgcaatcacatagaaaggttgtgctgtgctttggcaccaaaccacttgttgtccaatcttgttaataattcctccggttttcaacaactccttcagcaccaattatgacaagatctgctttctccatg

SEQ ID NO: 627349 - DNA, 115 bp, Homo sapiens
cttccctcatgtttcagaagcctgctgacagctgaatctgtgacagataacaccttttcatctacagtggtccactggagtgactccagtgagtctcggtatggcttgaaacccc

SEQ ID NO: 627350 - DNA, 182 bp, Homo sapiens
  misc_feature (72)..(72): n is a, c, g, or t
  misc_feature (93)..(93): n is a, c, g, or t
ttcactgccattcactgcacgcactgccatcactgccatcactgccatcactgccatcactgccatcactgncatgcactgccatgcactgcnatgcactgccatgcactgccatgcactgccatgcactgccatgcactgcaatgcataacatgcagtgcatgcactgcatgcactaagcg

SEQ ID NO: 627351 - DNA, 858 bp, Homo sapiens
gctgttcttgcctccggagccctctgatcctgtatatgcagtgatgctccgagggccaggcacctgcatgctctgataatagattcagcccctttacagaccgtcgtcgcgttaacacaacaggatgctagtatgactatatgatcactactagcctctcctgccgccagctgcatgctagccgccgccgacacaccagccgactgagtcactccattactagctatatctacttactacctgcatgacagttgttattacttacatctgagcagacacacagacttaccagatgctcgaggtgagaaacatagcctatttcagttgaggagctaactaggtattacttaattcatcagccggacagcctccgtcgatactatatatcgttccctgtcctcttgacgagacccgggatggtataggagtagcacttaaaagaactagaaaagtggcaccagaaacagcagcttacacgaattattacgatactactatgattaagtagcaagctaggagactaacttaccccccttgcatctttactgaactcttcttggactagtaaaatacatggggctatgagactttggaacgaatttaatagacttatccacctgtaagaatgctgtactcactcaggttggagggggcctatggcgtggttcaatggaccgtgagcagcggccaggactctactggagggtgaccccatcgagactaatcccccagactgtacgaaagagacgacggaaaggtcctcaaccctccaatcatagaggcagaccactctaatgggttcgggacaaaaatgccaagcccaataactggcacccttatgtcgccgcgcacccgtat

SEQ ID NO: 627352 - DNA, 1340 bp, Homo sapiens
ttagtgtcgccgctctgccgctgctttgctcctaggctgcttgcttaggcctggaggatcgaagctggcggctgtggcggtggcgtgatatggcggcggctggtgatgcggagcgggacgagggaacgggaggaagcgagcgaggagcgcgcagagcgcgcttttccgtccgcctgaggagccgaagcattccccggccccgcgctgcgcgtcgccttgcccagttctgggacaaatgccgagatgtccgctgcccacagcgcattgtactcggtcatgcctgggatgctgggcaccagcccaagccaggagcctgcgccataccccaccctggaacctgtggccattcagcgaatgccctggtgcaatgtttacctcatgactattgcaccaaagcccggggggacgcgtcttctccaccacaccgggaggaactcgaagtcagtttatgaccagaaagtttctgttggatcgtcgcaattctcccatggctcagaacccaaccctgacatctgcccaatatcccaggcagtcactagccctggcaaccttaattgaaggactccaaagtagaagtaaagcaatttgaacaacttgaacaatcacgacaggaaacatgcagttggggatgatgctcagttcggagatggacattcttgacttctccttgcacaggatttagcaagaacacagccagcaaacactgatacttgtagtgcacctgatttggccaagtaaggatcaaacaagtgaatacgcaccgaagaaggccataccatctagtccgccattacaagtctccaccttcccagtataccgtccttggtgttgccaaaattgaatgggggagaattgatcgcatttcattctgggccagttgtctatagttaccgtgtttacggtgtatccccttacacagtttaagccagggctacgaattgacattgccactgcacagtataactgtagaggaatggaggcgcttataacggagcaacggtctcgacgcgcttacgaattattcgctagttttgttatgtcttgatataggagaggcgccgagctttataaaaacccgtgtgtaaactttctggtgcccaccagacgtaagggtgttttaacggaagcaccaacaacgaggtagccaggaggccgagacgagcgctgagggggagaggtgtagaacagcgagtgcgtgtggcgctcagaacagcgtatgtatattgttcctactcgacggtgtgctgatctcctagtgtataccagacagatggcactcggtcgagcactctacgtgttagagaaggtagaatatactagacacaggccggtgataacaa

SEQ ID NO: 627353 - DNA, 256 bp, Homo sapiens
gggattacaggcatgaccccccatgccagacttcccattttactttttgcaagctgtttccctagcagctccctttaggggagaggtgaaatcttgcaagttgtagcaagagcccccaggaaacccctaactttcttataccccacccgccttttcccctttttgtcccgggatacctgggggcaaaagactttttggctattgtccatgctcccagaatcaagcataaatgccagacccggggattgagaagcca

SEQ ID NO: 627354 - DNA, 877 bp, Homo sapiens
agaacaccaaggcgagtaatgtagttatttccgctcctgtctccatctgacgacgagtgtagttccacggcgctcaatgttccctccccctccactgcttggcccttgggttgggcggcccccgggccaagttccgacaccatgccgcctactgcgcgacgaccccccaagccttccgggccgtaagccagccctcttgagttctgccgcccacaattcggtgggcaccccgatattgtggtccagcgcgcttcctcactcccctgtgaaagcggcgacaccctgggttttcaaagcccactacccggaacttttccctaaagggcaccaaggggagcagggtctgcgaaaaaacccacgcaaaggaccatgggcccactactttttgtcacgcggcgtagacctgcttccccgagaccgacgactacggtttctagcgtgggacttgcgttcttcagtagaaattctctctgtcggcggcggcgcagtaacgagaaaatcttttggtagccggcctgtatacgccccacccagggtgggcacagcatgaacaggcatccaccggctaagtttccgtgtagatcagatttccctgtgagaaggtgaccccggacgattataaggcacccttaatgcactcacacgcctattacgaagatcacctgacagaattagttacccagacttcattcttacacccacatccacagtcacacgttacagaatcttcctgaaaccgtattgttagtactttgaaagattacggcattagactaccacgtagagcactctcagggaggacgtccacaccttacttagagggaaaggagtttgtccccgggatttttactataatgtttatgatccggcaacatga

SEQ ID NO: 627355 - DNA, 489 bp, Homo sapiens
ccagaagcattaaacatattactagaacattaatgtaaaatgaacccctttactgcgtcaaaatgcctaatgcgaaacagccggcgacatttatataaagacttaaaataaggccaaaggaagagaagcatcaggaaaaactttcaatgaaaacagaaaatttttgccaatcttaaaaattacaattactcatatcattgtgcacaggatttttcttgcttccaaatgaaaagttagaagtgcttattttgtatctaacagctcttgaaacatcagtaggttgaggaaggtgctcattaaaaccgatttttttactcctgcagtttgaatactgagaatgtcgacagtttgttaacacaattgacagatgtaacaatacataggaacccttataaaatctagagtcatgagaagaaaaactctctaatattgaaaaaccttcactttgctttaaggaacaagtataaataacaattaacatttaatgag

SEQ ID NO: 627356 - DNA, 1031 bp, Homo sapiens
ggagaactagtctcgagtttttttgattttttatggggaatcgaatattttattaacatggtacgttgcctttgtaacatgtgcacacacactcgcacactcaaaatgatctgccggggggaaaaaatactaaaatagtgcctaggaggggaacagtgaaaaataaaaaaatctccgtgtaggtttccatctatggtaggcaattatgtccacatcacttacaagagctatggccaaatcgtgtccagaggaagcagagttgtgaatgtgagggcttagagaacgaggaaattctggggaaaaaattcaacaaggtggcatagcaagaagactctcgaatatgagaaaagcgtgactatagagtggtgggacttatggcgtggtgaaaatttcctctttgtggccaaaacaatattgcggcgaaagacagggtttaaattacaaagtggggccagacaaaaaactaaaggaagacagagagccgcggtgtgtgaaaagcactcagcggccctctccgatgacagtcactcaacactcctctacctccttacacaaaaataactgtgcgtcaccacggggatccaactcgaaacggaaaaaaacgtggccctataagccctactgttcatcacacggtgggaaaaaacccgaaggatgttacgaaagacaaaaccgtttcttccccccaaagtgagggacacagagggggctcgttttcaccccccgttcacagtccctcgattataagggggtgttgtagacagctgtaacccacaaagatcgtggaagcggggacaaaggctccctcatagaccacggggggtcttctctccaagagggggcaacaaaacattgtgataccccccgtcgaagagtgccacccccattataacaatgctcataacagaccacaacgactgctacatattacctctgaggcaaccctccgtgcaagagttttctacacccgcaaaacaacccggtggcgtgtctccgaggcggatctctctattaccgatttaatatctaca

SEQ ID NO: 627357 - DNA, 440 bp, Homo sapiens
  misc_feature (387)..(387): n is a, c, g, or t
aactatcatctgttgaacgaagccgccttcgaacagatgaaaaatggcgtgatgatcgtcaataccagtcgcggtgcattgattgattctcaggcagcaattgaagcgctgaaaaatcagaaaattggttcgttgggtatggacgtgtatgagaacgaacgcgatctattctttgaagataaatccaacgacgtgatccaggatgacgtattccgtcgccctgtctgcctgccacaacgtgcttgtttaccggggcaccaggcattcctgacagcagaagctcttgaccagtatttctcagactacgctgcaaaacttaaagcaatctgggaaaaaaggccgaaaaccttgccccgaaccgaacttggttttaaatccttggccggntccccttgcattccaaggggagctgatttcagattaatccccaatgacccttt

SEQ ID NO: 627358 - DNA, 104 bp, Homo sapiens
agtaacatatagtactatatagttctgagtgatgaaaaacagctttacaaaccccatatttcaaagatctctcaggctgcgcttacaacacacactgttcgcct

SEQ ID NO: 627359 - DNA, 1400 bp, Homo sapiens
acaatatttaaatatctaaaaatttaagagatccatactttctgtagctttacaattaactttaacgtactacacacacagaccaacggacatctcttcttacacgacacactttatacgcactttactgtgtaactttaacactgctaacgtccagaacgtactctgcaccttacggtactacccatctttactagccacactacactgacattcttaactgacactggctcttctatcacacgacttgtacaccctataactgacacggtaacactactactggctatctgatagtaattacttgccacacggcttaccgacacttacaccttggaatctctcgctacacactgtacttgagtgcaacacccttcgataactttaaaacacagctcgagaccacacacacacaacagccacacgattatatatcgacagcggtaactatttaaagaaccttctaacgtaacacctttcgcctaataattggacaccttacaacacaaccccttcggacataacagccctaatgaacatatcctttggttaacgattatacacgtgctccggggaccgggtttgcgcgacaggacccgcccttaaacgccgccctatcacacacttagcaacaattcacaaacggccaaatattacacaaactgcggtatacaccttacatcaatactacttaggatggaaaggattctcacagtttcaagtacgatccgcaccagggcaaccaacagtacgtcgcatgccatagaggcccacccgaaatatgctatattatggaagtaccgtcatactatcccattatccaaaccaacacgcgttgaatcactttattacacccaacagtttcaacccttgtccttcaacctttagagattacaaactcacaacaaccttacaactatcacattttccccccaacagacaaacaatttacaccacttaaacattaacaagcgacattaccttattgatacgccacgccaccggtattggcgagacagcatctgcaccaacacaacacgattcggaaggaaaccgatataaaaacttatgcaccacaacgaacaacatagttacacacaccagtcaactaggtcccgagcaagaagacgacttgatgccgctataaactcggaacatacaggagcaaaccccactagatatcctagctactatgggggagcccatatacctatcgacaatacagacttaaacgatttactatctgaacgaacaacgatctcgtataacaactattaacagatcaagaggaactcttacgaccgatgcagtcagtcaaatcgcattaaatccgcgtgaccaactatacgggcacaataacaactgcacacatacctttaatccttatagtgcacgctcca

SEQ ID NO: 627360 - DNA, 143 bp, Homo sapiens
tctatttaatgatattcacagacttgacattattactcatgtgaagaatcttgggcccaaatcactagctaaggaaaagtcagcttcggggactccttagggcaaacctgcctcccttctttcaaaggcatcccctgctcact

SEQ ID NO: 627361 - DNA, 395 bp, Homo sapiens
cgacagtatgccacaggtctgacccattcacccaggcggtacagggcgttggagaacagcaacgtatgacggtcatccagcgcttcgccctggggttgagcggcgtcgatcttgtcgcgcagcaggcgccagctttccagtggcgcggcttcggtggtgctttgcagccaggcgctggcatctttcagcagcggcgtgagctgatcgagaaactctggcgcacggtgctcaattggcgtacaccgcatcgtccaaagcgtcgatcacttggcagcaggtgaatcatgcgcccgcgcagttccttggtgttgcgtaccgtctgcgggcgtgcgccttcgtggggcagctggccgatcatcaaattcaagggtgttgaaggacattcggggctcaag

SEQ ID NO: 627362 - DNA, 257 bp, Homo sapiens
  misc_feature (218)..(218): n is a, c, g, or t
caggaaattcagaacagaactatgagaagtacaaattggttatagtatatgtatcaaatttctatatagattttatacctcagtggggaaaaataactgattccaatgacatgcatttagtattcatctgtgatagtcatggatgcttgtattgtccttggggtgctgaaattgaggaggaataaagaggctcttggaatatggttttaatttctctnctacaggttattttttggttatggtctggtgggactgtc

SEQ ID NO: 627363 - DNA, 107 bp, Homo sapiens
gcggccgcctactactactactgctcgaattcaagcttctaacgatgtacggggacatgccactgcactcctgcctgagcaacagagcaagaccctgccccaaaaaa

SEQ ID NO: 627364 - DNA, 109 bp, Homo sapiens
ctgttaaccatctatggcattccccatctcagtctatggctgttccatccttctatgctcaggacaaaatgcttagacttctcctattgctcctccgctctcacaagcc

SEQ ID NO: 627365 - DNA, 193 bp, Homo sapiens
tgactaccacaaagggaaagggcccctggtccaggtggacacgtgactcgggtgaactatcgatcattggagatgactagcactcctcttggaagtccctcatcttgattaccttatttaagggcacctcctcacagggcctaatcttttttttttttttttttttttttttttttttttttttttttttttt

SEQ ID NO: 627366 - DNA, 270 bp, Homo sapiens
catgtgctgtaagccagcgcccagtacctcacgcagacactagtgctcagtaaatgttgtccgtgattgggataaccttcgggaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctggcctacagcacatg

SEQ ID NO: 627367 - DNA, 346 bp, Homo sapiens
  misc_feature (291)..(291): n is a, c, g, or t
tgtttttgttattgttgttttgtgatagtcttgctctgtcgcccaggctgcagtgcaatggcacaatctcagctcactgcaacctcgtgcctcctgggttcaagcaattctcctgtctcagcctcctgggtagctgggactacaggtgcatgccaccatgccttggctaacttttgtatttttagtagagacagggtttcaccacgttggtcaggctggtctcgaactcctaacctcaggtgatccacctgccttggcctcccaaagtgctgagattacaggcgtgacaancagcgcctgggccctgtttgtttttttaacatgatttttctctaagcttaaatac

SEQ ID NO: 627368 - DNA, 140 bp, Homo sapiens
  misc_feature (3)..(3): n is a, c, g, or t
  misc_feature (47)..(47): n is a, c, g, or t
  misc_feature (64)..(64): n is a, c, g, or t
  misc_feature (116)..(116): n is a, c, g, or t
tgnagaaacggacactttgaatggccagtttatggtgggctttatcncacacataaaagggttntcggggccactcaattctaatcatggctactgttctgtggaaattgtatcgntacaattccacaacataccacccg

SEQ ID NO: 627369 - DNA, 241 bp, Homo sapiens
aaagaatttattcacaaggtattttattgggcagatgccttaaatgtgccaaatgaattattttggtgtacagactactcaggtgacatctaaagagaaattgcccactatttcataaggtgactctctgtttagctcttttttgaaaggggaaaggaggatgtgagtatactctgtatcatctcacatttatataatagcagcacgagtattatagagtgtgtgtagagtagcgcataga

SEQ ID NO: 627370 - DNA, 400 bp, Homo sapiens
agttataagccacacctcccccccccccctccccagaccacaactcagtttccccaacactgcgtgagagttttgcttttactatgcaagaaaagatggtgggttgtgctttccacattttggggggagggcggagtgatgacgaccaccgatctaactactctagaccagcatgtaagaatatcacaaagctggacgacaccacccaccacacacacaaaatcctttctatattccccgaccctcgtgcaccgaaactacaatcaccaccctctcatacgcctcctttattgcccggcgggggcgctctccttcctcccactctccgaaaaactacaacatacccaacaagagctctcactccccgtcgccgcgatactccgccccaccctcccccacc

SEQ ID NO: 627371 - DNA, 81 bp, Homo sapiens
aaaaattttaaacccccccttgttaaagccccaaaaaagggggggggggggggctattaaaaccgcttttttcccgtttta

SEQ ID NO: 627372 - DNA, 846 bp, Homo sapiens
cagtacacattttttttgcgtgtgagttttctctccctttattgggcacccctttgcgtgtgaccttgtacgcgcgggttcctaggccacatcatattcttttgctggctcctctggtgtacggacaccgcggccctgtgtattggggaaaatccccgtgctggtccaccggacacgggggtctttccaaaggggccctgttttataacccagcccttgtcttgacacacaagctgttctcatgtcaaacaccatggggcccccccacactggaagtatagccgccaactattctgctagtagtcaggatgcccccggcccccatcgctgtgttgcacaaaagcatgtgatatagtgccccaaagcaacagagatctggtgttttgaagcagacaccccgtgcagtagtcgcgtccaaaatcaacagttggaacggattggggctatattcatgctttggggaaaaaccccccttttgccctcctgtggcattcgtcttcgttacgctctcttacataactcagaaatccgcactaagacgtcattgactcactccccggtcgttacacaataggcatcgccccacacagtaaatccgctgtaatgccctctgttatcaattggagggcattcacaaggttcattcctgaatccccgcgaaacaccaggacattattaaatacttcctcttgtataggactccgttacacaggtacgggccaatctgttcattaacgagagggacgaaatcatcttcatgcaccccaacaagaactcctagaaggtaggtcttgcccctcaacctcaacgggtttcttttgccttaaaaaaacattcgtcatgtca

SEQ ID NO: 627373 - DNA, 301 bp, Homo sapiens
  misc_feature (37)..(37): n is a, c, g, or t
  misc_feature (154)..(154): n is a, c, g, or t
atctaatactacactatcttaatcactataataatcnctcgtacgcacaacctcttccaactctttatcggatgagaaggcgtaggaatcatatcattcctgctaatcggatgatgacacggacgaacagacgccaacacagctgcactacaangcaatccatatacaacgcgcatcgagagacatttggaatttgtccgtaatccatagcatgattctttaaacccactcaaagcgcatgcagattttcacacaaatctttatactaacacaatgaatgcccaaacataccattaatcgg

SEQ ID NO: 627374 - DNA, 342 bp, Homo sapiens
  misc_feature (9)..(9): n is a, c, g, or t
  misc_feature (27)..(27): n is a, c, g, or t
ccacccccnggccaccaatattaccanatatggcccccctaccccgagggagggaaaagaggatggggtaggataagttcaaactgcctttaaagggctaacaaaattcacctttattccctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcact

SEQ ID NO: 627375 - DNA, 130 bp, Homo sapiens
ctattcaggtgtgtgctgcggctctgcctcttattcaaagaggggcagacacccagtagacatattgaggcagtcgcctaatctccactgatgggagagacggatggacgagttctccaaggctctcatg

SEQ ID NO: 627376 - DNA, 232 bp, Homo sapiens
aggatgtcaggtgcagggtactcccgtccacatctatccttctttatttatcgtataaaaagaggtctctatcccgctattgtggctctcgcaccggtttaacccgcccttttgactcctcttcactatatagtttgcgttttttcttttgattcgtactccattttctcaccgcaccttcttctcctcggtccatctttgcattgggttttcatcccccagccccgtcttc

SEQ ID NO: 627377 - DNA, 739 bp, Homo sapiens
catggtcccgtttccccgcgcacatttttcatgcccgcgtttgcccccctgacccaccgggccaaccccccagtaccgggcctgaccgtgcccgagctcaccccagcagatgtttgatgcccagaccatgatggctgcctgcgacccccgcccatggccgctacctgacggttgcccccgtgttcaggggccgcatgtccctgaaggaggtggatgagccaatgcttatgtcccaaaccaaaccgcagctattttttgagtggatcccccaccaatgtgaaaacggctgtctgtgacatcccaccctcgggggctataaaatgtccgcccccttcattggcaaccagcacggccatcccggagctgttcaagcgcatctctcgagccagttcacggcccatgttccggcgcaaggccttcctgcacatggtacacggggcgagggccatggaccgagatggagttcaccgaggccgagagccaaccatgaatgaccctggtgtccgagtacccacggcagtacccggatgcccaccaaccgaggaggagggcgagttcgaggaggaggctgaggaggaggtggcctagagccttcagtcactggggaaagccgggaagccgtgtgaactctttattcactccccgcctgtcctgtggcctgtccccctgtgtgcccttgctgttttcccgtccacatccctgctgtaccagaccaccccacccttaaagccttttcata

SEQ ID NO: 627378 - DNA, 100 bp, Homo sapiens
gggtatagttctcatccaaaccactaatttcttcccacccattgggggaggagggaaatccactccaactctgttttgttgtgctttagatccagcagtg

SEQ ID NO: 627379 - DNA, 174 bp, Homo sapiens
ctaatctttattatttcttccttctgctaacattgggtatagtttattctttttctagttcttaaggtgtaagatgaagttgctgatttgaggtctgtttcctctcttcttttcaatccttataccttatatctctttttttctcttattattcctttggttaggtctacctgg

SEQ ID NO: 627380 - DNA, 858 bp, Homo sapiens
gaaaaattaggaatatcttgaatttgaaagggacctaatgcctggcacagtggctcacgcatgtaatctcagaactctgggaggcagaggtgggcggatcgcctgaactcaggatttgagaccagcctgccaacatggtgaaaccctgtctctaagaaaaaataaaaaaatttagccagggtagatggcttgcactttgtgtgtccccggttacttcgggaggctgagggctcggagaatcgccttgaacctggaagcccagggtttgcggtaactggagatcaccccagttgtctgggttgacaatttgataaccctcgttgtttaataacacgggataacggagatgttcgcgtgaatctgggaatccctaaatctgtggtttacccttgaacttttcctatatgtgcccagcgttttggaacatattttgggccctctatcacctttacgtgtggtccatttgcgaacggtaagagtactccacttttagaatgtgttcttgccttaaaagagtgggctaattggcagtgcccagaatggaaccgttgacgagtccacaagcggtggttcgacctcatggggggggtagaccatcaaagttttttggacccccccttttctctccctattccaaggacgggtaaataagggccatcccctcaatagggaattattaattgccgtcccctttgtgtaatgcccgtaaaggttttccacttgggacaaacatactccccatttaacaacccatataaggcccgagaggaaatttttttggtcccccactctcggttccctccagaatacgtgtgagacgcggtaatctatgcactatgtttaacggcgctaagccgc

SEQ ID NO: 627381 - DNA, 166 bp, Homo sapiens
cacaaccagagcggtgtgccctaaccagccccatatgtcaaccatgaggacggtgccccaacaaagaaatgttgggacagcttctcccaagccggttggcatctagggctgttgagtggcaccaggtatttcccatgtctcaactccatgtcacccccagggagca

SEQ ID NO: 627382 - DNA, 102 bp, Homo sapiens
gctggacttatttcttcttattgcctttattcctgtgccatttcccccctttgttgctttttataacaaaggtgttaatagaaagcaataaagaaggaaaat

SEQ ID NO: 627383 - DNA, 361 bp, Homo sapiens
tttgagagaccattggatgcttactttgaggtgataggacccagcctgacttgccccctaccacttatgattcagagactaggaatcctgtatctgaagagttgcaggggtctagtagttctgatcctgacagagacagatctgcagaaaatggaaggggtgttgaccaagcctaggaatctggaagtgacattttagaagagcaaataacaggtgtctccagagagcaagaagttacatgtatcgatggaggcaagaccctccccaaacagccatcttcccagaagtctgagcctctgataccttctgcttatatggatgaggaacaaggggacacttgtacaatatgtctggaacagtg

SEQ ID NO: 627384 - DNA, 445 bp, Homo sapiens
  misc_feature (153)..(154): n is a, c, g, or t
  misc_feature (174)..(174): n is a, c, g, or t
gacaaatcctggtgacaaactggggcttcagtgcggacgaggtccctcagaggtcaatcgccacaaaggtgacttccgcgcccaggagaatgtgccttcctgctgccacaggggtcactgccaccaagaacgtagcagagagatgagagctcnngcctgcagccctaaagccanccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacacaaaaaa

SEQ ID NO: 627385 - DNA, 179 bp, Homo sapiens
  misc_feature (16)..(16): n is a, c, g, or t
ttacgtcagtggttantgaacctaactacatcatgaggatgtaggtttgatccctggcctcgctcagtgggttaaggatccggtgtgccatgagctgtggtgtaggtcccagatgtggctcggatccagcgtggctgtggctgtggcataggccagcagctgtggctccgatttgactc

SEQ ID NO: 627386 - DNA, 1101 bp, Homo sapiens
aaaatggtggtgttcgggtatgagggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactatcaaactaccactaagccaagggattcaggtgtggtgcctgtgggatctgaggaagcgcccaaggttttcaagatggcagcatctatgcatggtcagcccagtccttctctagaagatgcaaaactcagaagaccaatggtcatagaaatctaggactaagccaagggattcaggtgtggtgccggtgggatctgaggaagcgcccaaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaattgcgattcctctagtctttcagattatgtttggaatattaaatggctataccattatgcaagtatttgaaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaaaaaaa

SEQ ID NO: 627387 - DNA, 157 bp, Homo sapiens
tgtggtgttctagaggatcccactgttgtcatacctgcactgttgttcatactgcactgttgttcataccatgcactgttgttcatacctggtcgctgtatcggggggatggagtgagagtgtggtgggtacacctggtggggggtatgaacaacag

SEQ ID NO: 627388 - DNA, 876 bp, Homo sapiens
gggcggggggacccgtgctgaggcggcggtggtcgacgtgggctgcgcgcgggcccgcggcgtcggcggcctggtgcgcgaatgtcgggcgctggtgggtgacgagcgcggtgcgtgatggcgatgggcgcttctacgtggggaaccttccgaccgacgtgcgcgagaaggacttggaggacctgttctaccgaagtgacggcccgcatcctgcgagatcggagctcaagaaccggcagcggcctcgtgcccttcgccttcgtgcgcttcgaggacccccgagattgcagaggatgctattgatggaagaaatggttatgattatggccagtgtcggcttcgtgtggagttccccaggacttatggaggtcaggaggtggagtgggcccgtggtgggaggaatgggctcctacaagaagatctgatttccgagttctgtgtgtctggacttactctccgttcaggcgagtggcaggactgaaaggatcacatgcgagaagctggggatgtctgttatgctgatggtgcagaaggatggagtgtggatggtcgaggtatctcagtaaaagaagacatggaatatgcctggtagagctggatgacacgaattctgctctcatgaggtggagcttctaaattcgaggtttatctgagaggaagcaccaagctattggtactcacggtctcggctggagcacagggcgtgatttcatacgaagcgggtttccgcctatttttccgtttggctactggaaggggggggaatttcttcagtgaccggtgtttggcgaacttttcggagggtttgttggaaagtattttgctagaaacaaatttttcgggcaacgacagaatacaaggggggaaagaatttcg

SEQ ID NO: 627389 - DNA, 210 bp, Homo sapiens
taatggaccctgcgctcccctcccattgtacacggctgtctgcccacccccattctcacaagacttcagccccctaccttagtacggcatctgcacagaatgaagaacctgggaatcagaccctgagaccctgagcaatcccaggtccagcgccagccctatcatgaccaaggagtatcacgaccttcagcgtctggacaatgaggggag

SEQ ID NO: 627390 - DNA, 836 bp, Homo sapiens
ggaaatacgaaaaggagaggtttgaagggagatgattcaacaaattaacagagacgggatgctagcctagccacatttgtcagcgggcgcttcgatgatggagacgcaacatcacttacttcgttcatacactagaccttgccatggcggttcggctgggtagcggcaggacccatggcaaagtggagctggtataggcgcatccgcctaacgagtggaggcggcggcatcgatccccgaggtcttcctctctcagcaggctgtcaccagccggagcacagtcctgggaccttggggctgtggtgtcgtgtgataccatggaggaatctcaattctctgggtactggatcgtaaggaatcaatcatgcatggtgtctgatcgcagaccagtctggttaagcacactcccacgcacgcatcgtatacaccattttgtaatgtgatgcacgtggaggcaaagtgaaagagtgatgcgataccgcacgtgagcgccgcacaacgcatacgccctttgctaccgcatggcctaccccgtacgtcgtcgaatccaggaaaccgtactatggccgccgcatcgaaatccgctcgtttgcgtgtcatggacgcgaaggtggcttggtcgtgcaacaatactcctcctgatagtcagcttgaaggggagtaccatggcaccaacgcagggactgcgaataacaagtcgccgccgcaaggcgtatcaggagacccatcttcactgtccactgaagggagccgtttgggcacggaatggccttttgggccggggtccatccgcgcagaggcacccggcttctggaaaaacccgatgtgcatcgaat

SEQ ID NO: 627391 - DNA, 415 bp, Homo sapiens
  misc_feature (60)..(60): n is a, c, g, or t
  misc_feature (92)..(92): n is a, c, g, or t
tggaagctggaacatgatacattacagtgaaagcaaatgtgtgataaaggatccactatnttccatggtagggggacctacacttacctcancataccttacaaagctgcgcatgaccacaatgaccttcgtgatgggggttatttgaaatttcagatggtaacaagcttggaattgtctttttctccagctatggactgtatcaaagtttatgggctataacgtggggttgggttctgtcaggcatcaggataactcatttgcatgactggtacaaaatttacttattcagtgaatcatgctcagctgctgtactgttcaatctgtaataataactgcagggtgactgactaacgataactaatctctcaactacaaaagcgtgtaaattagtagaataaatggttaggtgggc

SEQ ID NO: 627392 - DNA, 157 bp, Homo sapiens
tatatcgtccgtattttcgaatgatgagccgtcgtgcccccccttcccccttgtttgtcgcccaacttgagatgtatgaaggcttcgggtctccctgggagtgggtggaggccatgcagggcttacctgtacactgtactgcgacctacggcgatat

SEQ ID NO: 627393 - DNA, 175 bp, Homo sapiens
  misc_feature (171)..(171): n is a, c, g, or t
tctgaggtaataaatggattatcccgtatctgaaggccttttaggacaggctggttagagaactcctgcgtctcaagtgagttctcctggcgtcggtctcccaaattatacaggattatggacttgagacaccaagcctagactgactcatgtattctaccacggtgctantacg

SEQ ID NO: 627394 - DNA, 238 bp, Homo sapiens
atgctttttagtgtattctcttataaaaggtaatgaaataataatcccagattcaaactctaacttgaaactgactttacaaccgctttgataagtaactgattactagtacacagttcaaagactaggtcctaactgatcgctgacacatccatttgactattacctaggtgtcctcctatgtcaggatcctgttcctaccttgaaactgtgatcttgaacactggacaattgggtt

SEQ ID NO: 627395 - DNA, 822 bp, Homo sapiens
gaccagggctttgccactgcacgcttgaacttctccggacagaggaacatctgtaccctctcaacgatccagaagttgccacgggtgctagttgcgtcatccagtgacacctttatatgtacaattggatcctcaggatggaggagagtgtgtcttaatcaaaacccacagcttgcttggtcaggaacaacagacagagaatcacgaaaatgacctcagacttccttacctcagtcttatgcagcgaccgtagccagaccaagtgcaatcttcagcctccaggtgccaggctatatctgaggacggcggggcggcttggcagagaagtaattcctgaaccatgagttgtgcgacgggcaccagttgtgtctagatgatgacgaatgcagtttcctccctgtgagcatcaggaaccccgtaactgggcggctcagtctagtgttgcttagcaaaggaaaccttcgcttcataacgacgaggcagagtcccttttcccctgttgctaatctataacaaactaattctctggctcaagtattcgcacacgcagaacaaagaaaagcaacgaccaaacaccacacaccagctttgtgcgtcgccacgcgcccaccaggaagaacgattctagaacacattcgatggacgacggcccccccgaggaaagcgacagcatgggacacagggcgaccaagagacaccgcggcagagaccagcgccggatccaccaaataaacacggcgggacacggggtctaaacaccagggggcgagcaacgggcaacacgggcacggggaaacccgccgaggcacgcccgcaccagga

SEQ ID NO: 627396 - DNA, 454 bp, Homo sapiens
  misc_feature (176)..(176): n is a, c, g, or t
acagaggtgaggcagcaggatgcctcacccctgtagaccaagcacttttggagcctaggcaagtggatcgcctgaggttgtagaccgcagctaccacgcctagacagaaatattttttaaaaagagcaggattctctcgtgctcacatcaaccacagtatcattttgtgttatttncaagggccttatctgcatacctcccaaaactcacagatgcatgcctgaggcccagaaagtggctgctgcatagagcctgcttccgttggtgcaagagctgagccaggagctagcaacctggcaggtccttaagaggtggtgagcacacagccagcacccagcatctgaagtctttgaagtcaggcctggggccccagagcctaaagaagaaatgggcagaatttgccacagctttagttcatcaatgtcttccctgaattctagatttccaaatggat

SEQ ID NO: 627397 - DNA, 365 bp, Homo sapiens
tgggtaactctactccccatcatgcatctgaaaatggcgcactgaggcccgggatgtatgcactggaccgcacctaccccgtgcctctgtgccccacaaaccagttgatgagcctcgtttagctgccgtgccacatccatgatgttccacgactcctctctgctcagctaccagttagccaggctgatgcccaacttctgggctgccaacctgggcccccgtgaaatgtcacgatctgtcgactgcctaccaactgtgggtcatcctctgggccgtctgcatgctgtgcagggacatcgattgtagcctgcatcgtcccttgtctgctatccccagccgtcaagactccatactcctccgatccg

SEQ ID NO: 627398 - DNA, 725 bp, Homo sapiens
  misc_feature (167)..(167): n is a, c, g, or t
  misc_feature (290)..(290): n is a, c, g, or t
gaacgcattattgagtggtcctctaggccccccggctacccttagctccgctggatgttggggatttggagggtacctttccccagaaccgctatacatgtttggatttatcggctctcttagggattgtgccccggcgccagaatcggcccagggtggtcagcccnaccaattttaaaaaggaaacagaggctccctcccccatgtttccgggggtttggggcccttggttttaaaaggcttccgtcaattaggggtttttttggccagggccccccccctttgggaantgggagggagtcccctccccccccctttagggggggttcccaaggggcaaaaaaccagtttttggaattaaaaccccccggggaaaggggggcccccggaggcaggctttggaaccgcttggatttttttagggggggggggggggggcttttttcaccatgtaattggggaaccccccgggtttcctaggggggaacccaagggggtttttaaagacccaaacaaaccttttttttgaaaagggctggaaaaatatttgggccctgggtaaagtttaatggaaaacccggaaatttttaaaaaaaaaaaagggttttttttaagaaaggcccccttttggccggtttaactgggcctttttcctttttttgggtcttgtttgtttaggtatgaaaattttaaaaaaaatcaaaacggggccccgtttttcccta

SEQ ID NO: 627399 - DNA, 278 bp, Homo sapiens
aagctacaggaccatgtgccgcgcttaccttctgagctcctaggggtgaagtgacacgccgcccgccctcggccccgcagtccagaacgcgtgaggaggcccgaccctctgtcaacctccatgtcttaaattaaagggggagggatgcgttgcccttaaatagcaaggagccgagacacagaacctctctgagctctacctatttgagtgtagatatactctcctctacttctcactcgagagctctctcgtctcacagtgtaagtgactctacagag

SEQ ID NO: 627400 - DNA, 271 bp, Homo sapiens
ctggcgtcgcgtgtccccaacggcgacgcttgtggctggcctgcgtcatgtctgggttctgtggctgggctgtgccactgtgtgtggaccgtggaagtggccgggacccttgttgctgctgccctgcccctcgcagcggcagcctgccccatggttcagcgggctcttcatggcgttgtcgatgtggcccacttcgtgcctgcccatctcatcctgaatgtcaagcccaaccaactcgcagtgcagactgggtaaactgatgttcagactg

SEQ ID NO: 627401 - DNA, 349 bp, Homo sapiens
tggggtcagtcttttccctcatcccctccctggggagattggactagatgagtcctgagaggacccttcccacaagagacatttattttctgatttttcctgaaaatggtagtagtttacatttatacagtacagtttatgaagccctttcatacgcaggcatttcttgttacctacatttaagctgtttccgaaagagtggttcagaaccccacagtattgggcaatattcgataagcatattttccctgcccttgttataaaaatgagtggtgaaataatgtttggagacataatgaaagcgatttacctttggcaaaatataataaagcccttttgtaattggtga

SEQ ID NO: 627402 - DNA, 1811 bp, Homo sapiens
  misc_feature (1420)..(1420): n is a, c, g, or t
  misc_feature (1603)..(1603): n is a, c, g, or t
  misc_feature (1634)..(1634): n is a, c, g, or t
  misc_feature (1811)..(1811): n is a, c, g, or t
tcccaaaaaaacaaacctgtatatttttaaatttaaaaaatatttatgggagaacacctaaacgtaatctgggagatattggctatcctcacatcgggggttcttctgggcaatgtcggagaacgcaccacctctctccctggtacgctcgatggctacttcagcgttacacgcatctccaatattcttatacggtggagtattgagaaaacgcccctattgggttctgggtggtgtccacagagaactataccacgccgcgggtgtggtgtggcggaagaaattcgcctggcatgtggcaccaagtcttctccgcagaaacataaatggcctggccattatgggggagcaaccaccgtcgcggggtctttgcgcgggcaacgctctcgcgtgagcgagaaccagataagtgaaacacactctctttcgaagcagtggataaatatacctctcactataaccatgcgtttactccccctatttatcatagtaagtttaaccatatccctccaatgaaagagccacactaatagagggacacctctttatataacaaagtgtccaccacgtgtgcgcgataatgtttgtgcccaccccctagtagagtttgtgagaaaacatctcgtgaagaagcggcgtcatatgagagacgggagatattatttgcggcacgtttgatgatctccccagaaaatgccctgaaaaaaaaggccccaacgttcatctttcttagagggaaacggcccctctaataaaacgaagtatttgtcacgcgggagcagtaggagaaaaaacaccccaccaaggcgtgcccatcctgtgtcgtgcgaccaccatataaaacacgaagccaaccgcagcgacgacaccacgcgaaattgtgggggcgcccccattcacactatcacacaacaaacatcccggcgtgagaaaagagagcggggcatctagcgccgccataacaagccgggatacttccctagaggggcacccaccacagtgagactataacccgaggagaccacacacttggggtatgaagatatctccccccgcagagaataaaaacattctttgtgagacaacttcactacttccttcatttgtgacctcctccatacaaagattcatgccgcctccctcgagaagatcatctactctgtgggacggtgggcgagcctcaaccaagaaataatgtgttattgccgagcataacagccggcgcgatctaatttactgtctgtgagtgacccgcaagcgctctaaatgagcaccaatcgattgagtcgagtcccgcccaataattctctctggtgggtcctcccgagagggtatttccgaccgcatccgtgctgctgtgatgttatattaaactcccacggagcggaaagaactctcttgtgggagcacaagatatacngtccatcatcagtcataaggagagttcacaataatctcgcgaataagccgcccttttaggtaaacacatagcacacaggagaactttaagagctacaaggaatgaaagggaccgccagcgaatattactgaagaagcaccaagagcgcatctcgttacacgtgccgacgactcactctaactnagtagcagcagcagcggccgacttatgacanccacttctccaggtaaaagaaagagctgacgtcgccttttaacacgctgagtatctaagtccactggtgtgtctactgtcgcgcctccttgctacttttctgcgctcttgctcgcttcttgtctataatgggtaatagatacaagacgcagaattactagagtctcgcatgtggtgn

SEQ ID NO: 627403 - DNA, 766 bp, Homo sapiens
  misc_feature (278)..(278): n is a, c, g, or t
  misc_feature (416)..(416): n is a, c, g, or t
  misc_feature (436)..(436): n is a, c, g, or t
tcatttcagtccaggggcgggtctttattgtagttccactggtccgtcggtcgccaacatgtcaggtgggagtcatattacaaaaccgagggcgatggagaagcagaggaagaacaagaagagaaccttgaagcaagtggagactataaatattcaggaagagatagtttgatttttattggttgatgcctccaaggctatgtttgaatctcagagtgaagatgagctcgacaccttttgacatgagcatccagtgtatccaaagtgtgtacatcagntaagatcataagcagtgatcgagatctcttggctgtggtgttctatggtaccgagcaaagacaaaacattcagtgacattttcaaaacatctatttacgatcttacaggagtctgcgataatccaggtgcacaacacngaattctagcagcttgaccnagtctcaaaggggcagcagggacacaacaacgtttccaagacatgatgggcccacggatctgactactcactcagtgaagtagctgctgggtctgtggccaacctctttagtgatgtccaattcaagatgagtcataagaggatcatgctgtacaccaatgaagacaacccccatggcaatgacagtgccaaagccagccgggccaggaccaaagccggtgatctccgagatacaggcatctatccttgaccttgatgcacctgaagaaacctggagggcctagacctatcccgtcccccacatcacctcgcaaacaaaacagagaccca

SEQ ID NO: 627404 - DNA, 207 bp, Homo sapiens
cagtgcatactgctgccaaagcagagtaggtgaggtcacagcatcagtagctcccaggtagcatcttcctcatgtgtccatgtggcgcgtatcctcattcagccctgggagaggtgttggggtagtgtcacaatgtgctcggtctgattgggcgtgcacctgggacccttacatctggacccccaggtgtgatctggggcctacgtg

SEQ ID NO: 627405 - DNA, 363 bp, Homo sapiens
tcatttcagtccaggggcgggtctttattgtagttccactggtccgtcggtcgccaacatgtcaggtgggagtcatattacaaaaccgagggcgatggagaagcagaggaagaacaagaagagaaccttgaagcaagtggagactataaatattcaggaagagatagtttgatttttattggttgatgcctccaaggctatgtttgaatctcagactggtagcttcaaacatctcacagttaaggaggctgtctgaatggtttggtggccactgaggtgttgatgtggtttatgtcggagagattataggcaagcgggcatcattggctatatgtttgagaccaatctttacatctgattata

SEQ ID NO: 627406 - DNA, 174 bp, Homo sapiens
  misc_feature (14)..(14): n is a, c, g, or t
  misc_feature (21)..(21): n is a, c, g, or t
  misc_feature (48)..(48): n is a, c, g, or t
  misc_feature (92)..(92): n is a, c, g, or t
  misc_feature (126)..(126): n is a, c, g, or t
  misc_feature (145)..(145): n is a, c, g, or t
ctacgccacgacgnagtcgcnagacccaatccctctacatccctaacnccaggactcttgacttcaagtgacagccccaggtggccaggccnccaggaggccccaggcaggccctgtatcaggctnggacgctctgagctgtgcntgtacatatatacatatatagatacattt

SEQ ID NO: 627407 - DNA, 177 bp, Homo sapiens
gtcgaccaaaaaaagtccaggaccagataggttcacagctgaattctaccaaacattaaagaagaattggtaccaattccaaaagattgagaaagagggaatcctccctaaatcattctatgaagccagtatcactctgataccaaaaccaggaaagaacatttaaaaaaaaaagtc

SEQ ID NO: 627408 - DNA, 474 bp, Homo sapiens
accacatcagaaatgtagtttagtgtagttagagcatttctgtagttctgtgtttggagtagtgtgtttgtaacggaaacctggaaaatgcttgaatacttgtgaatcaattattgatctgcaaagaagcttttgattattttatttgcatattgtgtacttggttgtatatgagaatttttgctactacccctattggaactgaaagtcatggaggcgaatgttttatatggtaccaatgcaactttgtttttctttttgtcttgaaactgtttaaagtataagagtttaatgtctgtcaacacccaggttttccaacttttgatactttttcaacaatactttttcaacttttgatactttttcaactttgatactttttttttttatatcttccaaaacattttgtacgattttttgtaaggtattttgtacactgtccaaataaatcttttgtttaagaattgcaaaaaa

SEQ ID NO: 627409 - DNA, 846 bp, Homo sapiens
  misc_feature (5)..(5): n is a, c, g, or t
  misc_feature (27)..(27): n is a, c, g, or t
ctggncagcatcggtttttattctgtnatccaaagaaaataggaatatcagtagcagagaggaagaccataatgaaaatggccacatttcttcacaggggcagcaatcaatgcagggggcctgtaagactaaggctgtagttttcagtttgtctgaatactgtaataacctgagggttaatttgaaggaaaatatcttgatgtcccggcatcaccccagactcctagagaatttggaagtagaactccaatatcaggacttcagaaaactcctcaggtgattccaatgtgcagcaaaatggagaaccaacaatctaaagaaaaatccatccaccaaaggccagaggaaacagacagagtttctgaaagtccatcgggcagcaaaggcccagccacattgggaagtccacaaggaacagaggcctatgagatgcagacttctaagggctctttgggtgggcttgaggactgcacacagaagaccatggcttggtcttgagtgatacaggatgtgctccttttgttgttccccagaatgtggtgaagtcattcagccagtgcctcttctgtcctatggcacagggcaacctgaatgaacacaggttgggcctcttctgccactcttgaatacaacatgccagcaggtgtgtgcttggctgctcaacagcccagctcctggcacaccacggccacatccttcatgtcccagctgtcatcacacacggtacctcagtgaccttcctgtccacttccactcttcctttgcagtggtgaggaccattaatcaaacggactttggtcgggggctgtgtagcggtggtaggttaagagagtcgttgcagcataa

SEQ ID NO: 627410 - DNA, 551 bp, Homo sapiens
ggcatagagctgatgaggtgagccatggtgtctggaatgttaatggcaagcgcgagatgtgtggctgtacggccttcactggagactcagacgcatcatgcttctctctcttctcactgaacagggcagtgatcgtcatcttaatgtttgtgctcgggaacctgaatgtgcacacgcgcggcagctgcagcggcggcgccccgcgcctctgaaacacgccgtccacgaataccccgttcttgcccaagcagcgcaggtagaagtcgccgccggcgtcgggcctgggctgcgcgggcggcagctccggagcggccccgccatggccgccgccgcccgggggcgtgaagatctcgaggtggcgccgggagatgaagctcgagtggcccatgctcacgtccaccgagccctgcgacgagttgcggccgatggtcaccgagcgcttcttcatcagatactcgaactcgcggccctccaggcgcgccacggcccagccgcccggcggggacccgccgcccccggccccgacgcccccggccccgccgcccgcgggt

SEQ ID NO: 627411 - DNA, 305 bp, Homo sapiens
  misc_feature (12)..(12): n is a, c, g, or t
  misc_feature (102)..(102): n is a, c, g, or t
tgaaaccctgtntctactaaaaatacaaaacttagccgggagtggtggcgggtgcctgtaatcccagctactcgggaggctgaggcagtagaatcgcttgancccaggaggcggaggttgcagtgagccgagattatgccattgcactccagcctgggcaacagagtgagactccgtctcaaaaataataataataataattattattattatattgggggagagagttagaaaattacctatcaggtaccaatgtttacttattttggggtaatggctattacttggaagcccactcccagtac

SEQ ID NO: 627412 - DNA, 686 bp, Homo sapiens
  misc_feature (5)..(5): n is a, c, g, or t
  misc_feature (27)..(27): n is a, c, g, or t
ctggncagcatcggtttttattctgtnatccaaagaaaataggaatatcagtagcagagaggaagaccataatgaaaatggccacatttcttcacaggggcagcaatcaatgcagggggcctgtaagactaaggctgtagttttcagtttgtctgaatactgtaataacctgagggttaatttgaaggaaaatatcttgatgtcccggcatcaccccagactcctagagaatttggaagtagaactccaatatcaggacttcagaaaactcctcaggtgattccaatgtgcagcaaaatggagaaccaacaatctaaagaaaaatccatccaccaaaggccagaggaaacagacagagtttctgaaagtccatcgggcagcaaaggcccagccacattgggaagtccacaaggaacagaggcctatgagatgcagacttctaagggctctttgggtgggcttgaggactgcacacagaagaccatggcttggtcttgagtgatacaggatgtgctccttttgttgttccccagaatgtggtgaagtcctgagaagttgtcagaaggaaaggacatgaggtatggatcgagcaataaagatattattcaatccttgctaccctccgagagagccaaaaatttgtggaaaagaaagggaacaaatacttagtaagggaatgtgtttac

SEQ ID NO: 627413 - DNA, 369 bp, Homo sapiens
cagtccgatagaagtcacagagcatccatcctccgctggaaaacggtccagcccctccgtccgtgtccatgtcacagagcacggtcaggggcaggcagtcgggcaggtagatggtgttgcagccgctcaggaaatacccccggtctagcatgtccttgcagatgcgtgtgcctttgcctcctgtgcacgcggccttctagggtagataatagtagagcccacgttgtcatggaagggattcaggtgatatctggccattactcgagtgattgacggggggatgataggtgcagacagggttcttgtcttaagattccgtaacgtgaacgtgttgcagctgccccaggggtgggggccacgcttgggtac

SEQ ID NO: 627414 - DNA, 153 bp, Homo sapiens
acacctgttaatcgccagcacgttgggagggtgaggtggaagggccattatgaagcgaggagtttgagattagcgctgggcaggtagacccggtgtctacaaaaaagtttaaaaattagggggctgtggcggcacgtgcctatagtcccagta

SEQ ID NO: 627415 - DNA, 471 bp, Homo sapiens
  misc_feature (417)..(417): n is a, c, g, or t
  misc_feature (454)..(454): n is a, c, g, or t
gacgcggagaacccactgcatgctgcctgctctaccccagacgctgattgcattcctttgtgccctgttcctgcttttccttctgtctggagagttcttttttttccctttgaaatgcaaggccttgttcaaaaatatcttcctccatgaagttttcttttgttctattttgattttttaaaaatctttttggtcaaaagtaatcagccttgtattgttccttgtagttcttcgtttctgcctttataactgtctgcttgatgtaataattatccatttgcagcccatctttctactctagattccttggtttaaaaaattatatatttgtaggtactaacctacatggcttaaaaaaaaattttagtgagaataatagttatgtgattttttaaatgcaaaggtataaaataaagnctgtttcccttccctctccttagtccttccccacagngaccaccattaatagta

SEQ ID NO: 627416 - DNA, 1271 bp, Homo sapiens
ggtcgtgtgctgaagacatgtaatcaatgaaccgcatttcggtgaaggtgcatgcactgggcatgcacacggctggtcacatctgcccatctgctgctgccctggaggatgggtgtgcactctgaccatattcctcacgatgcagtgacatgctcttgattttgggtgtgaaaacagggtgctaaagccaaccagccttatgggtcctggagcaggtgggagctgaaaaggatcgaggcatggggcctgtcctttccatcatgaccacaatccccagagcccagctcattgcatctcttgtgacgtgcactgtgaatcctggcaagacaagcttgagtctcaaggtgtggcacggtcactgtcactgccgacatccctacccccagcagaatggaggcaggggacaagggcggcagtggctacgtggggtgaccagctggtgccaaatagacccagactggagcccagtgcagtgtctgccataggcccagagtgaacctgtccttacacacatctgggtgcccatgaacgggaccttcccacatcaccacactcctctaaagacaaagtagattcttaccaggcaccattaccattcggaacaaaaacacgcactacacatttcttcttgagttcattgcaagcactttccaaaagcaccatgcgctcatggtgtagccgccatgactacgacgacatagcagactagaccaccagggcgcacctgacgcaccacggtggcactagcacacgggccctggtccacatcctgtgtccctggaacttgacctccatcgacacactgaacgcaacatgccctacatataactctaccggcgtcattcacatctacctccttgtccaggagcgcggccaacacaacgaaaaggaaccagaaccaacacacaacaacggacgccccgtgaacaccaacgagacaccaaacaccgaaacaatgacaacaacacgaccacaagaagtgcacacggacatgagacgacccaagactcgcggtgacctgacacaatgagaaaggaaaaccagggtacacgtgaaaccgcacgagagaactactacccagaaactagtaaacgattcaccagccgaggataaaacgagacgaaacacacacacccctcgtaacaagcgagaaggacggaaagaccaatagacaaacccaacaagcccagaacgaagagacgacacacacgaccagaaaaccagcacagagaacgcgaaacaacacaacccgacagaacagagaactcgta

SEQ ID NO: 627417 - DNA, 225 bp, Homo sapiens
tatcattagatttacacagaaaccctgcaggtcagggatagagtgaaaaaaaaaaaaaaaaaaaaggcaaacaaaattttcttgctccaaagaaagaaaaaaaaacccccgggaacccattaaggttgcccctcagaaattagagggaaaaatagggctttccccagaacaattaaaacctgaggaaagttccacatagaacttggctttataagaaatgtgcca

SEQ ID NO: 627418 - DNA, 685 bp, Homo sapiens
taaccagtgctctgcttatatcgggggataaaagcattttctttatcatatcccgatcttcccatttcttcatagaaatgtgataagaaggtacatccctgtgatcctgctgcttcagataaacctcacagcgcaccctacgccgagttagccactgaccatctggtataggacgactatttgccgggacctatatctatcagttacttcccatcctgtccttgattaggcaaatatgttaagaagctgctcccatactaatattcacttagctcttgtcttactaatttgcgtccaacccctgctattactgctcatgctgcttaaagcaggcagggtactaggagaaacaaggcatttctaggcaggcctgtgtgcagctagaaaaccgacttttacacgccttataaaagcagtcacggagatagatccgtaggtttcgatccttcacatctaataccaggcgctacatgggaaccaaggtttaacagggtcctggtcatgctaataaacttgaccaacttagtgacaatttaaaattactgctttttttcctgcctttaatctagataagcttcctcaatatcctacttgtggtatactaggaaccatgcttactctgatctttctctttacaaacacacagggcagagtcattcactattgcactgtgtgttcacgacta

SEQ ID NO: 627419 - DNA, 984 bp, Homo sapiens
  misc_feature (130)..(130): n is a, c, g, or t
  misc_feature (275)..(275): n is a, c, g, or t
  misc_feature (289)..(289): n is a, c, g, or t
  misc_feature (475)..(475): n is a, c, g, or t
  misc_feature (506)..(506): n is a, c, g, or t
  misc_feature (553)..(553): n is a, c, g, or t
  misc_feature (579)..(579): n is a, c, g, or t
  misc_feature (657)..(657): n is a, c, g, or t
  misc_feature (676)..(676): n is a, c, g, or t
  misc_feature (680)..(680): n is a, c, g, or t
  misc_feature (748)..(748): n is a, c, g, or t
  misc_feature (864)..(864): n is a, c, g, or t
agcgggcttgcgctgagcagcccgcgagggcgtgaagtgggagctgcgacctgctgctccctgtgaggtgggtcaagcggacgaaatggcgccctccgggagtcttgcagttcccctgagcagatcatgntgccgcttgctgttggggatgcgtccctggaacgcacggggcggcggagcaaacgattcgcgtacactcacggacgacgaactgggagagaatctgcatgggaaggacgactggaatgattagatatatttatgcacccgttggntgccactgcgttgntcgaaagatcgttcgaaccaggaaagtgtggagaaggtgtgttgcgtgacaatgggggacgaaagagttcttgacggtctaaatagtatgcagagaaggtagactgtacagcaggatgcagtccatgggatcgtgacgatgggtacgggtgtatactctatataacttgcatactttcccatagcntactgtgtagtcgaattcgataagatgcatntgtgtggagattttgaggagctgccttaatcacgcggttcccgacangtgtacgtaataggaatagtgcactntcgaataatacagcttctgtacgtaccatggtcgagtacacaccgaacgtcgcgacaccgaacgtcatcgtggatgcnaccagatatatctagatcnactngggattatgggtcaacagagggtatctgagatatactggaattggagactaggtgatagcttctgagnacagcctcccttatcaagacataattcgtgatgctgaggagtccatgcgaacgatggacacactacatcagtacgtattactctggaacgcacgctgtagcgagtatagcaccagnatgtatggcgtgcactctatgtactacatagcgtgtttgagacatctatagacaaatcgtactgttatgatctcccgtggacctcgtatgactctagggaaccatcatgggtatcgaggc

SEQ ID NO: 627420 - DNA, 500 bp, Homo sapiens
ttaaagatgaattagaaaaatcttatgtaattagacaaaaaccaaaaaaacaaaaacttattttagaaagacttggataatgattgattataaaaaaatgattgaccatactttattaaaaccagaagctacatctaaagatattttaaaacttatttcacaagctaaagaacatggatttagaggagtttgcattaactcttcttgagttaaattagcaaaagaaaaacttgcaaatacagatttagatatcgtttcagtagttggctttccattaggtgcatcaaacacacaaaccaaggtttttgaagcaaaattagcagttgaacatggagctactgaaatagatatggttataaatgtgggtaaattcaaagaaaaagtttatgactacatcttaaatgaaatccaacaagttaaaaaagcaattggaaataaaatattaaaagtaattatagaaacagcgcttttaactaaagatgaaataaaaaaagcagctg

SEQ ID NO: 627421 - DNA, 554 bp, Homo sapiens
  misc_feature (144)..(145): n is a, c, g, or t
  misc_feature (147)..(147): n is a, c, g, or t
  misc_feature (181)..(181): n is a, c, g, or t
  misc_feature (191)..(191): n is a, c, g, or t
  misc_feature (201)..(201): n is a, c, g, or t
  misc_feature (206)..(206): n is a, c, g, or t
  misc_feature (240)..(240): n is a, c, g, or t
gttcttcctgccagcctctccgcttgtaaaccgaagccgtgcctggagccccaagatacacccctcttctaacacccctttttgcgctgtcattccactgagaacgttttcattgggagatctcccctacatgcagaacagggnncngaacatggctcttatgctgacgtcggtgaaaacnattcccttcnctccaggccnggatntggggcgttatcaggtgtcctggagcctggaccncaaaagggcccccccaggccccttttaggtttaattttttgacgaggagtcctacagcctccccaggaagggtcaaaggaataaagagggcatttccctcattccccctcttttttcagtcagggtggaccatcggggcccttggaacgggccctgggtgtccccttaggtgctggcttcggcgatcggccttttgatttactacttggccttcagtgcgaaaaaccccatccaggcctgaggggggccccccagccctgcccttgcttccttcaataaacatcccagggcctggggctgcccagggcctggga

SEQ ID NO: 627422 - DNA, 836 bp, Homo sapiens
ggctggcagtgcgtaggccgctcgatgcctggagttactgtgaaagacgtgaaccagcaggcagtttcgtctacgagactctggccatgccttcctcaagaaagtcctggtgaaggctgtaataggtcaccctcatatggcgatgtgataccagtcaaagcttgtgcgcacacgactagcaaacgagtcttgcttcccgtaccgatgagacactggtttctacgatcgcgtaggctgcgtatccacagtcgcagggcaccatgtaccatccaggtggctgcgcgcatgagtggcttggcatcctaatgaccaacgatcgtatgtgggcgacagtcagtagaaagcgggccgtcagtggcccagccacttcagcactgatggacttccaaggagtagtggcccgaccgtggtcctccaaagcccttggaggcgtgctgacaccatggtggaccatggaccaagatggccggccgcagaatctgaccagccttcaaggggacataaggagatcgtggacacgaatcgccgtgatcaggtggcaagctgcacaactagaggaaggcagttagaagcaagaccatgctggggttaataaacttgcctcatttcgtagatcctgataaagataaggccagttacagtgggtacgacaagagaagtagcacaacaacaagaagtccacagagaagaatcaagagaagaggcgaggaagaggacgcatagagcaaaagagatagctggacgggtgggtacaccaagataagccatagagagagcagtgacccgtgcagaggtgcttagatgtggtacagaggcaggcgacgaaacttagcggg

SEQ ID NO: 627423 - DNA, 468 bp, Homo sapiens
  misc_feature (50)..(50): n is a, c, g, or t
  misc_feature (91)..(91): n is a, c, g, or t
  misc_feature (149)..(149): n is a, c, g, or t
  misc_feature (157)..(157): n is a, c, g, or t
  misc_feature (176)..(176): n is a, c, g, or t
  misc_feature (189)..(189): n is a, c, g, or t
  misc_feature (314)..(314): n is a, c, g, or t
  misc_feature (355)..(355): n is a, c, g, or t
  misc_feature (368)..(368): n is a, c, g, or t
  misc_feature (412)..(412): n is a, c, g, or t
  misc_feature (435)..(435): n is a, c, g, or t
  misc_feature (462)..(463): n is a, c, g, or t
aaaaaccttaatttggaattaaccccatttggactcttacctccaaaacnataacaaatgtccgttatttgtaactgctgggtttgtggtnatttgttacaacccactttaggaacactgacccggaagaaggtgaggatagagaagcnagagtcanacagagttctgggagcggnagaagaggagggncgagctgtataccagacagtaagaggggagagtgtttgggggctggtcagctgcataagaaggcagagggacaaggccactgagttgggtgcgcagaaccaagtggcagcttgacaggagctgtncctctgaagaaagaagacccccggctgctgtggactgaagnttttgctcgtttnctcacctagatgcccctttctgctgctacatcccaggacccagnagcactcggtcacacctacgatnacacccgactctgactcttcaccctcnnaccac

SEQ ID NO: 627424 - DNA, 443 bp, Homo sapiens
caggaaagggtttgtggttcagttctgatgtgtgacccatccataggagaatggacacctcagactctctcaatcctggccagtggcaggtcccagtagctgccttccctggctgtccttgaggctcactggaggatacttctttttcattctggcaaattttaaaaaattcttctatagatctcagtgagttcaaagctgcctgtgtgcaggcatagatccgttctttgctgagcttccactctagttggctgaaaggaaagggtaatatagctggaaaaggtatcctggggtgattagaggattctacatttcatcttagaaagggatattgacaggagaccagaacttccagatcctcttgaatttcaagaactacttccaagcctggacaatatcgggaggcctcatctctacaaaataaaaattaagaaattcaaaaa

SEQ ID NO: 627425 - DNA, 485 bp, Homo sapiens
agttcgacggaggactctctatagttaggtagaatgaaataattcagccttgggacgacgggacaaaaaccagatgaaagcaatggggatttcgagatggcaaagggtacagagaagtcacaagagcaagggagaaaagctgtgcactttttttgtttcctgaagtagagtagtgcaactggtctgatgaataatcaggacttacaaagtgtagttataaagcaactgtatttcccactgttcctttaaacttggtaggtatggttgttctggcaggttgactgaaaattcaaactttctttttttttttttcccaggttatgtttggaagatacggtctcacgtgtgtaatgagaatgaccatttccagtgttaaggggcaaagattccaacctggtcaaatttacaactactcttaagtcctctagctggggaaggaaatagggatagcggcttggtattcttctcctattccttcttcagtc

SEQ ID NO: 627426 - DNA, 306 bp, Homo sapiens
  misc_feature (169)..(169): n is a, c, g, or t
gagtgactagcaggatcttatcagtgggaagagcgctgttcaaggaccatctgagcgtgactctgtggctgctacagcgtgtcagtgtcctgctgggctgtgcgagcatggaaccatgggaagacttcacttgcactggtgcctaccccgagtccaagaccccgctaancgccaccctctcaaaatccggaaacacattccggcccgaggtccaccttcttggcggcgccgtcgggaggaagctggccctgaactagctggtgacgctgacgtgccttgccacgcggcttcagccccaaggacgtg

SEQ ID NO: 627427 - DNA, 218 bp, Homo sapiens
cctaagttgcaattctggttttccacaagatataagacatgttacaaacagttaattgtctttgtttctcatctggtaacatccacccactgcacatatttcttaccttaaagagtttaaaaggcaatcgtataatccaactctgccaacactttcgggaccccttccacactctggaagctttgtactcttgttctgctcgataaaacctactgctc

SEQ ID NO: 627428 - DNA, 242 bp, Homo sapiens
gggagagcttgaaggaaattaattcagtcttaattatctcaaggtttgaagtccctgttagacaattaggcagagctagtcttgcaactgcattatgcgtaaactggtgtataacatggactcatctccactatttagctcagcaaaatttgtcccatgcttaatgctttgatgtacaacagtaagcgaagcacatcgtatggatttcatatcccgtcatggatggccattcaacgcctccg

SEQ ID NO: 627429 - DNA, 268 bp, Homo sapiens
gtgggaattcttcagtctaaaactgctctccggctgcgcgctgctggctcacacctgtaacccccgcacttcgcaggctgcgcccggacgattacttgacccccagagttcaagaccagcctcggcaatctactggaccccgtctctacacaaaattaaaccacttagccaggtgcggtcgcctgagcctgtcgtcccagctacttgggaggctcgaggcgacaggtcacttgacccctcgcaggcgtccagcctgcagtcagccgac

SEQ ID NO: 627430 - DNA, 586 bp, Homo sapiens
tcccctgacaccaagaaaacattcaaacagcatagtttttaactgtattttgaaaggtttccttagttccctttgacccttcctcttttgcatatcagttcctggccataaaaataaaaaatgctaggacagaattgcgcatctgagctgatttgccctcaaaaagtttcacagtggaacaaaccgcagggaggagttttctgtggctcagttaaatgtcgggggagggtggtgtgaaagccaaatgggattcctgctttcctgtttaaatcttgtttttcattgttatttgcaccagcaatactctgtggaataatcatgaaaatgtgtagatgggcagctaattttggaaaaatgaaaagaatcagaaatgaactaagagtgctcggaagtttttatgttctctcaacctgtttggtcaaattgttacgaaaacctataaggtctctttgactagatacaaagactttgcacattgccttagctttctcttgaagcatttccttttttaaaataccgtgtaattcacagtgatatgatagatttgccaaaggtaaatctaccagtctgaagattaagggcttgt

SEQ ID NO: 627431 - DNA, 394 bp, Homo sapiens
cccctccatggtagtcctgtggaaactctctaaccatagctagatagcattctctatgtagttctcacatgcaccaatgaaggagcacagagttgaaaaaagatatgcactcacccatgctcactgggctcattttatatgccctttaccctcaagtgggccctcagtgctgtatagccaatttgattcattttcataattggttcactcacccactttcagagtggtgattcttcactctaagttaatgactatagattattattctgctgaaatctacgaatcagttgagagagacacattcatatgggtctaccccaaacctattatgccatcctcatctgagctcacatactccattttccctcatgctctgtgtatatatcctctgtgt

SEQ ID NO: 627432 - DNA, 892 bp, Homo sapiens
catcaccatgtacagatacaatacatggcgtgcatctgtaggccccgctactcaggagggtgagacaggagaattgcttcaactcgggaggcagaggctacagtgagccaagatcacgccactgcactccagactgggcaagagacagcgagactccatctcaaaaaaaaaaaaaaacaaaagcgttttttttttccttttttgaacccctttgtgttcccctcttaaaaaccttgttgtgttgcaccttgttctatagtttatctaccttctgacattcagtgggcggggaaataatcccataatttttcttcaccacataccacatattgttgaacctattacaaaccaacacctgatttttcgtgccacgaacttctgttgcgaacccagaaagtaattaccccacaggcaggcaactgctcttctgcaccactatcttcccacctgggtgcccctgttaccccatttttcccaggcgccacaaattcacaattaccttggccacctttatgtgcccattctttaaggcctctcatctgctcaacgctattaaacaactttacaacatattgacccgtggaagattcccaaccccctcaacataaatcggcgggacgcaacaactttcttcgccaatccttaaccccaattctttggaacaaaggcggccataatactcccaacaattctctcaccaaagaaatcctacaacccaacttcttcccccgcacgaaacacttcccaacacacccacccttcaacacactctgggccacccggcattgtgcacccagcacccttctttcaaccgaacagcacctttttctcccgcttacccagcacaccttgacaaaattgtgcccatccaccttaatccctccaaccacgc

SEQ ID NO: 627433 - DNA, 267 bp, Homo sapiens
aacagatgcgggagtcataacagacacaggtagtaagtagctataccaagggatacataaatgaagaatggcactaaaagttacttgagatacttaatactctctgccttcagcaatcaattccattcatacatcagcactctgctggttctgcttgaaatatgttctgtatgtaaaactcaaatctagttggatctcggcggggcttgtgaccaatgaagtcatattagttgatggttgaccaagcttgctccactccatcagaga

SEQ ID NO: 627434 - DNA, 554 bp, Homo sapiens
  misc_feature (8)..(8): n is a, c, g, or t
  misc_feature (29)..(29): n is a, c, g, or t
  misc_feature (97)..(97): n is a, c, g, or t
  misc_feature (112)..(112): n is a, c, g, or t
  misc_feature (117)..(117): n is a, c, g, or t
  misc_feature (170)..(170): n is a, c, g, or t
  misc_feature (193)..(193): n is a, c, g, or t
  misc_feature (228)..(228): n is a, c, g, or t
  misc_feature (246)..(246): n is a, c, g, or t
ggacggcntggcctaaggctcctccaacngcaccatcaaggcccgggagcctgccagaactgatcccttggtgtgggaggactgggtaccacctacncccaacaagtcatgngggantctaattggtaggattttgacggttttgcaacataggtctattattagagtcnccatgacaaaaataggggttacnagatatgcccaagtcagcatttgtcctgggtcccntgtgtgatctgtttgganatgtttccttttcttctcccacttgctcagcagcttgggcttccattctagttcttttaccagatttttgtgtgacctgttgacttcatttggattgccctctttcaatttccttgtgaaaaacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttg

SEQ ID NO: 627435 - DNA, 180 bp, Homo sapiens
cgcgtcgaccgagcctcatactgtcctcttacgttcgatagcaggtgtatcctgctttctttcaaatacgctttcattcccttgccagtcgatacaccgccagcgccgtcaattctaacgtcttgctcggtctgcgcatattgctgttgtgggaaaacggtcatgcgactgctggtgatg

SEQ ID NO: 627436 - DNA, 317 bp, Homo sapiens
ccggaccaataacccaaataagatcacctccccacgcaaccccctgtccaacagaactgtctgtgcctggctggccaagggtgcaggggcagtgctctggctgggtgccctggtaaaggcagggcaccctccccttcccgtggatgcagtgattggtaactaggcagggtgggcagaccaggccaggctctcaaggtgtgttgccaaacccataggtggagtctaggctcggtcctagagagagagcaaggggagatgtagagagatgtaggaagagaaactgggccttgcagaatctatctctgagaggttggaag

SEQ ID NO: 627437 - DNA, 125 bp, Homo sapiens
  misc_feature (21)..(21): n is a, c, g, or t
ttattgacacccccgagtatncatatgtgaccggcgtcgcgagcgtggatctccctcttcaggccataatgaagggcctgatcctgaagacatggcatcgcctgctggaggcccagaatcgccac

SEQ ID NO: 627438 - DNA, 192 bp, Homo sapiens
  misc_feature (158)..(158): n is a, c, g, or t
tcagaaccaccggccagcggacccaatgcctggaggtcatcaaaggtgtgctgttcaggatcttcatcatcagggccatcgctagttggttccgccgagggcgcccctcaggacaggcgtgcccgggaggagcccacgcgtcgcagccgcaacctgtnccccaaagacattataatgaacctgcatgtgtac

SEQ ID NO: 627439 - DNA, 155 bp, Homo sapiens
tggtgctgtgatctctctgtgtggaatgccttggtgagagagatgcttattatgactattatcatttctgaccaagctttctattaagttttatttctaattaatacactattcttgatggtacctcctccagaaaaattttctctgctcaggtg

SEQ ID NO: 627440 - DNA, 498 bp, Homo sapiens
cttttaaaaagtgtcgtgtacctatcacttgcgcataaatgtgatgcagggacttcatgtaaatttatataagttattagtagatactggatattagacctttctcagatggacagatagcaaaatttttctcattctgtaggtagtcttatcactctgatgatagtttcttttgctgtgcagaagctctttagtttaattagatcccatttgtcaatttaggcctttgttgccattgcttttggtgtattagccatgaaatctttgcccatgcctatgtcttgaatggcattgccaagattttttcctagggtttatatggttttaggtcttatgtttaagtctttaatccatcttgagttaatttttatatacggtgtaaggaaggggtccagtttcagttttctgcacatggctagccaagttttcctaacataatttattacatagaaatacctttcaccataacttgttttcgtcaggtttgtcacagatcag

SEQ ID NO: 627441 - DNA, 353 bp, Homo sapiens
gctgactgatcaaggtaaggttcttggttctaagagatgaaatggccgtggcaatttcctaaaatactcacagtaaaacttttcaaaactggagtcaatcctctcatatatcctgctgctttatcaactaagttcaggtaatatttacaatatttaaaatcctttgttgtcatttcaacaatgtcatttcacaacgtcgttgccaggattagattccatcttgagaaaccacttcttttgctcatccataagaagcgactcctcatctgatcaagtattgtcttgatgcagcagttcggtcacatcttcaggctccacttctaattctagtttccttgctgtttccaccacag

SEQ ID NO: 627442 - DNA, 114 bp, Homo sapiens
ctgcagaacaatagataaaaatctaaaaggttctatatccttctggattttaaagaaacccaaaaattactggctcaagatactacattgctaaagttagggggcagatgaggt

SEQ ID NO: 627443 - DNA, 142 bp, Homo sapiens
ttttggggcccccttgggttttttttttggggggggggggtttttggtttttggtttttaaaaccgggcctttttttggggaccccctggccccaaattttgttccggattttttggccccctttaaaaggttttttgggga

SEQ ID NO: 627444 - DNA, 222 bp, Homo sapiens
tgcaactaagcaaaaactagagaaagctagaaaaccaggtacttggccatagcggaagcagtctgagggcctcaccaatggagtactgacctgcttgctggaggagcacgcaaagctgcatggcttgcagtaagatggtcccagtggacaatgaaggaatgacgtaagggcctccgttcctccccgtgcctagcagctaggctataccacctaggcactgtg

SEQ ID NO: 627445 - DNA, 783 bp, Homo sapiens
ggagccggcgtgtggggctggacgcaggtgcaacctgacatgggtgaaccccaggatccatgcggattctagtgacagggggctctgggctggtaggcaaagccatccagaaggtgtgtagcagatggagctggacttcctggagaggactgggtgttgtctcctctaaagacgccgatctcacggatacagcacagacccggccctgttgtgagaaggtccaacccacacagcgtcatccatcttgctgcaaatggtgggggggcctgttccggaatatcaaatacaatttggacttctggaggaacaaaatgtgcacattgaacgacaaggtcctgcacttccgtgcctttgaggtgggcagcccgcaaaggggtggtgtcctgcctgtgtccacctgtatcttccgttgacaaaggacgaactacccgatagatgagaccatgatccacaaatggggctccccacaacagcaatttgggtactcgtatgccaaggaggatgatcgaggtgcagaacacgggcctactttccaagcaagtacgggctgcaccctttcaccggctgtaatccaccaccaaacgttcttcgtgaccccaggaacaacttcaaccatccaggagcacgggtcgggcctgaccgtttgtggggttacaggggaaaatacggcggacggacggttcatatacttcgctggaccttggcccagctctttatctagggtcctgccgagtcacaagaagtggaggccatacacctctcgggggcgagcaatgaggttcc

SEQ ID NO: 627446 - DNA, 930 bp, Homo sapiens
gcccgtccttagctcacagggaagcggatacactggagaagaatgtgttggtggtctctgtagtcacacctggatgtaaccagcttcctacttggagtcagtggagcaattataccgcgtgaccgataaagtgagtgaccacgtgtttagctcctcatctgagactgtctggtggagctctccgaggatctggagacttttagaccaagacgttgttcggaaatctgctgagggcacattctttatcaacaagactgagattgaggactttcgcccggctttcctcaccggggcgttgctgttggatacagtctcggccattacctgccactctctagtcatcctggaacactctggatgtcgatggacggtacaataaattgaagcgatgttccactggactatctgagtagatgatccttcgttcccatatgagagcttcactatttccagagctcatgagaacatggggtcctataagcctgtgagccacatgtatacagcacaggatgtgaaggaggtcattgaatcacgcacgggtccggggtatccgtgtgcttgcagagtgggacagtcctggccacactttgtgctggaggaccaggtatccctggattactgactccttgctactcggggatctgagccctcttggcacctttggaccaagtgaatcccagtcgtcaaataatacctatgagttcatgagccacatgcttcttgagaagtcagctctgtcttcccagaatttgatcttgcatcttggaaggagaatgacggttggactatcaccttgctggcaagtcaaacccagagatcaggactttatgaaggaacgaaagggcttcggtgacggacttcccagcagctgggagtccttcataaatccagacgcctgctgcacatacgactcatcttatgggcaaggga

SEQ ID NO: 627447 - DNA, 1261 bp, Homo sapiens
  misc_feature (1119)..(1119): n is a, c, g, or t
  misc_feature (1130)..(1130): n is a, c, g, or t
  misc_feature (1182)..(1182): n is a, c, g, or t
  misc_feature (1236)..(1236): n is a, c, g, or t
  misc_feature (1255)..(1255): n is a, c, g, or t
ggggaggagtgtctccagatgtgtgtcccgcactgagcgatgagcctggtggactaaccgcctccagggggcgcgtgcatgaagcctccccgccaaccttccagaaagatgctttgcttggcagcaaacctaacaaaccttcactacccagtagctctcaaaacctgggccaaacagaagtgagtaaagtaagtgaaacagttcaggaagagcttaccccgccaccacagaaagcggctcctcaggggaaaagtaagtctgaccccctgaaaaagaagacagacagagcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttacncctgcgatgtnacagacactgatggatagcatcaagctacttaatagattgagggaagaattnaaacgtttacttgctccaaccatgaacacaagttccaacttccagttaatcaanttggaatttaaattttggnaaaagg

SEQ ID NO: 627448 - DNA, 349 bp, Homo sapiens
  misc_feature (296)..(296): n is a, c, g, or t
aatgaagtcatgggaacttggagcttgtcaggggccagcagttcagcattttgcagggggccaccgggttccatttcagattttacaccaaacccttgaggttttccaccttacccaccagcagctacgggaagggcccaacatagtttgtaaaggctgtaggcttttcatttttcaggctttagaaagaggcatgtttgctgtgacttccaagaaggattttttgcttcgtttgttcagtcttacaagaaaatctccgtagatgttctacttgtcacttatacagagacagcatnttcagcgcctcagttaatgcgactgaggtgaggacctccgcagtatctcattc

SEQ ID NO: 627449 - DNA, 833 bp, Homo sapiens
  misc_feature (691)..(691): n is a, c, g, or t
  misc_feature (702)..(702): n is a, c, g, or t
  misc_feature (754)..(754): n is a, c, g, or t
  misc_feature (808)..(808): n is a, c, g, or t
  misc_feature (827)..(827): n is a, c, g, or t
aaaaaaaaaaacaaacctggaacattcaagtatctgtgatgttgtcaatgttgcaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttacncctgcgatgtnacagacactgatggatagcatcaagctacttaatagattgagggaagaattnaaacgtttacttgctccaaccatgaacacaagttccaacttccagttaatcaanttggaatttaaattttggnaaaagg

SEQ ID NO: 627450 - DNA, 1021 bp, Homo sapiens
  misc_feature (16)..(16): n is a, c, g, or t
  misc_feature (879)..(879): n is a, c, g, or t
  misc_feature (890)..(890): n is a, c, g, or t
  misc_feature (942)..(942): n is a, c, g, or t
  misc_feature (996)..(996): n is a, c, g, or t
  misc_feature (1015)..(1015): n is a, c, g, or t
gatcatattcccaggnttcagaagctattgaagtcaaagctgctattgcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttacncctgcgatgtnacagacactgatggatagcatcaagctacttaatagattgagggaagaattnaaacgtttacttgctccaaccatgaacacaagttccaacttccagttaatcaanttggaatttaaattttggnaaaagg

SEQ ID NO: 627451 - DNA, 104 bp, Homo sapiens
atgtagaggatcccagagactacagtagttctacgccagtacagcacccgatcaaagcagtggttcatccaagctggctaccccaagcactggtgctcgtgccg

SEQ ID NO: 627452 - DNA, 146 bp, Homo sapiens
  misc_feature (8)..(8): n is a, c, g, or t
  misc_feature (102)..(102): n is a, c, g, or t
ctcggtanatgcaggcttggagatagagctgcgtcccagctcagcatgaaagcatcctggagtgcaacctggcggagacagagaaccgctactgcgtgaagntgtcccagatccaggggctgattggcagcgtggaggagcagctg

SEQ ID NO: 627453 - DNA, 369 bp, Homo sapiens
attaattgccctttttctttttttcttgcttttaaagggtggtggccccccctgtttagaattacccctgggaacagtgaacgtaaaaaattgtttttaacaaagtttgttgcccaaatcagagtggatcatgggggtttggcaacagggaatttgtcttgtttgaagcccggcttttggctcccccccccctttttctgtccctctgcctggggtatgggaagtggggatgccaatggcccagctccccccctggggatttaaaaacggcagacccaacatgtttctccccccgggtccctcgatgcctgcaggccccagggtgtgcccccacttattttgactttagggaaagtaacccaaagtggc

SEQ ID NO: 627454 - DNA, 138 bp, Homo sapiens
cgttgatatcgttacagtattgagggtctgggtatcctttaacagcaatgccggtttaaagggcacggggtctcttcgggttgattatagcttgctggacttgttcctacctcttgtagcagctgcacggacaagatt

SEQ ID NO: 627455 - DNA, 171 bp, Homo sapiens
gtttttactgtatagactaaatatattctatttacatgtatgtcaacctcattacttttttcctgtgaaccagtattaaaaaccccaaccggcctgataataaggtgaattaacctgtgtcttcccttggtcttagggatattcctgaggattgaattgcaggtttcttaa

SEQ ID NO: 627456 - DNA, 617 bp, Homo sapiens
ggccacgtggggtgtccgcccccggggggtgcgcgataccccctgtggggggggcggcggggcgcaccccccgggggcgccccttgtccgccgcgtcgtgttgttccccccgccgatgtttgtctgatcatcctcgggggggtgtcctccgcgccccgccgccgcagcgccccccgaggggggggggcgacacccatcgaggggtctggggtgcgccggcggtgctggtggagcttggcgtgtgctcctggggtcccccccccggtcttcttcctcccccgccggcgtgtcttttttctcagcgcgtccccctctgcgggaggcgcaccgcgggcggcactctccctggcgcgccccccgtcttgttgtggtggcgttcccaccacccccccccccgcggccgcgcaggcgcccgccgcgtcgtgaagcgagctccttgcccacgtaggtggggcgtatagtgttcttcctcctagcgggggcggcgcccgccgggggccgccccctctctccggcccccccccgcccccccccctttttttccccccccccgccggcgcgggccctttttttccccccccgggggggtgaccccaaaaaactttttggggttttta

SEQ ID NO: 627457 - DNA, 884 bp, Homo sapiens
aattcggtgccgatgtttgtgtgtgatgccgtcctaagtttatttgtagtgatcgggcttgcgagttggacatatggattcctgctggcccgatttgagcggccccgttctttggggtcgaacatagagcttgcgcgcgaaatattgctcacatcagctgcgggcttgtgtttatgcgtcacggagccagatggttgtgtgtcgtccacctcctgtggcgaggatacacttatgtgcgcgcgcgttgtcttattggctaatgctccctctggcgggccttcatattgtattcttaagattctactgtcgcttgtatcgaccctactctggactgattactcgattgcctttacgggcataatttgttgaatacaccagccacattcagcccctcctgttgttttacaccgcccatcttcaattctctcccaatcccctcccgtaattatttttctcccgtggctcaccgtacattattccttatacatgttcgccacctgcgtgttttaatactcattcctaacctttatatttctatctctctcaagtcacaatccatttcagaaattatcttctagacgctcgttccaccttttgccccataatattcctctcttctcaaacttcttcaaactttgttctccccactataccacctattttatgacttttttgaccacaatagctctgtttatacccttctcgatgacccccccactattttaaccaccgtggtggtaattacttctttgctatttgcataccaacctttttactcgtgacagacaatatatcctattcctacctacttactggttcgccgccagaagtcttgttcacgcccctatttcccttaaaattttcccccaccccaaaaacaaaca

SEQ ID NO: 627458 - DNA, 140 bp, Homo sapiens
  misc_feature (40)..(40): n is a, c, g, or t
tatataacagcgagagactaatgattgaacacccttaatngagtgggcttttcctcagccagctggtggaaggttgatgggcttcaagcccagcacagcccctgtgccctgtgcccctgtgccagtcctgagaatgggtt

SEQ ID NO: 627459 - DNA, 446 bp, Homo sapiens
  misc_feature (28)..(30): n is a, c, g, or t
  misc_feature (99)..(99): n is a, c, g, or t
  misc_feature (405)..(405): n is a, c, g, or t
  misc_feature (429)..(429): n is a, c, g, or t
  misc_feature (438)..(438): n is a, c, g, or t
cagtgaactctgctagatgccaggaagnnnaaaggaaaggtcaatgagaaataaagtgctcaagggcagattcaaggaaaacatggggagcattcaganaaccaggtcttaaaagagaagttaaggagaacagcaagaagcaagcacacaggagcaggcagaggcacactggttgagaaagtaggatgcccagcagcctgggtctgattaaatcagaaattccctctgtaggaggacaagcaaagcatattatcataggctgggcagaattccaaaggtcatttcatccaacactccttcagacgctggaaacttcaaggttttcggaaggccaaaagtgggaagtgttaggacatttgcttacagattttgaagccccaacatttttgtccttttgccttttcntaatttttggaggaccaaattttnaaaccttcntggaattt

SEQ ID NO: 627460 - DNA, 723 bp, Homo sapiens
  misc_feature (27)..(27): n is a, c, g, or t
  misc_feature (127)..(127): n is a, c, g, or t
  misc_feature (162)..(162): n is a, c, g, or t
  misc_feature (192)..(193): n is a, c, g, or t
  misc_feature (622)..(622): n is a, c, g, or t
  misc_feature (697)..(697): n is a, c, g, or t
  misc_feature (706)..(706): n is a, c, g, or t
aggggcctccttttattctacccaacnaatagccccctatatccttttttccacatcaactaactcaatcttttaccacctttccacacctctttaccctcaataaatttaacactacctccctgtnaacttttaacaaaattttttattgtggagagggcnaacacacctcatcccccctttctaaacacnncaccttaatactacgtttaatttttttcacaatatcacaccgccctataaatttttcctcttctaaaaaccaatatttttttaactacatccatcagatacccaactcttctcaaatacttctataaataccaattccatccaatttgaatttttctttaacgtgcatcccaaccaataagggattccctcttaacagcacccattttgacctaatcccactattttccctaaccgcccctttctcattgtcctatatatccggcggctcttaaaaaaaccctttttatcccaaaacccaattttaaaaaaccctcactataatttataaaaaaacccccctttattccattgctttcgacttataaaaaccattccctttccaatatccttgtgaaaatactcataaaataaattcaaaccttccacnaatataaaacacccccgcacaaaatatctcaaattaaataagaacaaaattcttataacaagccgctaacattanaaacttttnttaactttttgtggaaa

SEQ ID NO: 627461 - DNA, 881 bp, Homo sapiens
agcggagttaagctacctcgagaaggttccagaagtcaaagacacaggcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacgtgaaatgaaaccagttttaaaacaacggatgtcagagttcctgaaagactgtgcagagcgaattataattttaaagattgtccatagaaggataatcaacagattccactcctttttactctttatgggccatccaccttatagcaatgcggggaagtggaacataaaacaaaaaacagcagagatgatcaggagtcgaacagaacatcaagaggaatacgcacagaccgagggaaagaagaggggaatcatcgagaaacagaaacggggccaaccatcagagagactaaataaagagccaaaggaatcagaacaccgaatagcggaggcagagttctccggcagttctccggcgcccccaagccagccgcagggtctaggagctatgcggaggacgccggctgagcacgagaacagatgagggctgaagcgagaaaaccgactacggcgcaccgaggaggacggccaccccgggcagggcgtccgcacacgcaggcgaagcaagcccgagggaacaactaagtccgggactatgggaactggatgatccgcccatgtcccacaagagtgccactgatgagacatggccggctcgcacgtccgcaccaggtggccagccgcgacctgggcggggcggga

SEQ ID NO: 627462 - DNA, 276 bp, Homo sapiens
ctgctttcatctttaacagaacagcctcctctagagggatatgaagcggccgccagccccttcgagttctaagctgccgctcgcaaggatctggcgagcacctttgcagatttaactgaggaggttaaggcctaaccataggggggcatctgatcccagcttgggtcttagctattgtgtgtccagatatgtgaaagccactttcgtagtctattttgtgtcaactggagttttttacaactcaggtgagttttagctttatggtggagggggtga

SEQ ID NO: 627463 - DNA, 546 bp, Homo sapiens
ccccgataattgaatttcgctactctgtctttgcactgactcagggccttgaaccttctctccccgttttaatttcctcactcttaagaaagtacacgagtgatggaaagaattctgttagaaaatgacttgatagaatacagaatgagctccgagggagggagaatttaaccactgccatagataggtgctgccacacaaagttgttgtgagaagtaattagtctggcggatctggggaagaatgttgatttgttgaatcaacaattatttattgggtacctactacattaccagtgacaaagactttcccttgaccaaaactttagtcaggctcctctgagtcctctgattgaccttgaacttccccctgtgtccttatagaatcccatttgagcaacaatcctcctaagtcaggttagaaaaaattctccacccttggaattccttgatatcttatcaccctggcctgccttcggccataatcctatcaagttgatttagccagaacacctttatccttgatatttcctgttaagtaatttct

SEQ ID NO: 627464 - DNA, 153 bp, Homo sapiens
tcattatgggccatgatcagagtaacaatgtccttcatttggcattgaggaaaatgtatgtcacgagctcatgttgtgtgaaagattatactcaaattcataaatggaggttgagttattctttgagaataatgtagtgttggtctcatcgag

SEQ ID NO: 627465 - DNA, 135 bp, Homo sapiens
aaaaaactattatggtactggtaggtttaagcggggcaactattgcttcaaatttaccttacaacgatattgtgacttcagcttcagctaaatatggatatgacccgcttttaattcatgcagtaattcaaaaag

SEQ ID NO: 627466 - DNA, 680 bp, Homo sapiens
  misc_feature (651)..(651): n is a, c, g, or t
cgtggaggctgcgatgcatgtctgttgctagttcttgattttacccgtctttacccccgggacacagagatgactagaagtgagctggttcatagccctttgagaggagcatcgataatacgtttgcattaacatctgtccatttgtctccagatacagtctgggctgaggctcatttaagtatgattctgcacacttggagcctcctaattatgttctgcacctgtgtgtagtctttgcagcatgctctggagacaccggggtccccatcaggccctcaagggttcccagcccatctgtcagcctctccatccattagctgacatgtgactcagctgctagacagagcacaggggtcaggcctccagctgcctttacctgctccatcattatagccagaaacgggtgaatgagtcttggagtgaatgtgcttctgcctggctttgctagaggctcatggaggccacccacctgggaatcttgagaccttttccttgggaagaagagaggggacagcacagagagctggtgagctccttataactgagtaataaatgaaagccctggggtatggctcctcgggccagagacaatgagagctcagaccagacttggtagtttcggcaaaggaggacttaacatttgtttcanggctgttcttgtcttactttgtatcactc

SEQ ID NO: 627467 - DNA, 234 bp, Homo sapiens
  misc_feature (11)..(11): n is a, c, g, or t
  misc_feature (13)..(13): n is a, c, g, or t
  misc_feature (59)..(59): n is a, c, g, or t
  misc_feature (100)..(100): n is a, c, g, or t
  misc_feature (104)..(104): n is a, c, g, or t
  misc_feature (107)..(108): n is a, c, g, or t
  misc_feature (116)..(117): n is a, c, g, or t
  misc_feature (130)..(130): n is a, c, g, or t
  misc_feature (169)..(169): n is a, c, g, or t
  misc_feature (199)..(199): n is a, c, g, or t
  misc_feature (222)..(222): n is a, c, g, or t
ttaatatgacngntttaatataagcatatgaaagtaaagctccttttctgactgtgaangttgtaataagaaggtggttggttggtacttaagtggtctnggangcnntattatannttttttttttgantgagttaattcccttcattagagcatgctggacagacangaggagctaagctttgtcagctctgtaaanccttcctttctcagctaaggccnggtaaagctaat

SEQ ID NO: 627468 - DNA, 1592 bp, Homo sapiens
aagatgaggaagaggaggaagaagaggaggaggaggaacgaagagcctcagcagcgagggcaggggagagaagtcagccacgccctcacggaagatttctggacccgtaacacgtgggagagccagctgtcccggtgcatggtcctcccgcgacgcatcctgcagacggtcgtccaggcgttcctggtcttgtcccatcttccatgagtaagctgcttgtcgctgtagggcccaggagactccgatgtctgtatagactccagccatgactgacaagatgctggagcaccgcgaagagaagcggtgcgctgctactgaacgcttcactgagagagggtgatcaattctgcgtgattgcagaggaacgaatagtcctaggctagtgaagcgcgattggcaaggtctgcatgggagtggcgaggtgaggaagttgcacgcatgggaaatgcgatgagacggccttgatatctaaaacatcccgtcagctcactattcgagacttcacgagagcaacacgtttcgcgtctacacgaagggcgtcgcgtcaaggtggcactctacgtagggaggtttcatgtctttccataggacagttgacactcgatcgaaagggttccgaaagggggccacacgttgggacgccagaatcgcgttggtaagctggggcgcgcgctcggtgacatggcgtcgtggcttagaaaaacgcgaatcaacgtggtggtatgtgcaacgtcgaagtgggacccttcaatatgtatccccctcgagaagggtccctgcattgcgcaacacccgcgtgtggactgttggcttagagggatggttaacagggttggaaccgcgataatggcccgccgaaaccatgtcggcctcacttgggtaaattgccctggccttccacctatccgggaccgcggactgcaacgatgattccttgcctggacaagcaaccgggtaggatgaaccaaatgtggtgccttcacggaaacttcaaaaaaggccccattcattcccagccatttcagcacatttggggcacctatggggaacccccattgttggaaagccttgtggggggcacgggtgggaccctctggtggattggaaaactcctttgaagggggcggcacacgccacgtaaccgctcgatttttgcccttatggaggccacagcgtggaaccttccagtgggggcccaaacaagggggccgaagcgcggcgggggagcttccattgggtagggttccccccagcatggactaggtctcccccagggtcccaagagggtcacaccgccaatggaggggagacaacgagccgattggatcgggaggataagcaagggactgccgccttgtttgccaagcgggcccacagaatggaccatacccatggggaccagggagaatcaacacggggagcggagacaaacacggtggactaacctaggacgaggagtcccagaagatcgccgggacaaccaggggtcagccgagaggaggaacggatcgggggcccccccagaaggagcgagacgaacgggggcacgctaaagcacgaggaccagacaacagtgtacacctcaaccacgg

SEQ ID NO: 627469 - DNA, 295 bp, Homo sapiens
agtagagatggggtttcaccatgttggccaggattgtttccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacggcttggccgggatagtatattttttatagcacttcccctactgattgcttgccttctctgtggctacaa

SEQ ID NO: 627470 - DNA, 163 bp, Homo sapiens
tgatgaggaaatgacagagagctgaaagagcccagactcgaggacctattgctccgcaagaatcacatcttccagaagaactagacagaaaactagcgcgtcatgggaactctgaaatccttgtatgagtagcagcatcagcctctgtccatacagcctctgt

SEQ ID NO: 627471 - DNA, 866 bp, Homo sapiens
tatgttgtccgaatttattcagacagtatgactatcttgtctatggtgtaaacattaagggcgggcagggttttcggtaacaaggtcccttcttctgatacatcaaggtgggccgatgagataacatactttacattcgtatcgtaagtacgtacggaaatgatgctatttaaaggaagtaaagtacgtattatctttcgtaagtataggtacaataactataatggaagatatgaacttgttatattaatagcttggtcaaagtagtcattgcaagggtctgtcggaatgttgaggtggatgataccattctttgatattcctcatcgtggctgatggtgcgtcgagtattcttattgactctgaccctgtctatgacgtaagaataatatattgacaagaatgtgtaggattatgattacacggtgctcggctggattcttctccaaaacgagagccatacatttatggttgattactttaggttattcacacggggtcatgaaggctctgacttctctgatctatcatgggatttggacttcttgctttattacattgtctcttaccttattacgtaatctccggagagttataatctgattcgttgtgtgatttttaatttatttatgctgggggatcggagagtacataggcctaatagtaatgtggatacctgtttacttgtctcctttatcccttacttgttgatctcagcaataatattctatctctgggggaccattgtccagtcctcgtttggaacagcaaagtgttccgggcttgctggacgattgtccaacaatgtgaccagtccttctggagatgaggtgtcaacccggttgttcagacctgtaaggagaacg

SEQ ID NO: 627472 - DNA, 115 bp, Homo sapiens
actgttgttcatacctgcactgttgttcatacctggtcgctgtatcgggggaatgctggagattgtaatgggtatggagacatatcatggtatgaacaacagtgcagtgttacct

SEQ ID NO: 627473 - DNA, 448 bp, Homo sapiens
aaactcgctcgggttgaccgtagctagtataagtagttgctagctgaccaggtaagcataaggcaggtatctacggtccccctagccgtgctcccctaccctacctacgtactagccaagcctcgcctcctaccacaccacaccaggccaccccagctgcaagtagcctataccttggagcagagaggcagcctacgtcctacctagtcccctactacctacccagccaccatacgttcatactgctaccgggcagaactagtagtaggcccctgcctagtagccagccataggggctacgggataggactaccctagggccccacccattgccaagccaggaaggcagctttcgctagttcctgcctcgggacagccccgggtaaccccagcatcctgatatgtaccctctaccccacttcagaggccacccactcagcaccaccgg

SEQ ID NO: 627474 - DNA, 144 bp, Homo sapiens
ggggggggggggggggggggcccccttttttttttttacccccctttcctttttttccccgggggggggggggggcccctggggccccccgggcccgtttggccccggcttttctttcccctttagggccccctgtggtgccca

SEQ ID NO: 627475 - DNA, 307 bp, Homo sapiens
cagtacatttatgacgctttagtcaagcactttaggtgcggggaacatttacctatgtcaaactctctgaataagaggacatttcattatcattaacattaatcatctcatgaaacccaaaggcaactggtctacaaaaaggctgtaacaaggacctggaatgccaggaagtaccaagggcaatatttgtgttttttggtctacttttctatgtgcacctgattcattggacccaaatttgccattaaacctttctaatttactttttctgtcatcaagtgaccagcccagctgaattattgttact

SEQ ID NO: 627476 - DNA, 331 bp, Homo sapiens
atctccaacaagtggtccaatttaggaacgaaaagcctagatattgttctgaaaaccgtgctctaagggcgtttgaaagactgccaggtagtgcgagcctgagatgatctggaggattctatctaatcgtgactacgttggtctgaaggtcaactgagaaatcttgtgggacagagacttgagttaggaagccctcagtcacttgccttccacggtggccagccctgctgacatcattggctgaagcaccaccaggattcacggcacccaactggttcagggtacttcgtagactctggctcactacatgtcgaaagagttatttgagttc

SEQ ID NO: 627477 - DNA, 334 bp, Homo sapiens
gaaggttggggcacgaaggctcatcattcaaatataaaacaaaataaaaaagtattaaggcattaaactaattctgaattaacatttttataaccaagaactaaacatgtgcaaattctttttgagctacaataaaaattaaattatgctattagttataataagagctctgtcgaatatacaccaaactatatacttcagcacattcacaaacaatgttgagcagcaaggcttttcaacaagacatttaatacaattagttttcaacaaccccttggtggtccacatctacaaagatatccagcccaagccaaacccccttcccatctttcct

SEQ ID NO: 627478 - DNA, 283 bp, Homo sapiens
cgttaggtcaaggtgtagcccatgaggtggcaagaaatggggtacattttttcccccagaaaactacgatagcccttatgaaacttaagggtcgaaggtggttttaccagttaacctaaaattagagtgcttagttgaacagggccctgaagggggtacaccccgcccgtccccctcctcaagtatacttcaaaggacatttaactaaaccccctacgcatttatataaaggagccaagtcgtaacatggtaagtgttctggaaagtgcccttggccgcccca

SEQ ID NO: 627479 - DNA, 944 bp, Homo sapiens
  misc_feature (36)..(36): n is a, c, g, or t
tgctgatgcgtccgccggaagggttgtaacccgccnccgtaggggaaatcggtaagccatggcaagggggcccaaaaacaaggggatgccgtgcccaacaagaggtttgctccagcgacaagtggatgttcgccgcggagttaagcggcgaaaacgtttccaaaaggcggggctctgtaacaccgggcaagggggacaaacatttgcacaaaccctcctttgggccgccctcccgagccccccaacacgggggtcggagcagaccgccgtggtgaaaagggccccccgccgaaaacactggggggcgcctccattgggccgccgcccgcaggggaaagcacgcgtgcgccccagggcggcacccaggtgttaaaagacccccgctaataagaaacagggggttcaccccattgcggtgaggcctcccctcccgcgtacatatttctgcacggcctaaatttccacgcaggagcgcttctttttccccgttagaatctggtcaggcaaccgcgcaccccgcaatgggtatactgtccgtgggtcttttttataaattcacatgcgggccacaaaaagttattgaatccgcgataaaactgtgcatcttgcatttgacaaaacgctaaaaattggggggcccctctaagaatagttatccctttctgcacccgccgcgggagaattaacagatcgctcgcaacgttagtttatgaaaaaaaataagcgatgatgatgaaaaaaggttattggacggaaggagcgtgggcaccagtacctctcgtatagtgaagtcagagtgcaagagcaaattggttccacctcctaggccattcttgggccagctgcatatccttccgtgggatccgtaataatgccaccacgatatgtttttggttgttaaaaacccttggaatcaccgccaaaaaaagaaactcaaacaaaac

SEQ ID NO: 627480 - DNA, 1204 bp, Homo sapiens
  misc_feature (467)..(467): n is a, c, g, or t
  misc_feature (859)..(859): n is a, c, g, or t
gatagctgggtctgtttctatcacatccctttcctccaggactacggagctgccagctgctgatccattgctctagcacccttcccttcaaaatcaggcaagaaaccctaggagcaaaacctgagcctcaagcctcttgtctctatcccaccctcaatacccgccatggcaactcccagcttagccttctgaagaagaaatattatcagttcttatatttcaattccctgcgtcagagcagaatttcttgagtcaacaaactcagttgcagtgatatttagttgaagcccctttaagttatgttcattttgtcgtggtggttgtaatatgatttctggactggaggcattttcatctccttcacagaggtcatccattccaccaagaactctgctttccccccgcccaccaagaaactgtttaaatcctgaaatacttcttcaccccaatcccaaaggggccctatngttgctagttttaattcctgtagctcctgttctaagtcatgcccatcgaagaatcaagattagtccctccactaaatcaagatttagtactcttgaaaaggggagatgtctggaaagaagagcaagataaaaaccctgcacatcaacaggaagtataatcctgcagttactaataattcctgtagaagcagcagctctaggagtctccagatctgattctcagtctgtgtgcaagccaggctggctctcgtgcatgactgtctatgggtgtggaatgtacgtcagagcctgtgtagagatacaggcagatgggctaactcctcatgtctagtcatgctggcagggctttccccacatccatgcttttgaaattagtgtgagtgtacaggttngtgtgtgcatgtatacgtgtgtgtgcacaggaagcatttccacttgagggaaatcctgccccatcatgcctacctccacaatgaaatcactcgttttttggtgtttgctcgcctaactgacttgaaccccattttatttatttagtttttttctcatggcaaagtagaatacgttggaaggtgtagggaaatcctgctggactgtgtttcagagtaaatcttttttctctccggaatttcttgttttgctatacacaattatatttacctgattatgaaaaattaattttccttatacattttccccttacacactagaaaagagcaccttgttactattacggt

SEQ ID NO: 627481 - DNA, 970 bp, Homo sapiens
  misc_feature (233)..(233): n is a, c, g, or t
  misc_feature (625)..(625): n is a, c, g, or t
cccaatagatgacgtttgggtaacgtttgaaatgactctgaacattatttccatagcaatttctgtggctgaggagacttaaactttacaagtatatccttttaagatcattttaattttagttgagtgcagaggtcatccattccaccaagaactctgctttccccccgcccaccaagaaactgtttaaatcctgaaatacttcttcaccccaatcccaaaggggccctatngttgctagttttaattcctgtagctcctgttctaagtcatgcccatcgaagaatcaagattagtccctccactaaatcaagatttagtactcttgaaaaggggagatgtctggaaagaagagcaagataaaaaccctgcacatcaacaggaagtataatcctgcagttactaataattcctgtagaagcagcagctctaggagtctccagatctgattctcagtctgtgtgcaagccaggctggctctcgtgcatgactgtctatgggtgtggaatgtacgtcagagcctgtgtagagatacaggcagatgggctaactcctcatgtctagtcatgctggcagggctttccccacatccatgcttttgaaattagtgtgagtgtacaggttngtgtgtgcatgtatacgtgtgtgtgcacaggaagcatttccacttgagggaaatcctgccccatcatgcctacctccacaatgaaatcactcgttttttggtgtttgctcgcctaactgacttgaaccccattttatttatttagtttttttctcatggcaaagtagaatacgttggaaggtgtagggaaatcctgctggactgtgtttcagagtaaatcttttttctctccggaatttcttgttttgctatacacaattatatttacctgattatgaaaaattaattttccttatacattttccccttacacactagaaaagagcaccttgttactattacggt

SEQ ID NO: 627482 - DNA, 1758 bp, Homo sapiens
  misc_feature (153)..(153): n is a, c, g, or t
  misc_feature (162)..(162): n is a, c, g, or t
  misc_feature (416)..(416): n is a, c, g, or t
  misc_feature (1502)..(1502): n is a, c, g, or t
gaccgctgcccgaggcccgaagctatgtgcagcagaggctccgtgggttacgtggtctacagtggtggacttggacacctcggtgcagtcctcggtgctggcatgaatggatacgaaggtcgtatggacggtccagtatggcctaatcatgcncacgagaanaattcggacgcaagagaggaatcgactgtcgcatcgaaatgccgagggagagaagggccactagaaatgccattgcgggcgtcacatataagagggttcgcttacacttgaagggagtcgatccaagacgacgtgagagggattcgattgcgatgggaaggttaccacttcgtggggccgcgggcgcatcacgagatctcgggacgtcagccttgtaatagacgaggagctcggcctatgcctaccgtgaggancaatcactactttctgtgcacccaagggcccctcgtgcgggagtacgaacctcgctgaaaaagcgagagtcttgggaaaattacgttctcgcaagacgtgcgcgaatgagcggcaccccgaaagttaatgcttgattcacccagttcggaatggcgcttacgcacggagaacagagtggcgtgaacaatacgtactcggaagaggtccacgagggtttgtacggagtgcgtaccaagcgtcttgggctttgaacatccctaactatgggggcgctccaaccccccaaaggggagttacaagaatggcgttacccaatgtgatggcatccgccccttgggagtcacggcgaggatatatgggcggccataggcgaaacatttttcctctgaggcttaggaagcggccggagggcttctccaacattgtggcggtcgcccggaccttagagggttggaaaccccttgtggaaggtgggtgcgcaacgttctctaacctggggccaaaaaagaatggccgaagaacccaattataggcggggacaacttttccccccccaaggtggccccttctgggagagaatacttaccttttgcgcttcaccaacgtaaaagcggcgccaggtgtgggagcaaagggcccacctttggtggcaggtagcaacacggtaagagcgcccttcacaaaggtgggcgcgagcaacagttcccaattgccctttaaacaagcaatggcggtcgttaagggcaataacttcaccctgggcgggataggtagaacgcgccccgcttaaacgcagtgagattcccccaaccattgggcaggttctcctcacccaaaggggggataacattacagtgtacaccacaacgcggcaacaaaggaaaatccttccggaggaagggaatgggcgcccacatgagaccgcaccaaaaaggggcacgcacacgggccacacatttataccacaccaccggttcgtagatcacaacttggtctatcgccggaagaggacttcttcgcgcaacgcgttttccacaaccgcaacaaaaaagagaaagcgcggcgggctcccgcctaattgtgtntctgcgaaagaagccggactatggacaggcgccaacaccacgagctgtccgtaaaaggtgcgtgtgcaccttggtgggtcaagacggccgaaacgcaccacacgagagattctctaagtaaaataaccaccatttacgccgtgtttgtgttgagaagagcccttcacatgtgtccacatctgggattccactccgcctctgtgataaccagtgacaaaagggtgcagagctggttgcgcatcacgggcacatctcg

SEQ ID NO: 627483 - DNA, 482 bp, Homo sapiens
ccagagatcaaagagcccttcgagccccagccaaaaggtcccttgcagagtcctaaagaagaaccccctggaaaactttagaatcctggtggagcttaacccatatgcaaaggccctgggccgggaccccattttttgccagggcaggaatccccagctccgggggggtaaggcagctgctgcagcaacggcccttccaacccaatcaaattagaagggggcgggtgccggcaaaaagcctgtgggagggaaaaaaagaaaaaaggctgctgttggggtttaaaaaccaaaaaagcctctgggggggaaaaaggccgccgcttcccaaaaaccccgccccttaaaaaaagcccgcagagaagaaaccttcttcagaggggaaaaagcctgctggattaactttttaatttggtttttccctaaagggccaatccttttgggcaggttttttttaataaaaacccggttataccggccgggga

SEQ ID NO: 627484 - DNA, 358 bp, Homo sapiens
gagagagagagagagagagagcgagagagagagagagagagagagagagagtgtgagtgagagcgccccataatccccaatctgagcccagtgttgtccccagatgacttcacaccccatagctgggctggatacgcttgatttgcactctgacctgatcggaaccatcttcccctactccaccgcttgacctcctccctttgccctatccctgctgatgactctctgctgcatcccttcccaacttctctaagttccgtttcacccaggccttgttctaccaagggatcgatttctcgatcaactttcactagatctgtatcatctttggcacctacacccccatcgtgtgccctgt

SEQ ID NO: 627485 - DNA, 615 bp, Homo sapiens
  misc_feature (262)..(262): n is a, c, g, or t
  misc_feature (340)..(340): n is a, c, g, or t
  misc_feature (412)..(412): n is a, c, g, or t
gggaagtgtgcaggggtgaaggtagagaatagagttggagaaggagaaagttatcagatttttcattcaaaaaagttcatttataaaatttatttattaaagttattaaaatgcagggtagggaagagacaggaaaggtcaaaattaaaaacatgaaatgagggaatgtttatattcttattctttaaagataagaaagacatttcattttatgtatagaattctgttattttaaaatttattttaacattgatctaattgntttttccaaatggaatagagagatggagactagatcacatcattaattaaaattgcaaagtaatggccgggcgcggtngtcacgcctgtaatcccagcactttgggaggccgaggcgggtggatcatgaggtcaggagatcgagaccatnctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaa

SEQ ID NO: 627486 - DNA, 476 bp, Homo sapiens
aatggaaccaaagacctgagatccattgtgattatatcttcaccaggtcagcagagaagggaactgcgcagttgaactctgagttcaccaattgtaatatttggaaattatctacaatgtaatcttccctctgttctctgataacctacttgcttactcaatgcctctaagccaagtcaccctgttcctatgggcaggaggtggaaggatttggcaagctcaaccacatgctatttagttagcctcagttgtccccaacattctttctgcaaagggcaggagagctttgggggacaggaaaaggcttaccaggctgctatggtcaactcttcagcacttttcagagcaatctaaaagcgccccacttcgctatgtttacagtgatactattaagcaaatgcatgtgcttctgctctgtctttccaagtatgatcacctaaaaaatttgtacatcacaatcatttctccccaaaaaa

SEQ ID NO: 627487 - DNA, 468 bp, Homo sapiens
tgaagctgtgccatcagatgtggaacggcccgactcggctgtctgactgtgctgtcggtggtcagcgagacccttgcatctctcacacgggatcggcactccagaccccttgttgcccagggatcctgatcgcacagacgagatgaagcgcaggaagcgttatcattcacatgagtgaccatatctatacggagacaccatgcttgttgaccggactgaggcagaccagcaacactggaagcgttctcctatttccgtgccaaaggaagatcatacctcctatccaagaacgggaaggcaacagacagtggacactcccgtggctcattccgaggaaccggcatgtggtgcaaccagcccggttgatcagtcccgttaagtttctatgtatcaagctaattcaccagggaagtttcgcgaatgaacacaacaaaccatggggagttcaccatggcatcgtttaaacac

SEQ ID NO: 627488 - DNA, 475 bp, Homo sapiens
aagaggtggagtctcccaagtggtgctaagtttaaccaaaaagaccagactaatatattaatatatatctagctgtccagacagcctgtatctatgggggacagggctaggcccatgcctgggtggccgcctcaccccctcgcgtctcctcactcccttctacctgccactcacacagccaggtgccttggagggtcccaagctgtgccccagcccaccctcctgtcttcccagggtagcccgcctgccagtcctagctgcacagcgcagctgggcccaaccctgtctgtagaggcgcctggttgtatctagcactgccctgcacggtgggccttgctgggggacgggggggccccagttcagccttctctccgcagtctaacccagaagaagcctctttccccatggaaagacgaggccctcgggcccagcccccacagtgctgtctgatctgtgctttccagttcacccccaa

SEQ ID NO: 627489 - DNA, 627 bp, Homo sapiens
agacagagtcttggtgcgatgcccaggctctagtgcaatggcgcgaccttggcttactgcaacctcggcttcccaggttcaagctattctccttcctcagcctcccaagtagctgggtacacaccaccacgcctggctaattttcgtatttttggtagagacaaggttgtaccatattggccaggctggtcttgaactcctgacctcaagtcatctgcccaccttggcctcccaaagtgctgggattacaggtgtgagccaccatgcccagttggtattttgttttgattttgcatttccctggtgactagtgatgttgagtgtcttatgatgtgttctttggctttggtatacttctttggagaaatgtctgctcacatcctgttcccatatttaaaatgagttggctttttattattgagttgtaagagttcatctatttttttttaatgtgcttttggtgtcagagaaactaatgtctaatcaacgtgtatgaagatttatttctgggtattcttcttagtgttttggagtttcatattttacatttagggctttgatccattatgaattaaattggggtttatgatgggaagggcatcatttttttgcatggggttaaccagt

SEQ ID NO: 627490 - DNA, 333 bp, Homo sapiens
  misc_feature (9)..(9): n is a, c, g, or t
  misc_feature (13)..(13): n is a, c, g, or t
  misc_feature (15)..(15): n is a, c, g, or t
  misc_feature (46)..(46): n is a, c, g, or t
  misc_feature (50)..(51): n is a, c, g, or t
  misc_feature (55)..(55): n is a, c, g, or t
  misc_feature (76)..(76): n is a, c, g, or t
  misc_feature (89)..(89): n is a, c, g, or t
  misc_feature (92)..(92): n is a, c, g, or t
  misc_feature (100)..(100): n is a, c, g, or t
  misc_feature (120)..(120): n is a, c, g, or t
  misc_feature (147)..(147): n is a, c, g, or t
  misc_feature (160)..(160): n is a, c, g, or t
  misc_feature (172)..(172): n is a, c, g, or t
  misc_feature (174)..(174): n is a, c, g, or t
  misc_feature (197)..(197): n is a, c, g, or t
  misc_feature (242)..(242): n is a, c, g, or t
  misc_feature (251)..(251): n is a, c, g, or t
  misc_feature (261)..(261): n is a, c, g, or t
  misc_feature (264)..(264): n is a, c, g, or t
  misc_feature (290)..(290): n is a, c, g, or t
  misc_feature (320)..(320): n is a, c, g, or t
gagagagcnagananagagagagagagaggagagagagagagaganagannaganagagaggggaagttttaatgntctgccataatgnctngggggccnttgtcttctgtgtaaatggnactagagaaaacacctatattatgagncaatctagttggntttattcgacangnaggaaatttccagataacaacantaacaaactctcccttgactagggggacaaagaaaagcaaaactnaccataaanacaattaccnggngagaagttgcataaacagaattaggnagtatattggagacagcatcattaaacagntatgttgttctcc

SEQ ID NO: 627491 - DNA, 410 bp, Homo sapiens
cgagggttttaaaaatgtgattttcttcttttgacctgtgaggaggataacttctttcagcccccagattttaaatacaagcaaataaactccctatttttagacgtttttttcctccaagggggttttcttttcttaaaaaactcgatctggacccagctgggtagcagccagcaaaggccatcagacaaccaaaagcccatccatttttgtagtgtcacaaacatgtatatgcccccctttgccccttaatgaaaaactttgaaacagaagttattccctgggtttttgatgatctatctgtattggaaatatgttcctggaaaaagcctttaaataatagtaaattttcttgcatgttcccttatacgggttttttaaaagctgttcaatacagtattccctctaga

SEQ ID NO: 627492 - DNA, 346 bp, Homo sapiens
  misc_feature (32)..(32): n is a, c, g, or t
  misc_feature (51)..(51): n is a, c, g, or t
taaacccccacatttaccctttttgaggaacngcccaaactgtttttccanagtggctgcacccattttagaaatatcctaaaggcggctgggtgcagtggctcacacctgtaatcccagcactttgggaggatgaggcaggcagatcacgaggtcaggagtttgagaccagcctggccaacatagtgaaaccccgtctctaacaaaaatacaaaaaattagccaggtgtggtgcaggcgcctgtaatcccagctaatcaggaggctgaggcaggagaatcacttgaacctgggaggcagaggttgcagtgagctgagagagccattgcactccagcccgggtgac

SEQ ID NO: 627493 - DNA, 625 bp, Homo sapiens
atgtgaaaactccttaagtttcttaagttaaggatgttggcttttttctttaattttttaaaaaccattttcctatgttaggagtgcaagaatagccagcatttccgatttggacatatgtcattttatgcatatttaagaaattatagctgcatatcccttctttcaaaaaatgtgctttttttttttaaagggaatttaatatattcctttaaaagaaagcaatttaactcaatggcaaagcaattatataaaaccacaaagaatgtactggaacctattaaccctttaacatacagttaagggtcctagcgcagagtcctgtgttaaaggtcatggacctcatcatctgtcagtaatgagaggatggccagaataatttggcatacaaatgaggaccttaatttggtccgaaaaataatctctttaagttccttgaaaatggagtgggttaacggttctctaaattgctatctgcttttacctagtagtggcctacatctggggacttcagagaagaattatattgcgccagtaagtaagaccaggggttatggacgcatttctttacagtacccttacgtgttggtctgaaattaaatggctataattaaaattggcgaaa

SEQ ID NO: 627494 - DNA, 179 bp, Homo sapiens
cgagccgccgggagggaatgacgtttggcttctccttttggttgcggggaggtgggtgggcttgtgccttacagaccttggtgtggattgtgtgagaggcactcaatttcctttaaaccctgtctttcacttgaccccgtagttttaactccatttctcttaagaggcagccccactac

SEQ ID NO: 627495 - DNA, 279 bp, Homo sapiens
ctgtgtcccggctgtgagagtggtgtagctcaagagagggagcgatgaggttggtggccatagacagcgtagagtctctgtggtggcatgaccccggaggtcgcatgctgtccgcctgtgccaggcaccatggaacaggggcactgagaagttcgatgaatggagagggcgtgtgacctgtgaacatgtgtggccgtttctgtgacttgtgaaggtgacagccagactcacacgtgtgagctgcagatccaggtgagttggtggtttaccgtggctatg

SEQ ID NO: 627496 - DNA, 195 bp, Homo sapiens
  misc_feature (142)..(142): n is a, c, g, or t
  misc_feature (148)..(148): n is a, c, g, or t
atatgatacaatttccccataatattggaaactagacatttttaaagtatgcctttagcaaataggaataaaaaatgattgagtccagcagcagcccagtggcttatcaaggatgactttaaaaccacccattttctttggntatggntatgcaactgtttcttacacaaggatacaatgaaatattatattttg

SEQ ID NO: 627497 - DNA, 140 bp, Homo sapiens
gggagcacacagagagatggcagccacctacaagccaagaggagaagcctcacaatgaaccccccccccaccctgctggcaccttattcttcgacttccagcccccagactgtgagaaataaatttctgttggttcagcc

SEQ ID NO: 627498 - DNA, 153 bp, Homo sapiens
  misc_feature (91)..(91): n is a, c, g, or t
gatcgacacctaaagtcaggctctctggcagcgaacactttcacattacagtgcatgctgagacaagcagctgacagaatgctaccagcantcttaacagcttggtgcggatagtctgactagtttaaggagactggccgaagctctgcccaa

SEQ ID NO: 627499 - DNA, 1142 bp, Homo sapiens
gggtcgacccctcccccgttctcggcgtcgtcgaagataaagaatagttggcctggccgagcagcctagatgtgtctcccgacgccggattcggcgggctgcgtgggaccggcgggatcccggcacagccggacatggcggggctgtactcgctggagagtgaggcgtacttctccgaccagggcgggaggaagtacatggaggacgttactacaaatcgtagtggagcccgaaccgacaggctgaagaaaagccctcgccgcgcgcgagtcgctgtacctcagcccgtatgcctccgaaggcacgtcgccaggccgacctatcccggacggcgaagtactcggggcaaaggcccagacggaggcaagacacgagaggctacgcgaaccctctaccacggaccgccgcgagcactacacacggcacctaagcccgacagctgcccgccgaccgaaacctcgcgatggaccctactacacagaccggtgatgacgaacggggccaccggcaggagcgagaaaggcgcgcaccagaatggggcccacggagacgcaactatgctgcgaggttcaacatacaagacaagcagcaagaggtagtacaccaacgaacccgaccccgggcctacagggtctggcggactgcaccatccggccaacgggcttacctcggcttggacgcccttgcccctgcggcaaagacacgggcggacatggcccaacgaacatgaccgggttcaccctagcgacatcagggcaccaatggccacgagagggaccacaccagaccgcagcaaataacccaagcactacagcgcacggtacggagcacccacgccgcggccaaggccaacccacgaagacccggacccacagcaccgccagaaacagccgacgaaccagacaggcccaaacccaaacgcccccaggacgcgagacctcaggaactgcaggcaggagagcaagcgaggacacagaaggcggcccggcgcagcaacagcgcccaagacgcccgcccgcacccaccaaggccgcgcagcggggaacgcgagcaacgcggcaagagagcgcaacacgcgccgcccgacacaccggcaaagacacgcgcgcagccaccaccagagaccacaaggggcagccacc

SEQ ID NO: 627500 - DNA, 293 bp, Homo sapiens
atcgttatcggcatggcggtctgtactcggtgtgagtagtgtcactgtctaagggcccaggtgctagggtcacctccagagtgactgcagacatctgtgaagggaccctgcctgagcttgcctgtggtgtgtgtgtgtgtgtgtgtgtacagggtaccgcagggcttgcccgcgcttgcgcaactcactcctaggtgctcttagtgcaggggtggaggtgtctctgcactttacttcctgcgaggggctggcgcaccttggggtcaagtcttaagcttatatgctctccctat

SEQ ID NO: 627501 - DNA, 144 bp, Homo sapiens
ttagctgcggagttggtggaaagtaaggatgtggcgagaaactatgctgaggcaaaggatgtcttcctgggcatgttgtggtatgaatatgcaagacaggcatcctgagtgactcgtgtcggtgctgcgtgctggaggacttgc

SEQ ID NO: 627502 - DNA, 202 bp, Homo sapiens
  misc_feature (193)..(193): n is a, c, g, or t
ctcctcagcagacgcagctccaagatcacccaccgtatcactgggaatctgccagcctcctgcgatcagaagagaccaaggaaaatgagggtttcacagtcacagctgaaggaaaaggccaaggcaccttgtcggtggtgacaatgtaccatgctaaaggccaaagatcaacctcacctgtaataacattcgnacctcaagg

SEQ ID NO: 627503 - DNA, 300 bp, Homo sapiens
  misc_feature (28)..(28): n is a, c, g, or t
  misc_feature (55)..(55): n is a, c, g, or t
gcacttgaaatgtcctttgtcctaactnagaagtattggccaggagtggtggctnacacctgtaatcctagcagtttggaaggctgaggtgggaggatcacctgagcccaggagtttgagaccagcctgggcaatatagtgagaccctttctgtatttaaaaataaataggctgggcacggtggctcatgcctgtaatcccatctctcagggaggcagaggcgggaggatagcttgagcccaggagtttgagacctgccttgggcaacatagcaagactctgttctccacgaaaaggaag

SEQ ID NO: 627504 - DNA, 485 bp, Homo sapiens
accctcaaagaggtttaccgctccaagatggatggcgaggccaccaggcccccttccccggaccgcagggccctcccctcctcctctggtctcctcctcctcctcccagctcaggtggtacctgggggtagccctccccaaagaggcctatcacccagaagtggcacgggcagcttctcgggaagaacggaggcacatgcaggacatcgagacaagcgccaactagctctgcagcagaagggacaccaagtgatgaagagcagcggcggtgactggcgtgagctgaagcagaaagcggcagctgaggcacagtgccagtgggatgcccattcacggggcagcacccttcccagctgggcccctcgggcttcccccctctcatgcacccaatctatcctagaaccacatgcctgaggggccgggagcgtggggtggagggtgagcacgcctatgatacgctgagtctggagagctctgaccacatg

SEQ ID NO: 627505 - DNA, 625 bp, Homo sapiens
aggctgagcctgagcgcgctgttggccggagggaagccggaggagaccgggtcgatcctggtgcagagcggcagagggtcgaggagacctggtctagcaggcccagtggagtaccgaagtggtgcatgtggagcatgcggtcacgtgagtggacgcggcgccagagaaatgagacttgggtccctgtactgcagcctcaaggctcgcaggacccaagaactgggtaggggcccaagggccttccaaaaggccgtggccttttaacaacccacaattccaagggaggggacgagacccggtgaccaccaaggaggggacctgagagcctgaggcaaacggtgaggaccatgtgcgctctcagtcactgtcctttgcccgcggggggccacaatcaccgggatgaccatgctgtgtggcagagcgtggaggctcaaggggagaccgatgttccgggggcaggtgggaagttacccccgccgattaggccccgtggagattccgagggaagacccaggttttgcccttgggcctggaaggcctggtttgggcaggaaaggggcttggccatgagggcactctttgcagaggggcccttgattttccacggttgcgccaggccatggcg

SEQ ID NO: 627506 - DNA, 354 bp, Homo sapiens
  misc_feature (225)..(225): n is a, c, g, or t
  misc_feature (231)..(231): n is a, c, g, or t
gtcttgctagagccttggagtaccctgagacgtgtgaaccctgcacctctggtccaatcaagaaccttctggcttcatggtcgctcatgcctgtaatcccaatgctttggaaggctgaggcaggaggattgcttaagccaggagttcaagaccaggctagacaacaaaagggcccccccaactctataaaaaataagttaaatattagccatacacagtggtatncacctntagtctcagctactctgtaggaggtgggaggattgcttagtccaggattcaggctgcagtgagctatgattgtgtcactgcactccagcctaggcaacaaagcaagaccttaagacctcttct

SEQ ID NO: 627507 - DNA, 737 bp, Homo sapiens
  misc_feature (565)..(565): n is a, c, g, or t
  misc_feature (641)..(641): n is a, c, g, or t
gggggcgcagctgttagtcgcgggccgtctgctgttgatccgtcactcgccgaggttccttgggtcatggtgccagcctgactgtaaagaggacgctcccggcagacgaatgaggaaccaccttctactactgctcaagtacaggggcctggtacgtaaagggaagaaaagcaaaagacgaaaatggctaaattcgtgatccggccagccactgacgacgactgcagtgacatactgcggctgatcaaggagctggctaaatctgaatacgtggaagaccaagtaatcttaactgaaaaggatctgctagacgatggatttggagagcacctgttttaccactgactggttgcacaagcgccgaaagagcactggacttcggaaggacacagcattgttggcttagccatgtactatggtacctatgacccgcggattggcaagctattgtatcttgatgactacttcgagacgagtgattatagaggctatgacataggatcagaacttctgaggaatctaggcagcttgcaatgacgtgacgctgcagcagcgtgcacttatnggtagcagaatgtaatgatcatgcatcgactactattgatgaagaagtgcttatgatctgtacaatgatgatgatnggagactgatcaagatcgccaagagtactcgctttggcacttagaatgaagactgctgctgatgatgacacctacattctatttgagtttcccctt

SEQ ID NO: 627508 - DNA, 1077 bp, Homo sapiens
ggctgtcgccgcgcgagagccggagcaagacccatggcgcgagaggagtggaggaggatgaggaggagggtgggaggcaggtggcatgaggtggtaggaggtgtctgggaattgtgggggatctgatcgagctaattatagacacgagatcaccaatcatgtggtgaggtagtagaatacgtggttgtctggatacaaaggtaggccgtcggtaagtctggttcatggcagggtcgaggttgtctcaaggtaaatgcatgcttgaatgagagtaatgaagctcggataggtgaatagataagaatgcacttgactagtaaatgcagtgcttgggaaggtactgaatatagcacgaaacaaagatgggtttagcgtatgataaatcgcatggattagctggagcagtggcaccaaggagttcaaattttaatgggcgaatttgtaggggatatggtaataggtgaacgacagcggatcgatggctcatttggcaacatcatgtagtagatactgggtttatcgagacattcgaagatcacatcgtgttcagacgtaactttacagaggagccatagatagtgcatacacgaattttacaaggagattagtgtgagcgacagcgagagaatgttctcatattgattacttggattttggcgacttgaaactggagagccttgggaagggattcgaagccgatgttggataatgggccacatcggaagcaaggggacactggaagtaagtacgaacaaggaggatgggcgatagttgaacttggcagggccttatgtaaaagcaaacttcctattgttgacaattatgttgcgaaaaaaggaagtgaaatcgtttgaaatgtaggaagttcttgttatttttagagaacctggctgtggaaggaacttgagatttaggacttaggtgcaagaggctcaacccagaggtggtgaacatctggaattgaaatggttgtaacaaaaaagggaatagttccattgggtaagggttgggtcacaagtggagcaaattatgttggagacaagagacgcatttgatcgctgaatttacaagggaatg

SEQ ID NO: 627509 - DNA, 116 bp, Homo sapiens
gggtgcggtgtgcggtgtgtggcgtcgcgtcggtgagccccttggtgcggagaaacttggagatgaatgacacgggcggcggcgatctcgcctatcgtagcctggcagcaagatcg

SEQ ID NO: 627510 - DNA, 205 bp, Homo sapiens
  misc_feature (95)..(95): n is a, c, g, or t
gaaaaagaaaattacctgctggcacagttttagattgatagctttagattgaaactttcacatttttattttgaagattacagaggataaaagtnctggttaattgtgaatgttgatattttaaaataaagctgttaaaatcctcatttaaacctgcagtgaagtctaaatatacaccatttgatttgatttccctcatcttttg

SEQ ID NO: 627511 - DNA, 142 bp, Homo sapiens
acgactttctgcattattaatgtctcctctcccacctagcaaataacgaggggtccattgcaagatgtatgaactcagaatatggtaggccagagggatagaacaatgtgaaacacacacacacacacacacacacacacac

SEQ ID NO: 627512 - DNA, 155 bp, Homo sapiens
cattgcttgagctccattgaatgcaaagtctgttcaataagacttggattgagaatgaacaaacattgagagcagatcagatgttaccttcagaatcaaaacaaaagaggttgaagaaattcttggattcttagagtctacgttagactttttca

SEQ ID NO: 627513 - DNA, 507 bp, Homo sapiens
cccatgtacagttgaacagagtgatgatgatatgggggatcaccagcctttggcaaatgcacacgatgtgctagcccgctcccgcagtcgagccaacgtgctgaacaaggtagaatatgcacagcagcgctggaagcttcaagtccaagagcagcgaaagtctgtcttggaccggcatgtggtcctcagctaatggggaatggaatccaaggtgactagaaagaaacaggcagacaatgggaaagagcggacggggttgggcggggtttcatttaaatacctggtggattccaccaagggtggcgggaagattcaaaacgggaagcaaaaactggcttgatttttttttctggtaaccgtaataatagagacatttttaaaagcacacagctcaaagtcagccaataagtcttttcctataggtgacttttactattaaaattaattcggcctgtaaataatctggaagtcctttaccgggaacaagcactctcttttacaccacat

SEQ ID NO: 627514 - DNA, 1414 bp, Homo sapiens
  misc_feature (532)..(532): n is a, c, g, or t
  misc_feature (1102)..(1102): n is a, c, g, or t
  misc_feature (1107)..(1107): n is a, c, g, or t
aggtggataccccccctcgctcctctagatgtgttttcgcctcccgttggtggtggaacctcctgcccatttcctgccacacacgcgcgccgtgtggtttgttgttggacccccgcgtcccccgccggttatgagggtgacggacagccccctcctcccgggggggcggcgcgccccggagatgttgctcctcccttgggcctgcctctccttctcggcagaccttttcttttataggcccccctttatgggggccgcccccccccggcggggggcccctcggggtaggtgaccaacacagaaggtgtgtttccacacccaccagcacggggggggaaactccaccgcgcctaattgtgggagccccccccctttttattggcggcccccttaataatttataatgggggtggacacccccccgtatttagtgggagaacacccaaacggtgttggtggagacacccaacaaaatatgcaccaccggggccttggtgttataccccgggggtttccccgcggagattttttnccccccgggcgggagatattatctcgtctttcgaagaccccacaacacagggcgggtttctccgccccccatcacgcgcgctttccccgctttaaaaagtggagggcgcacacatttgatcacctcgtgggagattgtgttgaaaaaatggagattggacacttctctcagagaacggcgagggttgtcactcacacactcatagggggtgggactcttgtgggtggccctctgctctttggataaatttctctaaaggtgtgacacacccgcacccctctcgttgggattttgagagataaatatgcccccactaaccacttttatatttggccccgctgtgtgtgaggcgctttctctggagatctcccacgcgtacactttatctccccctcgaggagaccttctaaaaataagagataggggttgtctctaaatatgcacacactctaacttgagaagatagttctccgccacacaccacataaaggcccacatatctcagagactttgttccctctctctccacagtgtggccctgcgggtatatatatgagggtgtggagatanaaatngagaagcacatgcaccacagctacacacggcgttttctatacttaaactcttctgggttttgctatattaccacaatcctcatatttatacttttcaatagaccctctgttccctctagtgcctcttcataatatttcttctcgcctctctatattctttctataactgcagatatttttctcaccctctattgtgaccacacagaaatttgcgatagtataatattttcacagtaatattgattttggaaattcttgtccaccttatgtagtgagtttttcccaaaaataaattttttttccaata

SEQ ID NO: 627515 - DNA, 800 bp, Homo sapiens
  misc_feature (244)..(244): n is a, c, g, or t
  misc_feature (622)..(622): n is a, c, g, or t
  misc_feature (707)..(707): n is a, c, g, or t
  misc_feature (739)..(739): n is a, c, g, or t
  misc_feature (789)..(789): n is a, c, g, or t
aggctggtatcctataacaagtccagggacccctaaaagccgctttagcacgcttgcagacgactatcaaaaagcacaccctcttagagttgggatagataacgctatgtcatgcctttctgctgtcacacaagcacactaagagacaccaagatcagtgcacgttgaccaaacaatggcgatcgagcagagggagcaaccacaacgccgtttaggaggtggggtgcaacgattgtagccctangtctgtccttcatatagctcatccctacaaagttaactttcttaccgtaaaccactcacaggtcacgacaacaagagggattcaatacctcaagataccgcaagacgcacatgcggggttaacttctaagtaagcagactctctcacggtgagtaatgcctggtagagagagacttaaccaaccgaactgtacatatacggaaagagctcaaccccaaaaaataagctgagcgactggtaacaaacaataaactgggaattggggggcgcccggccggctctaccagtcaattatcgctttttcgaatttttgacgttttaaccatttggcctatttgccaaaaaagccttatagaaattaagtcaataaagttgacngtccttaaggcttaattccggtaaaacaaagggtacctataaaaagacacttactttgattccatttggggaaaaaaagagagtnttaaaaccttgctcccttcttttaaggagggntcttttgtgggatagaaaaatttaccattatttctcccacatttcccccnaatttttaaaa

SEQ ID NO: 627516 - DNA, 1359 bp, Homo sapiens
  misc_feature (848)..(848): n is a, c, g, or t
agcggggggcacgggggtgccaggggaggaggaggcggtgggcacgcttgggcgtgaaactattcctctccccccataagagcggagcgagcacggtgagcgtccttgaccagcctggaacagtaggttcaatcctagcaagagacgctgacgatgaagtagtagatcggctaagacaaacctctcgatgatcgcgcgaaaccatggcgactcaatccatcttcgttgacgcctatcttcgtgcggccatagcgcggcaaccggcacgcgcctgatcagtgcctgcgtgcgcgcgactcgctcaatggctgctagaggcggcagctgccttgtcagagcgcagcccgaagatccctgacccaacagagtacgacagctaccgagcgccggagcgatgatcccagctaggcgcgcggcccgcaggggcctggggacgagctctggcagacaagccctagacggtcgcccgcgagcccgggggaccgaaggcgggccccgacccccctggagcactgctattccttgcccgacagctcgtgcacagggccctcatccaacacgatgagatcgttacattttgcatgctccagtatggggcggctcccagggggtagcctccctgggagccattccgggttaggctgaccaccccataggtgccacgctcgcccttcgggcgctcggctcctcccttgaacatccggacgacaacatgaaactgtgtggaccgcgtcacgcaggaatggggccatcggttccccttccggccagtccttatgttagtcacgcagaaagaattctcctgggtacccaactcagaatgatcatcggagctgcacatacctgcncagacgcaacgtccatggcagaggagttttcagaaatcccccttgggcagcctccattgtctcttggctaacccgagagagacttcaataacagcaattgggcgagctctgcccaggtgccataactcctgtggaccacaccaaaagccttagaaacccttggggtcacacaagttccaactcccaggggcgccaaggaaaaggcaccacccgtgctggaccaaactcaggagaacagccactgcgctagcggggcgatagagacgtgcttgcccacggccaacctgcctcgaggggtgccctttacaccagcccgtaatcttgacgatgacccccctcgccgagaagagcttttagcgggaaccaatgcccaacgggaactgccgcccagccaccgacgaggcgcctgcaagatacgcgcacccgtcccacaagaggcacacaggcgcaaccccaggaccacgtggactccacccaacaaacgcagacacatcccaccaaacagacaacc

SEQ ID NO: 627517 - DNA, 1234 bp, Homo sapiens
caagacctcgctaacctcgccttaccccccactattaatcctactgggagaactctctgtgctagttaacaactacgttctccgtgatcaacaatatcactctcctacttacaggactcaacatacgtagctctacagccacatatacttccactctactatattctagctactaacactaactggggctcgactcaacccacccacaattcacatccataaaacgcctcattcactacgaagaaaactaccctcaatagtacattacacctaattcgcctcatattctcctcgctaatcccgtcaatgcacgacatgcgaattacctggggttggttctcgtctcgaatatacaatctatgccaccatgaccacaatcataaaaagcatgacttcggtgcagggacaggactgccgcagacaacacaatctttatccacgacgcatcccggagagtgggccacgcaggtggcaaaatactggagtgccacttgcactcttgtggttgccaatagcggtgggcacgcgtactggaagtggacccccgagtgggtacaaagacacaatgcactgggaaaaggcaagcaattctcaccctctcacaatcaataatagccacccctgcgggaagaagaatgaccagaaaaggaaattttcactcgataactcgcaggcgcgacacagattcggcacagcgcaagaactcacgaggcaccccaccacagcacgtcgggggcaccacacgataccctagggccacgagggaagcgtggccacacaagagccggacgaactcggatcggttcacacaaacggcaagaaatttacaatcggcacaccacatcaggggtgacgtgaactcacaaagcaacccccaacattcgggcccaagcgaaacggaaccacaaacaggccccaagcaacacagccaggggacatctagaacacggggacacactggcaaaggccattcaccgctgcgcacacaatccagcgagacccgagcaggcggacgaaccactactacaaacaccaccagggcgacagcaaagccaacagatccaacaaaagtgcgcagcgaacgacacgacaaacaagacgaggtgacaacaccgaatcagcacaacggagcacaaagacggcagcggaacacaggccccagcggagcgcacaaaaacaatgcaacacaaacagcaacgtacggaaagaaacaacatgtgcggccaaaccaaag

SEQ ID NO: 627518 - DNA, 216 bp, Homo sapiens
ttgggctgggtgggaagaggggtggccgcctccggttccgctggccatgctcctggtctctccgtcgtgaggtcacaggcaggggctgccctggacggggccccccaaaaaacgcctggaagggggcacagaggtggagggtggggcaggctgcacattcagcttagaagtggacctggctttggtggcaggagaagaataaacacttgcccagaa

SEQ ID NO: 627519 - DNA, 128 bp, Homo sapiens
tgcgatgagtattcttctgatctgtcggatgcaggtaatgtgtgcgcagaagactgtgtgggtaaggtcttgggatgtcagtacacttatgatgagtgaggtagttcgtgatgcaagatcatgctaga

SEQ ID NO: 627520 - DNA, 145 bp, Homo sapiens
caactccgagtctaccaattttcactctattatatgtcaaagcttggttagaatgtgaactcctatatagaagtcattcgctcaccaaacgaatatatagacttatataacctaattcctaaataaccaataacagataactgaa

SEQ ID NO: 627521 - DNA, 242 bp, Homo sapiens
ggtgactctaccggatcttcccacgaccatcaggacagacttggccgatagcgcgggcgctgggaactccactcggggtaactcctttccaagctgacctcagttttctcacaagaacccagcagctgatgttatattgtaattgtcttaattgctaagaacaagtaataagtaaatttttaaacagccatttaggtaacagccatttaggcaacagccatttaggtaacagccatatagga

SEQ ID NO: 627522 - DNA, 707 bp, Homo sapiens
  misc_feature (399)..(399): n is a, c, g, or t
  misc_feature (401)..(401): n is a, c, g, or t
  misc_feature (407)..(407): n is a, c, g, or t
  misc_feature (506)..(506): n is a, c, g, or t
tttttttttgggtaatttttttatttgggatagtgcttttttggttttggtttttggttctgctttaaggcctttttggctttgatttgaaataagttctttgacagagcatatggctgggttaatttaagttaaccttaaagttattgcatttaggattgtggtgaaatgtgtcttcgtgtgagttattgccaattcctgtgagggtgtggaaccaaattagcctttgtgattgaaaagggcaggtggatttcgtggaggctcatacttctcagggtgcgtgcatataatgtgcccttcaattcttcaatctcgaggacacttacacttgtggtgttgaggaaacactgtgcgagtgtggcgaacagacacattgtggccttctctgtgctctcgagngnctttanagagagggggtctcccactgtgaactctgtgcctcccttttagaaaacatttcaggagagttaacacctttgaggcaaaaacccttcaaagcttaaaanaccccattttttaagtgtgcgcatgtgagatgtttggtgcatgtgaactctttgtggatctaaagaattctcctctccagtggtacctttggtgcccctacggttttctcaaggggtattggggcgggtccatattagattgcccggtgcttgtgtccccagcttagcctcgtggttccccagcctttggggggggtctta

SEQ ID NO: 627523 - DNA, 257 bp, Homo sapiens
gtgctggggttggcattgcccgtcaacgaccggactttgtcatgctcagttcctggtatgactacgagatttggctacagcgtgtgggtggtggtgctcctggtccacttggcctcctaggagtcagagccctggagcaccagcccgagcaagagcagaagaggaagagcagagacccgtcactgctggggagtccctgtcagactcagtcccccatgagtctgaatttctcctcctcacagtttgcatgtctagcc

SEQ ID NO: 627524 - DNA, 246 bp, Homo sapiens
gtacatgtgtccacggaccactagaactctaccaagcacaccatgatctcgaaataggtcggtcaatcaatcggtctatcaactgaaacttcgcctcctatcaccttttctatcaagtggctttatcgaatcttcgttcacgaggtgatcgccttactaggtcaactatcaattattatcacttcaccctgaagttgtttgatcaggtacttactaccaactcgtcttattccttactattattaa

SEQ ID NO: 627525 - DNA, 367 bp, Homo sapiens
cggtctcggaactaggaatgaccccgccgtgccatgccatggaatgcaactggaatggaatagaatggaacagaatggaatcgaatccattcgagtggaatggaatggaggggaatggaatggaatcgaccgccgtgtactagaaaggaatggaatggaatggaatggaatggaatgcaatggaatggcatggcgttgaatcaaactgagtggaatgtaatgtaatcgaatgtaatggagtgcaatggaatggattagaatggaattgaatcaatcccagtgacatggagaggaatggaatgaattcgaatggaatggaatggaatggaatggaatggaaacaacacgaatggaatggaacggaatg

SEQ ID NO: 627526 - DNA, 239 bp, Homo sapiens
tatatttctctttatcttttgcctgtatatgaccttgccaaaatattatttcacaccccaggagttatatagtttttgctttaaagacaacagaagctgcaaatagaagaatgggaggagagtattcattttgcaaaagaatttcctcggatttgttttttaatgttgcttcattgctttgggaaatctgtgtcacttttcgtaaaaagtttttttctgcatagaaaacttaaaaaaaa

SEQ ID NO: 627527 - DNA, 334 bp, Homo sapiens
  misc_feature (126)..(126): n is a, c, g, or t
tgacagcctgagccatcaagctgtttgagttgcttcaaactgatagcacatataaactgggcagcgcataacacttgagattaaatcgcattcctagtattcataggcacagactagatccagttnaagcagctctctgtatggatttgtagcttcccgacagaaatatggttaaatatactttgtagttattgcaggttgtgagctgcacactgaagaaagatacagctgaaaaaggacggctcctctaaccatgtaaacaactatcaaccctgtgatcatccacgacagccttattacaatatcgtgccctcttgtgtaataccacaaaatt

SEQ ID NO: 627528 - DNA, 531 bp, Homo sapiens
tgacgactatacacagtgagccttataaactaccacctcgttgtagaattagtactcaaagtgactgtgcaatctagcatttagcctgataattcagtttggtgaaaactatagagtgaacttcaattctgaattttatcttgtcagtcgaaggtactatttgcgtagcctgcacagattaaatggccataacatcgtgcttttagccatggtgccttttcatcttttcatttccattctgcaattggatgtgcaaggggttttacagcatgtgttggcacaactggcagagtgttgtaaactcaattcgaagctgacaactaacacagtcactgcacttcaacgattttgatatttgcagaaaggcacagcacctttttgtagtcactgtttggaatgtaagggtcatctcctgcactttacaacactctttgtcagctttgggaagcatctctggtaggcatggttctggctaggccttttcaacagcactaaagctggacataggtggttctccggccggagaaatct

SEQ ID NO: 627529 - DNA, 342 bp, Homo sapiens
ggggaaaaaaaaaaaaaaggggttccctgcccagcccaagtttgcagatcatttttgaggagccctgttttggggcccccggtctttttgaaaaccccaacaaaaatgaaaccccccgggatttcttgttttttcccatttgagtttcccttccaaaaaacttgtttttcagcaaaaatggggccctagtaaggacatttttagcctttttttagccctccttttttgggggccaaaaaaaatcgttccaaagcttaggtttaagcgggatatgaaaaatttatgcgcctccccaactttaaaggaggggcccctttgttcccaaattaaatgggtttgata

SEQ ID NO: 627530 - DNA, 257 bp, Homo sapiens
agccggacgtattaggtgagctaaaagtgtcattgtaaaaatagtcttttttcagagacaggtcttgctcctgttgcccaggctagaagttcaatagcacaatcacagctcactgtggcgctcaacctcccaggttcaagggatcctcctgcctctacctccagagtagctaggactataggcacacgccaccatgcctggctaatttaaaattttttgtacaaacagggtctcaccacgttgcccaggctggtctc

SEQ ID NO: 627531 - DNA, 1001 bp, Homo sapiens
gtctctccttttgtttctttcgtttgttggtatattctgttgttgtgccctttgttggttctggacattcgggccgcttttttggttttctcggcttctcgtacgtgtgtattccgttctatttcgttcctgttgggggttttcgtgatcctcctttggttgtcaggccttcctattaggttggttgtcacgctcggggcctcgggttttcccggctagggtctatgctgacttcctgcaagttggcagtctacatggtcccctttcccacgtctccattttctttatgcctggctttgcccgtctcgccatgccgtggaagtccagcagtatcgagcgtctcacagtgccggaactcactccagcaggtcttcgatgcctagtacatgatggctgcctgtgaccccctgccatcggccgattcctcaccgtggctgctgtcttccgtggtcggatgtccatgaaggtaggtcgatgagcagatgcttaacgtgcagtactagtactagcagtctacggttgtgagaaatggatccccgacaatgtcaagtcagccgtctgtgacatcccacctcgtggcctcaagatggcagtcaccttcattggcaatagcacagccatccaggagctcttcaaagcgcatctcggagcagttcactgccatgttccgccggaaggccttcctccactggtacacaggcgagggcatggacgagatggagttcaccgaggctgagtagctaacatgaacgacctcgtctctgagtatctagcagtaccaggtatgccaccgcagatagaggaggaggatttcggtgaggaggccgaagaggaaggcactaaaggacagagccacccatcaaccatcaggcttactcagttcccttagaccgtcattaactacaaacatgcgcaccactgacgctcgtccactcaagaagaagtagtaagacgacctaatatgacttgtttgtagccgttaacttcaggggggggggtcc

SEQ ID NO: 627532 - DNA, 161 bp, Homo sapiens
gggacaggtatagccttacggttagcgctcgtgctaggcttctatggcttgttgggtgatcaggaaaaacttgaagatcgagctgagtggaatgtgtgctaaaagaagcgcttttagaaattcataagttgcacgtggctcacgtcgcgtaagccctgaat

SEQ ID NO: 627533 - DNA, 423 bp, Homo sapiens
taagaggggagtaaagtcggagtccgagataactgataaggtctacgtaaacactcacaaggtcgcacagagtggacaaggacacaaagaggagcatccgtgggatcgactacacatgacccttccattaatcactctgctgtatacaggacctgggcgtgctgacaccctcagcagtcagcgatgagctcatcaagctctatctgtaacctgtgagccctcccctgccaaggtgcagcttacgtagttgaggcagggtgagtagctgcttgacaccccagtgagtcaggccaaaactgagatgtgtcaaatgaagatttatggagtaaggacttaaaatcatacatcttggaagaacctttcttactccatttcagtcccatctaaaaatgtgtcagctattctaaatcccaacttaaattg

SEQ ID NO: 627534 - DNA, 255 bp, Homo sapiens
cttttggggtctttgctcttttttggcctccccatgttgtccaggctggcctgaaacccctgggctcaagtgagactcttgccttggcctctcaagtgctggggatacaggcatgagccattgtgcctggccccttttctctttttttttttttgagagccaagggctcactagtgggcccagaatgtttttgactttgggggctaaagcatttttcctgcctcagcctccaaaacggtggggattacagacatg

SEQ ID NO: 627535 - DNA, 335 bp, Homo sapiens
aggctgctgaggtggataagaggctggcagtccgagagctagcatccgccactctcactcatgtgcaaggctgcagcgctgaggacggtatgggtctgcaacatggccttgagcgcctctatgagatgatcctcaagaggaagaaggcagctcggggaggcatgaaaagactgtgaccggagcccccactacctttcctcccacctagataagggtatgcacacttggacagccgggtgggaccagtctgtgacctctcagtcagactggggtgcaggacctgttcacctcaatgaaggagaaaggagcatggagtgtccagttttggagacaca

SEQ ID NO: 627536 - DNA, 349 bp, Homo sapiens
ttcaaaacaaatgaataataaagacatgagaaaaggtttccttttaaaaagtcgtggttctcgccaggcgcagtggctcatgcctgtaatcccagcaccttaggaggccaaggcaggcggatcatgaggtcaagagatagagaccatcctggccaacatggtgaaaccctgtctctactaaaaatgcaagaattagctgggcatggtggcgcatgcctgtagttccagctactcgggaggctgaggcaggatttaaatactgtatgaacccaggagtcgagtgtgcatgagccgagattgcaccactgtactgcagcctgacaacagagtgagactctgtcaaaaaaaa

SEQ ID NO: 627537 - DNA, 408 bp, Homo sapiens
ggacgcgtgggttacagaccagcctgccctgcctaacccctgctcgcctgtaaacatgccagccaggtgggggtgtttacagaccagcctgccctgcctaacccctgctcgccatgcctcagtggccaccagcccccagactggacccaccccactgccctgggggagaccccgaaccgttaatccctggatgctgttccccccagagacactccccctagaggctcgcaggcggttagtccccctcccaccgtcagcgaatcacccacaggaccgagacggcctcgtgcaagcccaaggccaagccagtcgcaacattgtgctaccaggtcaccctagatgtgcagacgacgaagacggttgctagtgcaatacgcgactctagcgcccagtagagacgcaaaactg

SEQ ID NO: 627538 - DNA, 292 bp, Homo sapiens
aaggacccaaagagcaagaaggagaagaagaaatccggagaagagaaaagaaagacaaagaagaaaaagaaaggaaggagaaagcaaaaaaggcctcgagaccaaagatgctgagtcaccggcccagaagaaacagaagaaaaagaagacgacagcagagcagacggtatgacgagcaccagcaccaggcacagggatttcgtagccgagcagtgggcatccccatgcctttgacctccaccgagctctggccaccaggggtaggaactaaactgttaccttccctcgctcc

SEQ ID NO: 627539 - DNA, 151 bp, Homo sapiens
tccagtacccgagcatgcttgcctgcctgccggacgacgtgtattcaccactgccctgcatgcctccctgagcaagattcttacgctcgtgagagcagagctgacctccaaatatcggtaagctggaacctggtagacgcgtatacaccac

SEQ ID NO: 627540 - DNA, 393 bp, Homo sapiens
ggtagatggcaaatggaaacctactctggaagcaacattcattctaattcttttcctgaaaaaaaaaaaaaaaaaccaccaaaaaaatgttggcctttgaaagtttttaacacttaattcttctcccagaaagttggacgtttgaaattccattagtgttggggtttccccaccaaacaccacagggagttgagaagggcctaggaaagggaagaaactcccagccaagcaggggcacaagggaagagcatttgggccaggcgagtgactttccctcattggttggccgtgatatatagaagaacactctatctggggaggagaacctccgggaggtttaaacattaccaacaaaaataaaaaaaaacaaacaaacaacaaaaaccaaccttt

SEQ ID NO: 627541 - DNA, 877 bp, Homo sapiens
catgttataaatcgtcccttacagatttcagatatggtgttggaagattgccgggaagttgatcgcattttggaacgatggcatagattttgatgaatcttggttgcagcctatattatgataataggtttcaaatattgatatcatcgatttcagtactcaaagtccaaagtggagtgatagtacatatttggttctcaatgaggatgtcggacacggatctggaaaatatacatgattattatatctggcgtgactgtacccatgaaatatggaaatgaacattcgacgcaataaactggttaagtgtgtgtggaaaatgcatttggaagcattatgacgaaagtagcagagaatccaatgttatttgacatcagttttatgaaagagcgaacacggatttagatttccgtgatcgtgatgttcacagaatgaaattgtaagaaattttaccgggtctgggtcacaaagggtgtggagtggtatttagtttggatgagtgttaaatggctggctataagcagagcttgtgatagatgagatccgggtaattgagacccaaatacgcgtaacggtgacctcaattctcggaggctgtaccatgattcatcaccaggcaggtgtgcagattgcacgaacatttgtccggcagctttccggccgaccatggacccaatacaagaacggagccccggagatacaggttcatggtggactgaaatctattcttagagttttgccggacgtggagtactaagggttgccttattccaaaagtgattccttaaaataccttcagtgtaaactgttgtggacacactttagagttccctggggaaatccaagaatggatgttttgcacaaacgtcgcaattag

SEQ ID NO: 627542 - DNA, 550 bp, Homo sapiens
ggaaggcctggccatgacggtctggaacctaggcgagaccacaatcgtgctatacgctgacgccaacgatccgtacagtagagctggctagctctacagtaccgtggacatactccaacaggtacgacagcaccttcacactctgctcattctgtaccaagcccttgccgaccaagtttctcctgctgacttcctcgacagacttttttttgtagacagcctgtaagacttaactagcccagtgaaagcagccttggatatgcttaagactaatgacgacagtactgttgcatacatgtactagagaccaagcaggacaatcctgatatagccgaagtgctactagatgacctagcgaatgaactccatatgatgttgagacagtagctaacattgaccaatggcctcatactattatgagtcaggcacggctgtacagtccaatttgttatgaccaacagagcgagtgttaacaaacgtactcccaggctatcggtgaataccccccagttagcttatttacaacatttgtttgggatgttcccgggtt

SEQ ID NO: 627543 - DNA, 126 bp, Homo sapiens
atggccctggcgctgtatggccagcctcaacgctgtcccgcagcagacgcgcttcggcgtgttccgcgatgtaaccctgtgccatgacctgagcctgttgccatgttcaccaaagtcctgatcggt

SEQ ID NO: 627544 - DNA, 176 bp, Homo sapiens
gaatctcgacgaggttggtgcactacacacccagctaagtgttttgatttcgtggtggagatgaggtctcagtaggttcccaggctagtgtggaactcctgagctcaagaaatcctccggcctgagtctctgaaggtgctgggattacaggcgtgagccaccacacgtggcctatg

SEQ ID NO: 627545 - DNA, 248 bp, Homo sapiens
  misc_feature (25)..(25): n is a, c, g, or t
acggggctacagagctgtcccccgncccccagctgggcgactacgcggacagtggtgtggcctctctctctcctgatatgctaggttgtcgctcctgagggtgccacggggctgacaggctgtcccccgcccccagctgggcgactacgcggacagtgatgtggcctctctctcctgatatgctaggttgttgctcctgagggtgccacaggggctgccaggctgtcccccagcccccaggctgggcg

SEQ ID NO: 627546 - DNA, 362 bp, Homo sapiens
  misc_feature (13)..(13): n is a, c, g, or t
  misc_feature (24)..(24): n is a, c, g, or t
  misc_feature (28)..(28): n is a, c, g, or t
  misc_feature (48)..(50): n is a, c, g, or t
  misc_feature (70)..(70): n is a, c, g, or t
  misc_feature (79)..(79): n is a, c, g, or t
  misc_feature (83)..(83): n is a, c, g, or t
  misc_feature (85)..(85): n is a, c, g, or t
  misc_feature (90)..(90): n is a, c, g, or t
  misc_feature (96)..(96): n is a, c, g, or t
  misc_feature (101)..(102): n is a, c, g, or t
  misc_feature (135)..(135): n is a, c, g, or t
  misc_feature (145)..(145): n is a, c, g, or t
  misc_feature (161)..(161): n is a, c, g, or t
  misc_feature (178)..(178): n is a, c, g, or t
  misc_feature (180)..(181): n is a, c, g, or t
  misc_feature (235)..(236): n is a, c, g, or t
  misc_feature (259)..(259): n is a, c, g, or t
ttgtgggaatggnaaaggaagganacanccaaactctgacaaaggctnnnccttatagaataacccaaancctaggtgngggntnatatntaatgncccannaaaaaatatatgtggtttgggggaaaggacaanaaaaaactanaattccacatataagnaggtagttgcccatttncnntttccagttatgtgtgtaaaacagaaaaattaagtaccaaacctattaggaaanntttttaaaaagtggatttaactnaaattactgtgtacttgaggttggctttggatatggattttctaaaaagtgatgttttattgtttatcatctaatggctgtaaactgtagtactagaattaaa

SEQ ID NO: 627547 - DNA, 236 bp, Homo sapiens
aaaaaacgtaaatagaatgttagctgtggattctattaaagacaactttttcttcagtgtcttgtcttctctaattatttggtgacttttactcatgtaagtttttgcagatgggggaaaagagtgaagatgtgaaataaaacactgtccaaaaaatcttagtattcagaaagaccagaaagtacagggactcctttcccctgtatttcttggttgtttcttcccccaagctgtca

SEQ ID NO: 627548 - DNA, 323 bp, Homo sapiens
  misc_feature (23)..(23): n is a, c, g, or t
  misc_feature (136)..(136): n is a, c, g, or t
ggcacgagcgccccagtggatgnagccccactggcacacgccctgggaagcagagcccagcaggatttcagcctctcagccagacccccttgtgcagtgcacgacctgcccaaccctacatggtagccctcaatgnatgaaggaatctgcagtgctgcatgcatgtgccacttctggaagggatgtgtctctgtgtgggggaaaaaggcatccatgctgtacaggtcacagtgctcagagacctgagttcaaagcccagccccactctttgggcaccttgggtctcaggcaaatgatgtgacctctcggaaccccagcgtcct

SEQ ID NO: 627549 - DNA, 310 bp, Homo sapiens
agttcgcacatacatcgtgttatatcatagcagtagatataagcaagaaatcccactcatcgaccccgggtaaaacgtaatggtaagcatgcacagatagcagtctacagttggttgctgtagcacaaaataggtgtacctttataagtacattcaattttctgatctacatttatcatgtaatttatacaaaaaatccatctatctcggatatgttgatccaacgtctgctttcgctattattattgcttaaatactcctatcatttactgaattacttggtatttagaactcctagcaccacacgacg

SEQ ID NO: 627550 - DNA, 257 bp, Homo sapiens
  misc_feature (13)..(13): n is a, c, g, or t
tactctagagcanccccaaaaataaaacccgcgcctcgaaaggcgcgggcaggtcgagcttagcctgggttgcgtatttcgccagacgggcatcgcttttcagtacagcaatggtgttgttgtgcacgtcgtcagcggtcacgtcagccttgctgaagatctgctggaagtgctcgtgggtcacggccgcgaagtgatcgcgatcttccggcgcaacacccagtaccaccgcgtaggtggtcagcgcttcgccgttg

SEQ ID NO: 627551 - DNA, 119 bp, Homo sapiens
gagcccgtccctgagatgtctggtaactgattgctgacaacagattctctggctcatatttcttttctttctcatcttgatgatgatcgtcatcatcaagaatttaatgattagaatag

SEQ ID NO: 627552 - DNA, 140 bp, Homo sapiens
caaccatcacttctcgaagtggagccgagttacatcatcaagaatgtcaaggctaagttccaagataacgaaggtatcctcctgatcagcagaggttgatctttgctgggatatagctggaagattgacgcactcttatg

SEQ ID NO: 627553 - DNA, 845 bp, Homo sapiens
gccaaaggtaagttgctattttcatcagagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtttatgagagagagagtgtgtgttagtagtgtcatcaaggtcagaacaggtttcattagttatcagtatcatactagttctctgttaatatactttatgaaatggagtcttgctctatgtcagcccaggctggagtgcacgtggcggcaatctcagctcactgcaacctccgctcccaggttcaagcagtatctcctgcctcagcctcctgagtagctggcgatgacaggcacccgcacaccaaacccagctaatttttcgtacttattagacagacgaccgaggtttcgccatgttggccagagactggtctcgaaactcctgacctcaggtgatcaacccgcactcggcttccaaagctgctggcaataacagcgcgtagagccaccgagctggccagaataaggtataagctttacacacttgattcaagtagaataatggcaaccaagtttgaacagataaatacttggacagactaatcgccaatgaatgctcagagagtctggccaatatccaaccactgtgtactaagacgcaattaaacaagatcactctaccggaaagaaacatacatcgacttaaaaccacactcacaaacaccagcacaacaacgtgccaaaacaaccaagcaacgaacgaaatgaacac

SEQ ID NO: 627554 - DNA, 107 bp, Homo sapiens
aatgatctacctaccttggcctccaaaatgctggaatacaagcgtaggaccgcgctctgccctgaattcaatgtttaatacctcactttagttattagattgcaagg

SEQ ID NO: 627555 - DNA, 929 bp, Homo sapiens
tttttcccttcacagtggcgaacacacttcatatctaaatcaccttcctgaggttgtagatgccgtgatttgatcttgtctttggaaatggccaacaagaaggagatgctaaaaattaagcacagaacagctctatcgaagaatattgcttgcacaccctagaggacactcatacccctggaggctcgaattatcagccttgtcctgtcgagcatccgcagtcctcgaagaacacttcgtacaaccatcgctaaggacaaagacccacccaccgctctctgcttattgaccgtctgcctcatagtgaataacttgcttaacatctcttccctatctatctgcttactgctggtcctgcccccacgcattcgatcgccggctctccaacccgagccactccccctctaccccctgatttatcctaaatcagctcccccgtctttccaaccctcccaccagatgccttcgtccacgttcgcgaccacacagcaacacgtctaatagccccatacaatcgcctctattacgccctaccgtctctctctcctaccttctactctttcactcctcacggcctcgctctttcccctccttgtgatcctcccccccacctctccctctaacaccactcatctcaccctcgatccctcctcctccgcaccacccaaacgtcgtaccattccagcccacgtccacacgtcccctcccaccaagcacgtgctagcacccaacacaagtccctgagcagttacttaacaccgcgcccttccgaacgtctacgatctgcacatgccacactcacgcacgcgttcgttgcttcgctctgtctaacgccgagccgtaaccaccccagccgctcacaccctccgcttccgtttcgcacagctcctttccgtgtcgacccctcccgactatctacccacacgtcc

SEQ ID NO: 627556 - DNA, 961 bp, Homo sapiens
ttcaggcgcggcgccaagtgggtcgccgtgatggtgcgctgaacaaacgcgggacaaccaaactgtggtgtcctaacacagcggggggtaaataccggctctaccgaagaagggggcgcaacataacacagggggaaaaaaactgtgttaattggcccaatcagggaaatcttgggaacctccgccccagatgtcgcgcccccaaaaggggggaaaccccccccttgggaaggcgcgctccgcgctccccgttgtggccaccgacaaatccgggaaaccaatttcgtgaccgcgtccgcctcttcttttcaattatttggactcgctgtcttgtccttcttgatcacaacaatggctgtcccccgcgtggtgtttcccccctggatccgtgccccaaggtgtcgcacaccccatgggggtggttcccaccgagccatctggagtcggagccgtcgtcccccaattgtctcccccggatattgcccctttggcgcgccgcatgcaatttcctcctccgcctgttgaggggggttctccaccctcatcttggccacgaagggccccgcggttctcctccctccggggcgcatgcccccgcacaagcagcctttctgcgaacacagtggccccagatgagccgcggtcgcatcatcacactccgttactcctccacaacttttcattctcccccacgaagcttatttgacaaattattcttctggtcattcctcactacttccttagagtaattgtgtacatcacaatttccataatctcacccccagtgggctcttactgacttgtcatattcccacacccccccattatttctctgctttatcatcacctctccccctttaacgaagaaaagatccccccccccaatattagcatgaaccggcgcgacgagaaccacccaaaaattcgccaaaatttaaaaacacccacgcaaacaataaca

SEQ ID NO: 627557 - DNA, 297 bp, Homo sapiens
  misc_feature (54)..(54): n is a, c, g, or t
  misc_feature (130)..(130): n is a, c, g, or t
  misc_feature (188)..(188): n is a, c, g, or t
  misc_feature (191)..(191): n is a, c, g, or t
  misc_feature (228)..(228): n is a, c, g, or t
  misc_feature (263)..(263): n is a, c, g, or t
  misc_feature (265)..(265): n is a, c, g, or t
  misc_feature (276)..(276): n is a, c, g, or t
gactaataagaagacgaccttctttggtgggaattctatctctatgattgattncctcatctggccctggtttgaacggctgcaagcaatgaagttaaatgagtgtgtagaccacactccaaaactgaanctgtggatggcagccatgaagggagatcccccagtctcagccctgcttactagtgagnaanactggcaaggtttcctagagctctacttacagaacancctgaggcctgtgactatgggctctgaaaggggcngnagtcagcaatnaagctatgtctgatattttcc

SEQ ID NO: 627558 - DNA, 601 bp, Homo sapiens
  misc_feature (3)..(3): n is a, c, g, or t
  misc_feature (67)..(67): n is a, c, g, or t
  misc_feature (81)..(81): n is a, c, g, or t
  misc_feature (86)..(86): n is a, c, g, or t
  misc_feature (93)..(94): n is a, c, g, or t
  misc_feature (103)..(103): n is a, c, g, or t
  misc_feature (108)..(109): n is a, c, g, or t
  misc_feature (119)..(119): n is a, c, g, or t
  misc_feature (125)..(126): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (139)..(139): n is a, c, g, or t
  misc_feature (148)..(148): n is a, c, g, or t
  misc_feature (165)..(166): n is a, c, g, or t
  misc_feature (171)..(171): n is a, c, g, or t
  misc_feature (174)..(174): n is a, c, g, or t
  misc_feature (198)..(199): n is a, c, g, or t
  misc_feature (228)..(228): n is a, c, g, or t
  misc_feature (287)..(287): n is a, c, g, or t
  misc_feature (302)..(302): n is a, c, g, or t
  misc_feature (376)..(377): n is a, c, g, or t
  misc_feature (430)..(430): n is a, c, g, or t
  misc_feature (466)..(467): n is a, c, g, or t
  misc_feature (487)..(488): n is a, c, g, or t
  misc_feature (493)..(493): n is a, c, g, or t
  misc_feature (497)..(497): n is a, c, g, or t
  misc_feature (596)..(596): n is a, c, g, or t
tancggggtgctgtccttcctggtctcggccttcttcttggtggtcgacgcgtatttcccccagaanagcaaacgccaatnaccgnataatanntggtcattngtaanntgcacaacanaaaacnnagaaantnacnantggtttgtnggtttctgcttcctcannaatcnaangggcagtcaccaacccgaaggatnntgctggtgggggccgactctgtgagggcngccatcaccttcagcttcttttccatcttctcctggggtgtgctggcctccctggcctnccagcgctacaaggntggcgtggacgacttcatccagaattacgttgaccccactccggaccccaacactgcctacgcctcctacccanntgcatctgtggacaactaccaacagccacccttcacccagaacgcggagaccnccgagggctaccagccgccccctgtgtactgagcgnnggttagcgtggggaaggggnncaganaggnccctcccctctgctctgggactttcccatgagtctcctggaactgccagcccctctctttcacctgttccatcctgtgcagctgacacacagctaaggngcctc

SEQ ID NO: 627559 - DNA, 170 bp, Homo sapiens
  misc_feature (157)..(157): n is a, c, g, or t
  misc_feature (169)..(169): n is a, c, g, or t
gtaatgatctggtaaaattctcttcatctaggcttggaattaactcatttattcgttaactggaatagctaagcccagtaacagtgcatacactgataggtatcccagagactcacattccccaacatctaacaaactaaaaagagaaaaggcgaangttaagaggtant

SEQ ID NO: 627560 - DNA, 720 bp, Homo sapiens
tatttcaatggtagaaaggccttcaaggtgggtattatattttaaacttttacattattggtattaatggtagtaatatattggtatgttttctaaattatttttctttaagctggacgtgggtttttttctggtgggtccccagaggggtctacgggacttgggtggacatatgttgggaggtactccgggtcgctcagctgggtggtctggttcaatcagcaagataagtctctccaaagcaaattcacatggattatgagtcgctttggagcttctggacatggtcacttggcccggagggttaaaacttttcaaccccttgaagaccttacatggttttatgggattggtgaggaagggaatggtctccagggtctcagggctattgggaaattccaactcctattacttaccaggagccatgggagagaccagatctggatgttaaacgtctctggtctggcagagatgggacaaatcaggtatacttggtgatatagtcatgggggttcagtggcactattttctccttaaaggtccaggcaacgggaccatgatagagaggaggagggaagaacgaggccttctctatgaaccttgtggcttctggtctaacaagtttcttttacagattctcacttctggtagcctaagcaggggttactccagaatcttaataatggcctattcttatctttgttcccaggactcattttt

SEQ ID NO: 627561 - DNA, 1185 bp, Homo sapiens
gacgacacatactgtctgactaccaacgacgttacctttgactacgacgtaacactacactacggacgcttacaaccccccttactttctacggacctactgacgaactcgaaccccactccctgacgaactccaaacacttctccgatgccatctattcacaaccccaatcctaccacgtactggtcacgctacaactacagctactcgggcccactaccccgacaaatgatcggtatatacccctatcccgatacctaacttaactcccctgagcccaagcccgtcatctacatcataaccactctttgcacaggcaacactcatcacagacgctaagctcgcactgatatatcatacctgagtcaggcctagcaaatcaaccatgctacgcttcaactaccagtatctaaccaacaaaaataaaccctcgattccacagcacagctgccatcaagctaattcctcaccgcaagaaaaccgcatccataatccttctacatagactatcactcttcaaacaaatatactctccgtgaccaatgaaccatacaacaatcataacaatcaatactcatcattaataatcataatggctcatagcaactaaaactaggcctagcccctttcactatctgagtccagaggttacccaaggcaccctctgacatcccggactgcatgcatcgttacattgaacaaacaataagacgcaatctaacatccatatcccaaatctctccactcactacacgtaaggcttactcctcaaacacatccaacttatcacaactacaacgccgcgccgggtacaccacaccagtaacgacacttagaaataaccataagaaacccccactcgacagctattaccgccagctacccctagaaccccatagataacgatgtgtaataaaaaactatattatcccaacataacacgactctgcatacaccaaaacgcagccaggacagacaaatcgccgtacaccgactggcacacaaaacaacagcaaacaagaggccaggggtataacgacacacaaaaaaaagcaacacacaaccacaagagacacatccaaacacaggcggcgcacgcttccgaacgagcagcagcacactacccacgaccaagacacacacacacaaccaaccaagacccacgcaagccacgcaccgacacca

SEQ ID NO: 627562 - DNA, 278 bp, Homo sapiens
gtggttctctattatcgaccatttgcaggcaacttgggatttgctatgtaaaagcaccttatctaccctgcctcattaattctcatggcatcccttaaagagacagatcagaaaaccaagggtgagagcctcatccgaggtctcgcatctgggaggggacgggaccagaagataagactgtccagtggactccaaaccctagatcttcacattcatcagcccccagctccccctgacagagaaaggatatgcgtattagctttccaaactcctattgt

SEQ ID NO: 627563 - DNA, 117 bp, Homo sapiens
tccaggctggcgggtctgtggaagcggcgacaagctgacaccgacgccgaagcgctggcgcgcggttgggaaacccacctgaccatcgtcagcgaagcgctgtcgccgccgagcctg

SEQ ID NO: 627564 - DNA, 1234 bp, Homo sapiens
ggaatcttatgatatataccatttaaccatgtcacttctaagaattggagtgtatcactcaaaagtcatatcttccctaatatgcctagaagcgcaatacctcactatcgctgtgcattgactagtgtactctgcataactcctgaacaccggactccctcttagccaatattgtgccttattgccatactagtcttagccgcctgcgagcgcacgcggagtgggccgtagccctactagtctcaatctccaacaggatagtggacctagacgtgacgtacagtaacctaaatctactagtctcaatctccaacacatatggtctagactacgtacataacctatacctactaccaatgctaagaactaatcgtcccaacaattatatccactaccactgacatgactttccacaaaaaccgcataatcttgaatcaacacaagcacccacaggctaatctcattagcatcatccctctactattcttttaaccaaatcaacaacaacctatttagctgttcgcccaaccttttcctccgaccgcctaacaaccccctcctaatactaactactgactcctaccctcacaatcatggcaagccaacgtccacttatccagtgaaacaagtatcaactaacaaacaactctagctcctctatactaatctcgctacaaatctccttattataaccattcaccacgtcacagaactaactccatattccatcactcttctccgaaaccacacttatccccaccttggctatccatcaccccgactgaaggcaacccacgccaagaaacagccctggaacgcagggcacatactttcctaattaatacacccctaatcaaggctcgcttacccactaaatcatcgaaccatgattatacacttacagaacacccataggttcaactaaacaaattcctacatacctacaacttcatccgcctgcccccaaaggacattattacaaaccttcttgtactacaacgcacctactattaattgaattaagcttaacaccaaatcagttataaaatacgtaccagactacccccttaacggcacaccacactatagtaaaactcccctaaaaccccttgtataaacccccaactgatgaggctaaacgatacatgccccacaaaacttataaccaacgcggccgctatcgtcaaatatcacacacaacacatattttacaacccataaaaaaccaaacttc

SEQ ID NO: 627565 - DNA, 202 bp, Homo sapiens
gtcgttggttacttcagtgcccagacctggtcagctcgcgcacggcttgatgacggaaacccttgtaggcgccggcttcagccaggacaacggtgaactcggtctgctcttcagcagcggcggcagcgccaccagcggagggagcagcgacagcgacagcggcggaagcaagccgaaacgccgaacttctcttccatttccg

SEQ ID NO: 627566 - DNA, 295 bp, Homo sapiens
cgaggatctgtgggcaggagttcgagaccagcctgacacagtgagactacatctctacaaaaaaaaaaaaaacaagttaaaaaaaaaaaaaagggggaaaaaaattgtttggcccccctacggcaaacttaaattgcacacggccaacattttccctgtagaaaagggattaagagaaagggcttggccaagtttccagctttgggagcagaactcccccttgtgcttcaatttttgtgtccccaggaaggcttaacggatttctccaaagcggaaccccttaacagaacaactt

SEQ ID NO: 627567 - DNA, 1414 bp, Homo sapiens
ggcaccgctgcagcgagacagactggcggtctccacagcgaatcaacagttcctcgctaattctccgcttttgttgcgaagaactctgaacgaaggcacaacaacatgcgcagtacggcgacggctacagtttagcgtggcggccttgcaacgactgactgaacgatactgacactttacaaggtggcacaggcactgactcactcgggccaccaaggcacaaatctatgacacacagcaactatactagccctgacaactagaatgctggcacctacaatacccagaagctcctccgtccagctcagcattcgtaacaaaacattcactatgcacacggaactaccataattccacgctggcgcactggctgcgactgccccggagcattaaccacggtgttacgcacacacactggccacacactctcactactacgccactctacacacgttgtactttcacagcagctacagaccgctctacatggcatgtccaacgacgcacacactactgacacgccttccagcagcccaccaagaagggacaaatcattacaaccaactttaaactctccacgtggattctcaacactttgctctttcacacgtcaaggcaaccctttctactcaactgtcacaactggctcttgtgaactttcacacttatttcacccaagtggccaacacacttaccaccacttcacaagcctcaaaacggaaatcttcccagcgcttgggtaaaccaccattgcacccctgggcaccctttggggtacacgccacctacttactttctaacatcacttagtgtgttacaaccacccactcattgcttccacaggggtaacccaggggacgcgtgaaaacacactgtccaccccacaaagttcatgattgtctgtatacttccttggcaacagggggtcaccttggttctaatttaagacatcattgaaacaccctggcgcacgctcaccctcgcaacacatcacaatctccacagggctcttaacccccgcaagtgactaaaccgcggtatttgtgtcaccaaccagctgtcttcatatgccgcactggtcaagccacgtagggtgcgttcacaccaccaacgcaccaagcaccctcaaccgaacaccgagaccaggttggagggcgcccaaccccaccctctctaatccaggagacaaccacgaccgcccaccgacaactgtcgaccaccgccgacgcgcccacctgacaattggccgccacacgccgtcctacacgcgacacgaggacggaggccgtaacaactacccgccaccacacaacccgcccgaccgacccccgccactaccaaacaacggggcggcgcgcgcaacaccaagcacctgtgatcacacgccgagcacacgcgaccacagcacctcacc

SEQ ID NO: 627568 - DNA, 366 bp, Homo sapiens
aaagtacagcagaaagtcttcattcgtgtagggtcaaccgcgatggaagtcagtgttcgcctccgtgctggtgaccgctccacccatgtgaatgtgagtggccccttcccgggagctctcactgaaccgcagcaggcatggtccccgtgctgctggtcctatcaagcagggcacgctactccctcccttgcttgatgaagcccgcttatgcacccggtcattccaggagagggagcagcgtcttttttaactgagttctcaggatgctttcaactcctcaagccacgaagggaacaatttttatccatttatatactttccttacaataacctcgtccacggtcatgagaccctcggggctggcgc

SEQ ID NO: 627569 - DNA, 458 bp, Homo sapiens
  misc_feature (301)..(301): n is a, c, g, or t
gcacgaggccaaatgttaacttttttctttttgaaaatataaataattactattttgtactgtgtggtatctctggtcttttgtttcattcacttggcttgtctcttgggtctgagatgcttgcctgtgagatcttgaagccctggtttgatctccatcgtgcagggattatgttcagaatgtctaagaagcggtaggatttatttactctccatagtctcacgcagctgccagcctgttgtcctccttgaggagctgccagccatgtcctggcgagtatctgggaccaggtcctactttnccaaggcaagcaattgtagtgggcttcttctgcaccctgtgtgtgttaatacccaatcccaaatctcctttctcctaacaaaatcaaaatatatatatatttaggggacatgaatatggagattaaataaagggaaattgttgtgtcaaaaaaaaaa

SEQ ID NO: 627570 - DNA, 540 bp, Homo sapiens
  misc_feature (300)..(300): n is a, c, g, or t
  misc_feature (317)..(317): n is a, c, g, or t
  misc_feature (391)..(391): n is a, c, g, or t
  misc_feature (417)..(417): n is a, c, g, or t
  misc_feature (446)..(446): n is a, c, g, or t
  misc_feature (529)..(529): n is a, c, g, or t
ggggaagctgtcatggctgctcctgtacgtatcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatattcattcaaactggaacatttaaataacttcataacagangcaatcaactgatatcntagatatctcttcaggagcatcattttaaatcagatgttggcttcaaacaaaggcataagcactctaacagccntagattgaaagactacttagctaaangacgtttttgactcaagcagctctgtccngttgataaatctgagatgaatggagaagtaaccttaatcagaagtctccatgaagagttctaccaaggaaccccccgtacgcngtagcgtctgg

SEQ ID NO: 627571 - DNA, 576 bp, Homo sapiens
  misc_feature (16)..(16): n is a, c, g, or t
  misc_feature (136)..(136): n is a, c, g, or t
  misc_feature (419)..(419): n is a, c, g, or t
gttgctttgtcagccntggacatggagcagcgggatatgactccagaacagccttcccatgtcgcagcagcagagggtcatgttgaaagttgtcaagtttttgctggaagcttgcaaaggtaaaccctttccccanggacaggtggaataatacccccatggatgaagcactacactttggacaccatgatgtttttaaaatccttcaggaataccaagttcagtacacacctcaaggggattctgatgatggaaagggaaaccagactgtccacaagaatctcgacgggttgctataatggtctgcaccccaagacttccattactctccatagtctcacgcagctgccagcctgttgtcctccttgaggagctgccagccatgtcctggcgagtatctgggaccaggtcctactttnccaaggcaagcaattgtagtgggcttcttctgcaccctgtgtgtgttaatacccaatcccaaatctcctttctcctaacaaaatcaaaatatatatatatttaggggacatgaatatggagattaaataaagggaaattgttgtgtcaaaaaaaaaa

SEQ ID NO: 627572 - DNA, 194 bp, Homo sapiens
tgcttgccctggcctatcccatgaggcccagtgactccacaaactccccgaggaggggatgggggggtcaaatttcagagaggctcttttttgagctttttgacccccctttttacggacccaaatttgccgtttttcccctcttttttggagactgaataaaccacctctggcccattttggccccagttcca

SEQ ID NO: 627573 - DNA, 673 bp, Homo sapiens
  misc_feature (19)..(19): n is a, c, g, or t
  misc_feature (89)..(89): n is a, c, g, or t
  misc_feature (92)..(92): n is a, c, g, or t
  misc_feature (104)..(105): n is a, c, g, or t
  misc_feature (109)..(109): n is a, c, g, or t
  misc_feature (118)..(118): n is a, c, g, or t
  misc_feature (120)..(120): n is a, c, g, or t
  misc_feature (130)..(130): n is a, c, g, or t
  misc_feature (133)..(133): n is a, c, g, or t
  misc_feature (255)..(255): n is a, c, g, or t
  misc_feature (272)..(272): n is a, c, g, or t
  misc_feature (277)..(277): n is a, c, g, or t
  misc_feature (280)..(280): n is a, c, g, or t
  misc_feature (283)..(284): n is a, c, g, or t
  misc_feature (292)..(293): n is a, c, g, or t
  misc_feature (302)..(302): n is a, c, g, or t
  misc_feature (314)..(314): n is a, c, g, or t
  misc_feature (322)..(322): n is a, c, g, or t
  misc_feature (329)..(329): n is a, c, g, or t
  misc_feature (331)..(331): n is a, c, g, or t
  misc_feature (345)..(345): n is a, c, g, or t
  misc_feature (347)..(347): n is a, c, g, or t
  misc_feature (352)..(352): n is a, c, g, or t
  misc_feature (367)..(367): n is a, c, g, or t
  misc_feature (371)..(371): n is a, c, g, or t
  misc_feature (379)..(379): n is a, c, g, or t
  misc_feature (439)..(439): n is a, c, g, or t
  misc_feature (575)..(575): n is a, c, g, or t
  misc_feature (593)..(593): n is a, c, g, or t
  misc_feature (655)..(655): n is a, c, g, or t
ggcggggaatgaagcaggngacccgggaccgggcggatgaggaaactccggaaatacatcatcagccaggactcagcgaggccgcaggnggntttacgcacgannagcngcagaaggngnggaaaggacngtnttattgcatgtggatgcaggacaagccactcctccaggaagaattaggaagagactatttcccaacacgtatcatgctatttcagacaacggaggcgcacaccatgttccttcaagccttcnggcagaccatgaaacgngagtnganggnnattgacannctgagccangaaaaattctanatgcacanacggatngncctgaacgagtccntnaaggnactgaagatgcaagnctgngaaaaaanacagatcgaggagctgctaaagcagcagatgactgagatcctgcaccccagcagccaagnccccaacggtgtgaagagccacttcatcgagatcttcctggaggagctgaccaaagtgggcgccgaggagcttacggcagaccagaacctgaagttcatcgaccccttctgcagaatcgctgcccggaccaaggantccttggttttgaacaanatcactcgaggcatctttgagacgattgtggagcaggccccgcttgccattgaagacctccngaatgaactggacacaca

SEQ ID NO: 627574 - DNA, 177 bp, Homo sapiens
aggggataggtgccatggatccgctgtcgccgccgctctgcacgctgccgccgggccccgagccgccccgcttcgtgtgctactgcgaaggggaggaaagcggggagggggaccgcggcggcttcaacctctagtgagtgggggtccgcggggaggtaggcgtgcagggagctccgc

SEQ ID NO: 627575 - DNA, 94 bp, Homo sapiens
agttgcatatatggaccccgccttgggaggacaggtcctgaatgtcctttttccagtgtaacatgttttactcccaaataaaattctttcagca

SEQ ID NO: 627576 - DNA, 208 bp, Homo sapiens
aggggataggtgccatggatccgctgtcgccgccgctctgcacgctgccgccgggccccgagccgccccgcttcgtgtgctactgcgaaggggaggaaagcggggagggggaccgcggcggcttcaacctctagtgacccacgccgcggacttttggagcaccgtcttaacgccggacagcttgcgcccttaaagccgttttggcctg

SEQ ID NO: 627577 - DNA, 114 bp, Homo sapiens
aatcagctcgtacctgtgcatggcatccctgtcgatacaaacatcttcagcagtcagctggcttcccacttcttgcttcctgtttctgccctgggtcatgttcttggtgagggt

SEQ ID NO: 627578 - DNA, 571 bp, Homo sapiens
ctactcgggaggctggggcaggagaatcgcttgaacccaggaggcagaggttgcagtgagctaggatcacgccactgcactccagcctgagcgacagagtgagactctgtctcaaaaaaaaaaaaggcttctccaaagttgttcattgtttcagcaccaaaagggaattaggcacagggttgaccccagaagtttcattttgtgacactttaaattctccagattattttattcccacgttgggttcttgattgcgggcctcagcacttaaatttaacttgttattgttggcaaagttttcaattgtgcagagcctttcgtgttattcggatgaaggctttccggccactttgttccattgcttatagccccctttgccttctttccttgtgggagcattgctttctcttatttccttattgttgaaaccagccttgacattaagttgaaaggattttgggcttcaagcaaacattgaaattgtgggtttcattatctttggcaccacttccttgattagcttgtgttgactcattggcaaaccttcgtttttcattcgtcttgctcaggt

SEQ ID NO: 627579 - DNA, 633 bp, Homo sapiens
ggttgggaaagcgagggatttttaggcctgtctcctgcttactggatctcctcccttttactttgccggtagaacacagttatgaggtcgcaagaagaagaagcagctgatgccgtggctgctggtatcctttgtcggtttgaagtcgaggtcgcgttggggtgccggttgttggggcctgggactaggaggcctggatttggcttacggcgtggagcgtttgtatttaggcgtctgcgtgggtggcctggtggctgggattggacttgggaaggcttctaggaaaatggggttccgaggtcgacaggcttttgcagttgtgggtcgtgtgactctgtgactcaggaggatcttgttcggtgcgaattttggactccgggaggcggcctggacccctccgccagggacagtgtcccctagggactattcagccaccttccgttgtattggtgacgattcaacaagggacttttcttcgagtgcgataggcttattactttcatggagggttggggacagcttcacagtctgtcacccactttttctgtttttatttactttatgtgtgtctagtgtatattttttcgaattggcggtttagtacagaaccaagcaacccctggggatcctcta

SEQ ID NO: 627580 - DNA, 362 bp, Homo sapiens
  misc_feature (12)..(12): n is a, c, g, or t
  misc_feature (27)..(27): n is a, c, g, or t
  misc_feature (49)..(49): n is a, c, g, or t
  misc_feature (169)..(169): n is a, c, g, or t
ccagcccacagnccacacacatggagncctccataccttaggaagcgtncctgccctttaaatgaaggtggtcggggccagtgcagcggctcacacccataatcccaacactttggaaagcccaaggtgggaggatctcttgaacccaggagtttgagaccagcttggncaacatagggagaccctgtctctacagaaactttaaaaattaggcaggcatgatggtgcacacctgtggtcccagctactcaagaggctgaaggaggatcacttgagtccagaaggttcgaggctgcagtgagctgtgatcatgccactgcactccagcctaagtgacagtgcggtaccctgtctcaaaaaaa

SEQ ID NO: 627581 - DNA, 230 bp, Homo sapiens
tgacgtagactttgatttctcagcctcggtataagatgtagtctgagaagataatggaatagaagtactcacagagtggctcaggcaagaataagtccaagtccagtcaataaagagtgttacatctaccaagatgttcctgcgcggggactcagtcatcgtggtcctgcggaacccgctcatcgccggcaagtatgggccgcctgtctgttgacagaactcactcctct

SEQ ID NO: 627582 - DNA, 158 bp, Homo sapiens
  misc_feature (152)..(152): n is a, c, g, or t
gttgttggatcggcatctcactttttcttgaaccttttccaatcaggtctcattcctaacactccatgggaaaccaaccttgtcaattctagatcatggctccatcagacttccatgtgtgccacaatctacatggccatgtttctctattnccttgg

SEQ ID NO: 627583 - DNA, 248 bp, Homo sapiens
accgatgagcaacagacgagctaaacaccctgtgggggacctagctcaacctcttcttacctaggtcaaaggcactatcatatgatgtataagggatgggtactgattggaagaaattaatcagcacccaatgggagcccacggaactaagtagggtcccaagaaaaaaaacgggagcctaaacacagagctgagctaatgccaaatttcattcctcaaacctttagtagagggttaattagaggccg

SEQ ID NO: 627584 - DNA, 315 bp, Homo sapiens
cgtcgacatggggcggtagtgcacgatgagctccggcgcgccttgcggctcctccgtcaccggccttcgcaccttcacgcgtcgcttgttcttggtgggagtgccggccgtgcccccctcgttctccacgtccgggaggaggccgaggaacgccacgcccaggcgctgctcgatgtcctccggggtcttgatcgtgcggtccgcctgatcgcgcaggaacatgagcacgaggcccgcgacgaggccgatgagcgagcccatgcccgcgatcgtcagcaccttcgggcgaatcggcgacttcggctccgtcgccca

SEQ ID NO: 627585 - DNA, 120 bp, Homo sapiens
  misc_feature (1)..(1): n is a, c, g, or t
ntcctttttttttccttgggcctccaaaagatttaaacacgtgctgtgcctcacctaagctgggaacatttcctcagtaaaccacacccccacggcccggtttcgctaactccttcctga

SEQ ID NO: 627586 - DNA, 148 bp, Homo sapiens
tagaggaccccgggcagtacggattggacagcatgactgctgtggagtaggagggcagcggtggcagtgtcctcgaggcacaaagtaggagggaccagtgtgtgggggatgggacttggggagacagagtgctgggtttggggtgtgt

SEQ ID NO: 627587 - DNA, 100 bp, Homo sapiens
accaaactcaccatccctccagtcctccccaacagggtactaggactgcagccacctgtagctcctctctgcttacccctctaattggacagctgcactt

SEQ ID NO: 627588 - DNA, 335 bp, Homo sapiens
atctataaatgcatttccccccttgattcttcacataaagtgtaaaaaggaagttaagcagtgccaatatatggaaaatatctaagttaaatgttctagcaaaaatgaatcagtaatgagattgtggctaaagagggctctaaatgagaataatatatctttacagatatccaaaccttccaagcagaaatacgttgcatataaaaaagctctaggtgcacagtaagcatatagggttcattttgttccatgtgtatttctacacaatgaaagtgtcaaaaaatagggtcatctgtgttagcatagactacgttattgtatatgctgcattgaat

SEQ ID NO: 627589 - DNA, 117 bp, Homo sapiens
gcataggccaagctcggggcattagtgtatgcaaccatgcagggtgtatacatcggtgtgcaatgcagggtactcatgtatgcatatgtgtgtgggtgcagtgcagcccccattgtg

SEQ ID NO: 627590 - DNA, 382 bp, Homo sapiens
tttgggggggggtgggggggggggagggggcgtcggggaaaagggggggggggggtggggggatcggggggggggggtgggtatgtggggggggggggggggggggggaaggggggggtggaaagggggggggtgtaggggagggggggcggggggcgggggcggggggagcagcggggggggggggggggggggcggggggggaggtgggcgtgggagctaggcctggtgggggcgacgtcaatgacacgctgggcggggggggcggcgtaaaaagggggggacagttgggacagacagagcccaccccattcctccccgcgctcgtggcccttaccacggtactcctacctatctccccttttatagtaataatcttata

SEQ ID NO: 627591 - DNA, 103 bp, Homo sapiens
  misc_feature (1)..(1): n is a, c, g, or t
nattcgcggccgcgtcgacacggctgcgaaagacgacagaagggtaggaggatcgcttgagcccaggagttggagaccagcctgggcaacacagccagacccc

SEQ ID NO: 627592 - DNA, 110 bp, Homo sapiens
attttaagagcatatttaactatcagagtgcacaaaaactaggtgtgtcattgaaataatagtgcataaaaattaaactgttacataatgaacactactctgtgaaagtg

SEQ ID NO: 627593 - DNA, 85 bp, Homo sapiens
tgaggattaagagcaagaagttgggggggatgtgaaaataattttatgaggttgtctaaaataaagagtagtttcttaaaaaaaa

SEQ ID NO: 627594 - DNA, 1089 bp, Homo sapiens
tgtggcgcctggtgcgagtcgcggtcatgtactcgcaaggatgcctgaagttacacacccgagactcactaacgaccaaccgatggcaaccagactgcaaggaggtagacaagtgcgcctcgtcaggcaagaacttgtccatatgatgtcattgatcatcaatactttcaagtcgaaacaaagacgtatccttagctgagattagcctcatttcatacagttgcatcgagtagtggcgaatggcagcaacacatccgggtgaagcaataagctgtgaccatgatcgccagttagaagttgaaagcactggaattgatgagcttgacgttagttaagccgttataccagaacaaaaaccacatgatcgagactctcgacgtatggtgccatagtgggaatttgcgaactggcccataggctgcaattgatcaaatgaaccgttggtactaatcgccaaagtctggtgccccaacagccgtttcaatgtggagctttcgtctgggctgggtgcaccaatattcctctctgataggtcagccctgtgaggttcccccttcaagcttatgtgtcatgatgatcatgtgttactgttatcaccaaacatactccgatccactgatcggtatcgcctagggtagtcctcagccaggggactcgtacaccagggatgacagacggcccgttaaacctatggttcgtatcacacaaaagtttttcctacactctggtaagagaccaacagactattaggcatgccctgacggcacagggggcttcgtgaccaaaacgtacccggttgtggcacactcccatagcttaagaggcaagaagtgcatgacaatggcaataataggtgcacgcattcagcaacatacacgaaggggcgggctgagacaccgaggccgtctgcgtgcctgatcgaaacggcccatagcggtataagaaaggcggggaacgcatgggacaccacgtgttggcgagacaccgggtaatgcgcccagaaagtaaggtatcacacctgacacggcgagattaaacacaatacatgcaatgtaccttactcccacacgttcccctaccgccgaacaa

SEQ ID NO: 627595 - DNA, 498 bp, Homo sapiens
gataacaaaacatgccttggtagtggctctctcatgcaaatacaagaaagcttaagaaattcttgttgtaggtggcattaggcaaggctgccattcagctggtcatcaagctcacaagtaaaaaatcaaaaccgctcaagcaaaacggacacaattttggcacatgcattacacagatgtctttatcaaagtttttttcaagcacttcattcctaaatcacacagaatcacaccatggtgtcagctcacttgtaagacaccaaccaagattttcctatatactgtctccaacaatttaaagatcaatttcccgcagagggtgtgcaatgcatccataaactggccctaaatttagaggatgggcagagggaagggttgggcaggatggaatattaaattgtaacatgataaatatgcaagactgttatccaatctagatactttatatacattttgatgacttaggaaaaaaaggaatcattttgtgaaagcgtaaaa

SEQ ID NO: 627596 - DNA, 504 bp, Homo sapiens
ccacgcgtcggactagttctagatcgcgagcggcgccctttttcaaaaaaaaaaaaaaaaaaaaaaaaaaaaaaaaaaaaaaaaaaaaaaaaaaaagggggggcagaacaaaaaaataccacactgggggggcccaaagatacatacgccactccacccgagtatactgaggaaacacagggggcccaatatagcggccgccacatagagatgacgccacacaccgcgggcgcgacggcagtataaaacacgcgccggcagcgcgaaaacacgtccacaccgggggaacctatgagcaaacgacaccactctctactgccgtcgggcggggcccccaccgctgcggacacaacacccccaacaggaacaattcaaaccccctaagcgcggccaacatacaaagactcaacggagcggtataaacgggtgtgtgaacacacacactccgcgcgctaatctagccgagagcccgcgcatacagaccaccacttgccagcacacaac

SEQ ID NO: 627597 - DNA, 101 bp, Homo sapiens
atggcactcccaaagtgtggtacaggagccttttccaggacatgaagaggggattccctgatgtgagacaaggaggaggcgacgatgagagccacaggctt

SEQ ID NO: 627598 - DNA, 405 bp, Homo sapiens
  misc_feature (405)..(405): n is a, c, g, or t
gagaaacactagctgtcgtgagcagaagccagtcgtgaatgaccagagcgaccttatctccagcaatgtgcaactgccacatgcatgagccggcgccctcgttagccgggagagcaagatgcagacgcggagccctgaacacaggctgttgcatgctggtgactgtggttgtcgatgaccaggtcaccatcgtctactacctgtaccaacagcagagacggatggacctactgacagtcaactgagataacctgcatatggagaacctgcgcatgaagcttcccaagccttgcaagcctgtgagcaagaagcacatgggcctcacgcgtgatgaagcaggcgctgtcaatgcgagctctgccgcagatgcacatgcagaatgcgaccaagtatgagcatgacacn

SEQ ID NO: 627599 - DNA, 483 bp, Homo sapiens
  misc_feature (4)..(4): n is a, c, g, or t
  misc_feature (65)..(65): n is a, c, g, or t
  misc_feature (71)..(71): n is a, c, g, or t
  misc_feature (296)..(296): n is a, c, g, or t
  misc_feature (424)..(424): n is a, c, g, or t
  misc_feature (459)..(459): n is a, c, g, or t
  misc_feature (469)..(469): n is a, c, g, or t
attnactttattgttttaaaaccagccccttctgtctgccaccacccgccaccccttcccgaagnaagtanaaaaatcataatagatgtctctccagcgtgcacctctgttctcctctctctaatggcagcttgggaccctgaggcagtgacgcttagtaatgtatcctaatagtcattgtttgtctgacaaatacctagtgaccacaagcctaatcagggccgccatgaattaatggtcagtgtagtgatgggtgctgaatgatcataaaaatagcttgggaccctgaggcagtnacgcttagtaatgtatcctgaatgagtcagtgtttgtgctgacaaatgacctagtggaccacaagccgaatcagggccgccatggatttaatggtcagtgtgagtgatgggtgctgaatgatcataanatagcgaatactgggccgggcttggtggctgatanctgtaacttnggaaacggaggcag

SEQ ID NO: 627600 - DNA, 1382 bp, Homo sapiens
  misc_feature (1179)..(1179): n is a, c, g, or t
agtggtggctcatgcctgtagtcagagcacttcaggaggatgagaagggcggatcacctgaggtcaggagttcgagacagcctggccaatatggtgaaaccgtctctacaaaattacattagccgggcatgtggctcacgcctgtaatcccagctactcggtaggctgaggctagatgccagggccatcacacccagctaattttgttgatctcttgctagagcagtacgtattctgcctatgttgcccagtctcgtcttgcactcctgctctcacgagatcgtcgtatcatgcttgactcatatcactcagattttcgctggcctcaatacgatctcatcttgccattatcctttataaggtcgtcctcttgtctatgaatacgtcctctacattcagtcctcctttcatactcgcttagcgtcataggtaactcgtcctctaccgctcttgctctgtcgcttcctttccttgttccttaggccctccgtacactctttctcctgtcttccgctcccacatcgttgtctgcacctcctttcctcttccacgcctccttacatactcctgccctttaacgctttctctcccttttcactgtctcattggtgcctttttcttccctccgtttcatcatttcctctccatcacctcctatcatcttccttcctgattgcattcctaccttatcttcttctttcctaaccactctactcgcgcctctacctgtccttctctcctccgcctacatacgtcgccctactctctattctctcttctttctttctcttctatctcccctctatcacttaatatcacttcatccttctcaccttcttcttgtcttcctcttcatcgactcctcctgtttatcatctctctcatctctactctcaccctcatctttctttactctcttctctacttctctcctccgctgctctcatactctccgatctcatccctacattctctctctccttcatcatatcactttctcctctcgtttatcctgctcgtctctcatctctctcatatacctcgtccatatcttctcactagcatcttctctctcttatccgttactctctctcgtactcgcgtccgcttctctcgtacatctctgtcgtcatctccactccctctgcattatctgtcactcgtacgtctctactagtntgctcactgctattatctcctcttgatatacattttctctctctatctctctctctaccataatcgtcgctcgtctacactagtacgtctacttatatgcatcatctacatgtcgtcgctcgtatcatcgtattaacggcgctgatatctctcattctctctccttctcgtgtacctactctgatactcatacccctaccgct

SEQ ID NO: 627601 - DNA, 578 bp, Homo sapiens
cctagtccaaaggatgattgtatcaaacaggtacaaaactgacagagtttctttttgtttagggcatgttactaccctgaaatgttgtattttttgtctttaatttccaagaattaaagccggcctggtaaaattgacataaatggtaaacttcaacattttcataatacagtattaatgtttgataaaggtatatcccagttaactacattgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgtttttttttcctccagcgtgtttaattaaatatgttactgtattagcaaaacattttcatttttaaaatctgctaattttaaacttggactgtgttaagtaaacgttaatcatacactgc

SEQ ID NO: 627602 - DNA, 333 bp, Homo sapiens
gtgatatataaactcagagccaaacattcatcagttctacatatatctagtcctcttcctaattaccctactaatcttagttaacgctaacaagcctataccaactagtacatcggctgagagggcgtaagcgttatatcctacttgctcatcagttgatgatacgccctagcagatggcaacacagcagccatatcaagcaatcctatactaccgtctcggcgatatcggttacatcctcgaccgggagcatgattatatccgtacactccacactcatagagacccacaacaaatagcccttctaaacgctatatccaagggggatcctct

SEQ ID NO: 627603 - DNA, 261 bp, Homo sapiens
ctgtatggacttggtgcttgggtatgtctaccagacttgaagctggatgatggcaggactaggtctgtcgtgttcacctttgtattccagggtccaggacagtgtacagtatggtaggcattcaataagtatttattacatgaatagatgtatgttgaattaagtttattttctctggagggtggtgttttatacattcatccttaattcagataagcaaataataagcttttactgagcacctatggtgtgtgtggatga

SEQ ID NO: 627604 - DNA, 233 bp, Homo sapiens
agggtagggaacccctggcccccccggaggggaaaattgctctaaccccaaacaacggcatgagggcccctgccccttacccacatgttttttttgcaaataatcggcccaagactgtttttttactcctttttaagtatgctttgttttttgtaaggaatgctttttgttaatttgttccctataaaaacaatgtttttccctggcttgctgtccataaacatttgggtcca

SEQ ID NO: 627605 - DNA, 954 bp, Homo sapiens
  misc_feature (248)..(248): n is a, c, g, or t
  misc_feature (266)..(266): n is a, c, g, or t
  misc_feature (294)..(294): n is a, c, g, or t
  misc_feature (296)..(296): n is a, c, g, or t
  misc_feature (298)..(298): n is a, c, g, or t
  misc_feature (310)..(310): n is a, c, g, or t
  misc_feature (313)..(313): n is a, c, g, or t
  misc_feature (317)..(317): n is a, c, g, or t
  misc_feature (378)..(378): n is a, c, g, or t
  misc_feature (392)..(392): n is a, c, g, or t
  misc_feature (404)..(404): n is a, c, g, or t
  misc_feature (416)..(416): n is a, c, g, or t
  misc_feature (426)..(426): n is a, c, g, or t
  misc_feature (431)..(431): n is a, c, g, or t
  misc_feature (495)..(495): n is a, c, g, or t
  misc_feature (907)..(908): n is a, c, g, or t
  misc_feature (921)..(922): n is a, c, g, or t
  misc_feature (936)..(936): n is a, c, g, or t
cttcccggtaaatgggccgcgcggcccgagcctgaactgggcgggcccaactgataggatcctggctgcaattagaacagggactaaagggccagacaaggggatagacccctgcagaacctgtggccgagcctcgggcctgagagtcagtcaggaaggagacatggtggagaggccaacacggtatgggctccacctgcagctagacctgaaaaggggaaggagagtctcattagagaagaggctgntggcagaggaggaagagnacgaagaggaggtggaagaggatggccncngnagctgctcggangangatnacagtgagctgctgcaggagatcacagacaacctgacgaagaaggagattcagatagagangatccatttggacncgtcctccttcntggaggagctgnctggagaganggacnttgcccacgtggtagagatctatgactttgaaccagcgctcaagacggaggacctgctggcaangttttctgagttccaagagaaggggttcaggattcagtgggtggatgatactcacgcactcggcatctttccctgccgggcctcagctgcggaagccctgacccgggagttctcggtgctcaagatccggcccctcacgcagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccacccnngagcttcaccatnnggtgtggtggtttntttatccccgaatgggaa

SEQ ID NO: 627606 - DNA, 522 bp, Homo sapiens
gcaggaggatcacttgagccaaggagttcaagaccaccctgggcaacatagcgagaccctatctctaaaaatatatatatataaggccaagtgcagtggctcacgcctgtcatcccagcactttgggaggctgaggcaggcagatcacctgaggtcaggagttcaagaccagcctggccaagatggtgagaccccatctgtactaaaaagtacaaaaattagctgggcatggcggcgggtgcctgtaatcccagccacttgggaggctgaggcaggagaatcacctgaacccgggaggcggaggttgcagtgagatgagatcgcgccactgcattccagcctgggcaacagagtgagacttggtctcagaaacagaataaaaaaataaaaaattatagccagtcagggtggcatgcacatgtggtcccagctatctggaaggatggcttggacccaggaggttgaggctgcggtgagccgagatcgcaccactgcactccagcctgggtgatggagcaagat

SEQ ID NO: 627607 - DNA, 157 bp, Homo sapiens
accctgtagttgttacgacacctacaacccctatatcttacatctcaattcccatcctaaaaagcactcatacttatatgcatccccgcagctacagacacacaacacacagcacacgcatgcacacacagcacacacacgcaaacacagcacgaga

SEQ ID NO: 627608 - DNA, 428 bp, Homo sapiens
aaacaggcccgaaaagtgggtcccaggttggcagtgttccccagtgccccaaaaccctggggttagtttttgccccccccaggaaagccaccttttggggacattgggtggagggcagggcctaaaggccccaagggaaggcccccttccggggctttttccccaggaggaagggaaggggctttgtgtgcccccccagaggaaaagggccttagttttggggtcaaacccccctttttgtgttttcccccccaaatggaaggttcccaaggttccctttctgttccctttccttccccctgggcgggcccttccgcccccccccccagaggcccccccccccccttggggtgtttttaggagtttcgggcagggtgggcattttttcccaaggggggagaatttcccattaagggcttagcccttta

SEQ ID NO: 627609 - DNA, 103 bp, Homo sapiens
agtcagctactcaggacgctaaggtggaaggatcacttgagtcaggcatgttgaggctgcagtgaacccagatcactccagcctgggtgacagaccttgtttc

SEQ ID NO: 627610 - DNA, 109 bp, Homo sapiens
tgcgttgtctctgcctctggccttcctgtttactttcagttccaccacatgggacagtccctcttgccacaagggctttgtccgtgatgctctgagattgcggtgtttg

SEQ ID NO: 627611 - DNA, 86 bp, Homo sapiens
tagtagacataattcttatggtgactacgatcgtccttttgactactggggccagggcacccttgtcaccgtctcctcagcctcca

SEQ ID NO: 627612 - DNA, 220 bp, Homo sapiens
  misc_feature (18)..(18): n is a, c, g, or t
  misc_feature (108)..(108): n is a, c, g, or t
  misc_feature (144)..(144): n is a, c, g, or t
gatcacagactctgaagncagactggcaagattcaaatcccgactgccatttttaactgaaagaccttaggtaagttacctaacctctctgtacctgtgtaaaatggngataacagtagtatccacttcacagagttatgaggntgaaatacattcatatttataaaacgtttggacccagtacttggcacatagtaaggccatgtaagtgtttgtaaaa

SEQ ID NO: 627613 - DNA, 517 bp, Homo sapiens
ccagtgttccaggcgggtctcgaagtctgggcctcaagcaaaccggccgccttggccatccagggtccggggattatggggcatagagccaccacaccgggccgggttatacttttaaatgatgtattcttccctcctcctaccagagtatgaggagatgtttctccagtctcaccctgagagccggggggggctcagggaggtaaaactcagactgggtatggggacctccccagtgactattccccgggagttttggtctcctacggttccatgctcagtctcggccattggtcagttcccctttcctctcggggggtgctgggctctagggtttctggccccgcaatgagctgtgattcttagcatggcatatctgtctctccatcttgggggtaatggttttttcatgtgacctcaattatctgatgggatctgagaacagtcatggatttcaagttggccagcttactggtggtgaggatgggagtgatgacttctgagcctttacaagctg

SEQ ID NO: 627614 - DNA, 438 bp, Homo sapiens
gtggagccaggcctacaccccagcaaccatgtcaaggtgacctgcattaagtgattcgtcatggcaccacctactcttgtgtgggtgttttccagcacgtgaaaagtcgagataagtcgccaatgatcagggaaatctggataccagtccaagctatgtcgccctttacggacactgaacggctgatccggtgactgccagcacaaggaatcaattttgcagatgaacccgcatgcgaaagcaacgacaggcacttatcatggacttacgcccaagaaacccgattcctacgcaacgtctgcgggaccccgacgagggaagtacgacgaactcgaactgggcattggttagggtcaccagaggctcctcgacgtcaagtgacacaaaaccgactatggggcacccatttaaactagcgatgaggtcgaaagtgaaatg

SEQ ID NO: 627615 - DNA, 855 bp, Homo sapiens
gctgctggagcatgctctgtgctgtgccgtgtgaagaccctgaaccccaatggcctgagtgtggccctgatgcgcagtgcgtgctgctgtgcgtgtcaacatcatgctgcacgcgctgtgtggtctgcatgtgactgtgctaagtgaccaacctggtgtgcccacagggcaccatgaagatgctcgtttctggcgctgtgatgacatcaaacttactaaatgacgtgcaatgtgcttgcttcacgaacatgcaacattcaagcacccaagcagccttccttaatatgcaaaggtagcaacagcccaggatgatataactggtgatgtgtactgacttctaatggtcctaatcatttggagagcttgccttgaaaccaggcggatctcttacatttcttgcaagtgcctttcatcctcaggaataattcacctgcacatgcggatttgacatgctgcacagtgaccacaggcccttcagttttctggggacagaaggtcaacacgtaacgcatgacgacgactcggaccaacggcgacaacactttaactacgacttgtcgcgccaggaaccactctctttccgtactaacaccgtttcatgcttgaaacgtctgcacgcattgtcctttatcccggacgcgcttgttcgctggtaccttcccattttgtcgggccccatctacaaacaagtgcaacgaattgacacccttaatttgaacactcctttccagtgcttggcagagtcgcctgggcagctcagtcacgcgtcattcaacttctggcgcacttcgctaccagacgcctcgcactccagcagtgcattgatttctggtactccacgggcaccaactggaa

SEQ ID NO: 627616 - DNA, 954 bp, Homo sapiens
agatgagtagactctgcgagaagtggagagaagcaggtctgtgcctccccatgggcagatcctggggtactaccgccagatacctagcaggctgagtacgagcagcagggtggacgaaggaagtgagagcggtgaggtcatgcgatgggatttggagatgaaagagtagaagaatcttgaagtcttggatgggctgtggtagaacctgataggtcgtaatcaaagtgggagggtgcgaaccaaagaaggcttgatgtggtcaagataattgacctttggacaaagtgaggtttccggggatgaatgtttgccaattctcggggtccgaacaatgtgcgtggaccatcgggagggaggaaggaagaagggggtttccaccaagtccaacgtatggtttcttccggatccaagtccgacgagtgaaagaccaaagacgggaggattccaaagttacctttcagttctaaccggacggtaaccggcccaggtttcccagattgcttttgccgtgaggaccaataggccttgtaagggaggcggctttccgggggcccaaggaaacgaaggcaaaaggaaagcccaaggtggccctcgtgtggggccctttggttacgccgtttggccccaaagaacttcccgcagagcgaaaaaggtcttaccgtgggcgcgtgtgaaccaccagggggggaatccgcagaagcaatgcggggagtacccttgccccttcagaaggcctaacttttgaaagagggcctggtcacagcttgcaggatatagaggtgctggatggatgaagagacggtcgggatctttcttttacccagtgcgcgctataaactcagaaacatgtttgccccagcgacatccgcggggtcacacaccgagacgctgaaaattcaccaagcgtgtcccccatgggggcccagtggtgagccgcgatggagcctgaaaaac

SEQ ID NO: 627617 - DNA, 471 bp, Homo sapiens
gaaaacagtttgtagagcttcctcaataagaacacatatgatccagcaatcccactactgggtatatatccaaagggaatgaaatcagtatgttgaagagatacttccacgttcgctgaagcattgttcgcaatcgccaagacatcaacctaagtgtccatcagcagaagatagatagggctgagcgcggtggcccacgcctgtaatcccagcactttgggaggccaaggcaggtggatcatttgaggtcagaagttcttgaccagcctggccaacatgatgaaaccccgtctctacaaaagatacaaaaattagccaggcatcttggagggcgcctgtaatcccacctactcgggctgaagtgagaatggcttgaacccaggaagtggagatttcagtgagctgagattccgccactgcagtccagcctgagcgacaagagtgagaagagtgaggcttcatctcaaaaaa

SEQ ID NO: 627618 - DNA, 508 bp, Homo sapiens
  misc_feature (3)..(3): n is a, c, g, or t
  misc_feature (26)..(27): n is a, c, g, or t
  misc_feature (359)..(359): n is a, c, g, or t
  misc_feature (369)..(369): n is a, c, g, or t
  misc_feature (424)..(424): n is a, c, g, or t
  misc_feature (445)..(445): n is a, c, g, or t
  misc_feature (472)..(472): n is a, c, g, or t
  misc_feature (488)..(488): n is a, c, g, or t
ttngttaagcaggtagtcacccgtgnnagtgggatagtgttatctgaaagtggacttgaattggttgtaaatgtatattgaggaattaggtgtgttctttgttaagcaggtagtcttatttgtgggatagtgggatagtgttatttgaaagtggacttgaattggttgtaaatgttactgaggaattaggtgttttgtttgttaagcaggtagtcttatttgtgggatagttggatagtgttatttgaaagtggacttgaattggttgtaaatgtatattgcaaattctgtggcaactagttaaaaaaaagttttaaaaagagaagtatgtactaagaaagacagggaaaatggagtcntctaaaatcntccaatgaaaactgcaaaaggcagaaaaagagtggtagaccaaagaatgaagacngaggagaatgaatagaaaacngtaaccaatatagtagatattaatccnatgatatccataatcnctttgaatgttaatggtatg

SEQ ID NO: 627619 - DNA, 146 bp, Homo sapiens
ccctttccctttttccccttttatttggagggaatgggaggaagtgggaacagggaggggggagggggattttttttatttttttagcccatttccaggggggggaatttttttttaaaatgtgccatgaaaaaagttgtttttga

SEQ ID NO: 627620 - DNA, 175 bp, Homo sapiens
ctgtcattcaggacacaccacatactaccatgggacgttcactacacaagcaactgagtctgggtgattgccacgtgcactcacccagcccggccccctacccatgtccagacccctacagactgtgtctaagctcaggaggaaagggaccctcccatcattcatggggggctgc

SEQ ID NO: 627621 - DNA, 533 bp, Homo sapiens
  misc_feature (4)..(4): n is a, c, g, or t
accncccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagtgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcg

SEQ ID NO: 627622 - DNA, 403 bp, Homo sapiens
tcagcacagagatagaggagagtccaggagcaggaggtcactggaccacaggggccctctcccacacgcacgcagacactcgcgcggccacgtgtactgggcgcccgtggagagccggtgggccaagctcgacttgctgtgtagtgctgtggttttcccctcccatgggtacagaaatgctgccatgacgtgtgtgtctctccatctgttgggtgggggtagggctgatccagagcacagatctgtctcgtgcattggaagatcgccacccaagcttggctagccgagctcgtgtatcctggggctcccttcatctccagggagtcccctccccggacctagcagcgctcgctgggctgagcccctaccccgagaacaggccggtcctcccggggcctccctt

SEQ ID NO: 627623 - DNA, 1042 bp, Homo sapiens
  misc_feature (542)..(542): n is a, c, g, or t
tcgaagccctccattaagtctccgagcccgttctccggagtgttctcctgcgtgtgcgttgtatcgcctcagccaccaagacggaatcaggacatcttccttcgtgcgtaaagttactagctgggagtcatcgcgcgccgtaaactccataggatggccgtgggtctgagtcgaccagggatcaggcgtgttgactgatggctccatgtctcgctcaactagcgtgattctgactgtccgacaatggtagttacaacatggggctctacggtggaatctgtcataggtacgccgtgattcccacaaatgggagacgacgcgtgtgtgcgtgctcctatcgtggaagtgtagcgacatgcatttgtccaaactgttgagttcagctatatattgccacagttccaagcgccgtacaaacgtattgcccttgtcagagggataatgtgcgaatgacgagcaatcttctctggtgtggagctgtgggatcaatgccagcactgtaggataacgtgcacgcgctatcttccgcaggcgtctacatncatgcgtgctcactggctgtgttgctcgtgtcctggtgggcgaacacgtcgctcatctgtttttacgatgatactgcagccatgtgatattcgctcacgaaaaaactggtccctgaggcaagtgggagcgctgtgggactactgtcggtgcaaaaggaagcctgggagtttacggtaggccctggtgaggatttggtcgtggtgagagaatcacacagaggtcgtagggtgttgttcgctgggcctgtttcgcaggggcgtttcacgtggttctccgtggcacgtgccattcgattcattctgacgcggggtcggcgtactttgcgtggtgtacgactctggtctccgggcggttgctgccgcggaccccagggaacgcacgcaaatacggggttgaggcgggccgatcgcgggcgaacgtggcggcgggggcgggcgtggttgtcctaacccttcgagaggtgggggggggcttgatggttgcgcccgggggcaagggt

SEQ ID NO: 627624 - DNA, 368 bp, Homo sapiens
tcacagacaccagctgctctagacggtgatggatctatgaagcccttgttctccttgccaggtaaccgagactccaatccagctctgctgtatccaacctgtgaccttgggcaaagtgtggatcctctccatgcctctgctttctcacccgtaaagagggtcaccttggatctgtcttcactcgtgtcttccaatcctttggtgtccctagtctctggagaagcttcccagactcttttggaagattccagaggacagtcatctatgggcctcttctgcctatggattgtaatgtcctggggtttccctagcagccagccaaagaagataatggagcaatatgtcatgaacggagggatgggtggatg

SEQ ID NO: 627625 - DNA, 573 bp, Homo sapiens
ctctgcaatccctgactcaagagtattaagacttacaagtctatattataaaagaaatacattatgtaaggcgatcgctgccatagagtagatacctctgatggatctaggacgagagtaaatagaacaccttctagaaaggcttcaccattactagatgccataaagaacattatgtgattcctgggaggaggtcaaaataacattaccaggagtatggaaggagtagattccaacatagtagaaactctgtttctactaaaaatacaaaacttaagtcgggcatggtggcagatgcctgtaaatacctagctacctgggaggctgaggcaggaaaactgattgaacccaggaagcagaggctcactgtcgtgagccgagatcgtgccactgcactccagcctggacgacagagtgaaactccatttcaaaaaaaaagaaaagagaaaatctgtagtactgagtcgccaacatcatcaacgatctataggagaccagtatctcattacctagtacctaaatgtattatatagaaaggtggagggggaaaatcaagaaagttacctgaataat

SEQ ID NO: 627626 - DNA, 150 bp, Homo sapiens
gctactgatcctgtctttaggtgtaaattctaatattttgctcaccatgcccgtttgcactaaggcttatcttcatacaacagcgggctgctttgacaggtaacacttgaactgctctccaggccagctgccactctgggactacctacc

SEQ ID NO: 627627 - DNA, 903 bp, Homo sapiens
ggtcctatactaccaaatcctgtattaaaaatttcggttggagcgacctcggtaaatagaacccattctcctccgagccaggacatgctatgagttcaccagtcaaagcataatcttactatatctcaattgatcctacataatttgagcaacggaacgaagttcaccctagggcataacagcgcacatcctattctagagtccattagtcagcacatagggtgttacgacctcgatgtggcgtactcaggacttcccgcaatggtgcagtcgcctcaattaacaggtccgtatgttcaaggattaaagtcctacgtgatctgagttcagaccggagttaatccaggtcgggtgctatctagttcagattcctccctgtacgagaggacaccgagaatctaaggcctacttaacaaagtgccttccgcccgttaattgatatcatcgcacccttaggtattgatagccaaacatactaagaacagggtttgttggcaaccatcaaattcccagatgaactcaaaagtttttgggggctctgcaggtcatagaacacaagggtccaaacgactagcgggggctaggagccaactggaattcaaagtatgcaagaactatgggcaaagaacaactcgtacgctgaggtcagcaggaaaacctgcaataaaatggcccggggaccccgacgtgtggaccagtctagagaggcgctgaggacacaagaggcccctagcagacggcgacaggagctattgatgcccgaccagggaggagaaaaatatggggacgaaaaaaaacaaacacaacgggggccgacaccaaaaacacagggcgcggcgcaagtaagaagaagacagaacagaagggacaaaaacagcaggcaacaaggagacaagcacatac

SEQ ID NO: 627628 - DNA, 1032 bp, Homo sapiens
ggccctgagagggggattgagcctgagagaggagacggagtttcttcttcttcgaaaacccccatccatgatcctaccccctcaaccatccaaggtcgcaataaccatcaacatccaacctcctcctctttggacgtgagaggaggagagaaagaaaccaataagcctattagcaaccacagaacatttgactgactgctagttgcatgcatgcatgatgctgttgatgaatgatgatgaatactgatgctgatgcatacttggttgatgatatggcacatggattggaaagacatattaactaaaccccaggaggaggacaacttacacgagattcatcaatacctcatacattaagacataactccgtacctacatatcagcaccacactattatgacccattgggtgtcatcctcacaaagcgtccacagggaacgcgcacctacacacaagttggaggggagcagagacacaagaaaagtaatccaagctataccaggatagacctactgcactagtggaagcgatagactgccatagatcaatcaaggagagaacacacccaatgaagatcagccagaacatgccctattatccaaactttatagtaacatttgcaaaaagtttgtagatgaattgtgtgacatgtattgtgcaaaaagaggattggtagtagagagatgcaataaacagattatgaagatcatattgatgtctgcaggaactgtggtaggaattgtgaaaaaaagatgttccatgcgaattaatgtaagagactaatgagtgtatacacaagggattgacgaatataggtagagactactaataattgtgatgagtacggatcagttggtggaaagcatgttgagagagattgggatgtataagtcagaagacaacaagtggtgatgacagaaataaacatgagggccagatgaatgtatgatagagaggagggatacaaagggagagtatagtggatggtaaccgataaggcagggaatgcagaaaaaaagaataagtaaaagag

SEQ ID NO: 627629 - DNA, 1084 bp, Homo sapiens
gcacaggaccccgagcggggtccccgagccgcagggccagttcctgatcccagcagcatggcgtcttgggctgagccctctgagcctgctgccctgcgacttcctggggccccactgctggagggctttgaggtgctcgatggggttgatgatgcagaggaggaagatgacctaagtgggctgccaccactagaggacatgggacagcctacagtggaggaggctgagcagcctggagccctggctcgggagttcctggcagccacagagcctgagccagccccagccccagccccggaagagtggctggacattctggggaacggattgctgcggatgaagacactggtcccaggcccgaaaggctctagccgcccactcaagggccaggtggtgaccgttcacctgcagatgtccctggagaatggcacccgtgtacaggaagagcctgaactggccttcacgctgggagactgcgatgttatccaggccctggacctcagtgtcccgctcatggatgtgggcgagacagccatggttaccgctgactccaagtactgctacgggccccagggcagcaggagcccatacatcccccccagcaggcctgtgcctggaagtcaccctgaagacggcagaggatggacccgacctgggagatgctgaagtgggccaggaagcgccgttggcctgggcagacggaagccgggagtggtggcaatgcccaataccagggtgccgacctttgtgctggccgccaatttctttttgacctggggcatcaggggtattcactccaaaagccaagggggggcctcgacctggtggagcgcgcggaagcgacgaggaacggggtaacgagtggaagaggcgctcccaggttgttcgagcaacacgcctggtgggggccccaccgagctgtacgaactgctgagccccattaacccgcgcacgagtccgtgctgcccctcgtggtcgaacccgcgtgtgctggtgagaacacaaagccgagcagacaacacggagggacgataacgccgagcagagagggtgagtgcccacaccggcgcaaaagttgagcagc

SEQ ID NO: 627630 - DNA, 333 bp, Homo sapiens
  misc_feature (208)..(209): n is a, c, g, or t
  misc_feature (248)..(248): n is a, c, g, or t
tactacccatttattctgttctggatctcagacatgctttctttactattgctttgcacccttcatcccagcctctctttgccttcacttagactgaccctgacacccattaggctcaacaaattacctgggctgcactgccacaaggcttcacagacagcccccattacgttcagtgaagcccaaatttcatcctcatctgttagtnntactcccgttcaccgttctcaactactcatacatgcccntgctcttctttacactgccggtttacactgtttctccaagacatcacagctgatatctcctggtgctaatccccaaactggcaac

SEQ ID NO: 627631 - DNA, 474 bp, Homo sapiens
  misc_feature (3)..(3): n is a, c, g, or t
gcngtatagtgcgtcttcctgcatcatgcggcggatgctgattttgccgactttgtgtcttgacgattttcttttccgtcgcctgcgcggtgtagcccgacaggtcgggcagcgccggcttggccatttccaacggcgcggtgggcgggctggagatggtgtaggttttggcctgttgcagttccttggcgatgatcggcgccttggccgccgtatcggcaaacgctgtggcgctggccatcagcattgccgcgacgaagtaggctttgagcattcatggcgcaggctcccatcagaatttccagaccacgtcgacaaacgcgcggtgcaatgtaggagtcgacctggctgccataggcatcgccgggcttgaacaccaccggcacggcaaacgcaccaaggctgaaggctcgtcgatcgaactggctcagcgcggctggcagcaagcctttcttgaagtacttggtggaccac

SEQ ID NO: 627632 - DNA, 471 bp, Homo sapiens
  misc_feature (332)..(332): n is a, c, g, or t
aaaaaaaaaaaacggaaggaaacatcagcctgggggccccagactcaacatgtgtgtgtggtggggttccagcccaacatagagtaacattatttgtacctcccaggctagctcagtccatgggaggctctcctgtccctgaaagctgacacccacctttcaccactttgcccatggtacagttcagtttccttgtctgtaaaatggggatgataatgggacctaccctgcagtgttgttataagtattaaaggagacagtgcaaaaaaaggccttggttggtgaagagcccaacctcggaggggagctgctgggatcctccttattttgantgggatgtccctgtctccccctccccctgctccttgaacatggccaaggaaagtgaaaaacaaaaattattccctttgctagcccccttccccttgatgcctgggaataggttttgcccataaacggatttgtgttgga

SEQ ID NO: 627633 - DNA, 514 bp, Homo sapiens
ggggactggtctctctgtgtcactcagagtagactgcaatggtacaagccatagctcactgcaacctcaaattcctgggctcaagcgatccttccacctcagcctccgagtagctgggactacaggtccatgccattatgcccagcaaatttttatttttttgtagtgttttcgttttattttattttattttatttttgagacagagtccagctctgttgcccaggctggagtgcagtggtgcaatcttggctcactgcaacctccacctcctgggttcaagtgattctcatgcctcagcctcctgagtagctgggattacaggcatgcaccaccacacctagctaatttttgtattttcagtagagacagggttttgccacgttggccaagctggtctcaaactcctgtcctcaagtggtctgcccgcctcggcctcccaaagtgctgggattacaggcatagccaccgcgcctggccttgttttcacttttaacatagcttcattgatcct

SEQ ID NO: 627634 - DNA, 108 bp, Homo sapiens
gccggaccgaaaccttattgtggatgacctcaatatgagtttcgattgttacgtgtttttgttgggaagtaattctgttgaaaatgttctcacatacaggaattaggg

SEQ ID NO: 627635 - DNA, 145 bp, Homo sapiens
agaatagtcttgagactggagcacagtgatgaatatcaggaggcagctcaccacccccaacagccgttccagagactcaggagacagtcccatccagacagcaccaaccttactcctccctacccccatgtcatctccctaagga

SEQ ID NO: 627636 - DNA, 131 bp, Homo sapiens
tgtccggtgctccacgtactctgtcaccgttggtggctccattcaagggaacacagacagcaatagggtgcatttctcaggtggcgaaactggcacaagcagcaacctatggaatgcaggaaaagggggcc

SEQ ID NO: 627637 - DNA, 1034 bp, Homo sapiens
tattctggtattttattactggaaatatgtggtccttactcattcccaccccacaataaaaattctgacccaggccccccatttctttccctcatccccttcttccaccacaccatcccggaacaaggtgctccaggattcccgtgcccacgtggccatttgggagtgtggtgtctccatggggttagcaagtggtggaaaccaccagggccttggtggagaaaatggagggggttgagggagtcccaggaggggcttattggagggccttggccactgtgctcataggcgagcctcgatctcctcatcatcgggacaggtgtggaagcgaattcttcccgggcgttaggcatttgctcaagttaccgattgcacttccccggaaggcctcggggaatgggtgaatccccggtacttcttacacaccaccggtactagtgtgtaacttgggcaacaggttgcagtcagccagggctgagctcgtggccatccaaaaactcctctgagagacaccttaatcttcacgcacgggttccatccacttcttctgggaggggggatgtcaacgctcaccggtctaaacccctccagggcttcaggagctcccttctccacatggtcttgactgctgggtcgactcctcgatggccggcgcaaacttggccaaacattgtccagcccagtcggattgggacacagggtcaaagcctgccaccaaacaccacccaccactcacccaaaatcataccacaacaaacacaccccccccaaccacaccaacacacaccaccacaccacaacaaaccgacacacaaacagcagggcgcctacacataccacaccacgccccaaccaccccccaccccgaacacgcgccacaaacagggatcaacagcgcgacgcacgcgcacccagcccagccaagccacgtgcgccccgacgcaaacatggagtagtacagcagcccaccaacgcagacacatccaccgtacagcacaccgtgacttgatccaaagtcgcaggccacgccgccc

SEQ ID NO: 627638 - DNA, 239 bp, Homo sapiens
  misc_feature (103)..(103): n is a, c, g, or t
  misc_feature (124)..(124): n is a, c, g, or t
  misc_feature (148)..(148): n is a, c, g, or t
  misc_feature (191)..(191): n is a, c, g, or t
  misc_feature (229)..(229): n is a, c, g, or t
atgtagcatgatttcgttgggatgcaaatcttaaaacagtcctttaatatgaaccaacaatctggagcacaccagaaggacaatctagaattgtggcttgaanggactgcacgtaaaacccacntaaaaagatgctggtaacctgatngatgggcaaaccaggttaaaccggagcacccgtgccttgtctngggctcattcacctactccctaatcccatgactaactnttactggtga

SEQ ID NO: 627639 - DNA, 213 bp, Homo sapiens
tatcaacaggtcctgcggaagtcttcatgacctggcactacttcttgtatctttgttcgagagtccactctgccgagatatagcgacgggtcttaacttgtggcaaagtaatggcgactatcaacgcacgacatcggagagaagccaagctcaggaatatccaatacgaacacacctggaagcgtacgtgggtacgagctcgaatcgaatcat

SEQ ID NO: 627640 - DNA, 313 bp, Homo sapiens
  misc_feature (13)..(13): n is a, c, g, or t
  misc_feature (31)..(31): n is a, c, g, or t
  misc_feature (36)..(36): n is a, c, g, or t
  misc_feature (80)..(80): n is a, c, g, or t
  misc_feature (118)..(118): n is a, c, g, or t
  misc_feature (129)..(129): n is a, c, g, or t
  misc_feature (164)..(164): n is a, c, g, or t
  misc_feature (275)..(275): n is a, c, g, or t
ttggcgtccgctnggtggccgcgtgctgccnccgtncaggccccgcggcctgggctaggggtaccgccccgaggagggtnacagctcggaggtgaagacggaggatgagttgcgcgtncggcacctggnggaggagaaccgaggcattatggtgctcgggattnacagagcttatgggaaaaatgcactcagtaaaaatcctcctcaagatgttatcaaaagccggtggatgcattaaagtcagataagaaagttcggaccattatcataagaangtgaagtccctgggatattctgtgcttggtgttgacct

SEQ ID NO: 627641 - DNA, 264 bp, Homo sapiens
tgacctgggcacagaaatgtcattatttcctataggggtcggaaatgtagtctatcggtaattttgcgtgatgcttaaatttacttataaatagaaatatgtgaataacgtatttttcctctttattatgtaggtttaattgaagtagtatattattttcattacacattaacatgtagtatagtactatctcaaatataactgctgggtgatgaaaaatagccttcacaaactcatgttccaaaatttctgtgcccatttcaa

SEQ ID NO: 627642 - DNA, 328 bp, Homo sapiens
aagaagcgcacgcagatgttaatacccactctaaattctgtgtctagatcaccatgctgactgcacagacgttgatgagagctgatagaggtgtacgaatatggagcgccatgaatactgaaattgcgatcagatgttgcagtaccgattccatcagagcatccggatctaatcaccggccatgcatgtggcgcccccgctgagacatacatacgctctggtacttatagccgaacactactcttaccctatactcctggctcagatgtctctgccgtgatagacgctgttgaagatcgcatctgctttcactacaggggaccgagtc

SEQ ID NO: 627643 - DNA, 877 bp, Homo sapiens
  misc_feature (21)..(21): n is a, c, g, or t
ggcgaaaagagcgggaagggnagtggaaggcaggggctgaagacacaggccaggcggaatgaagatgatggtggtcttgctcatgctgtcctcgctcagccggctcctgggcctcatgaggcactcatctctcaggcaatacctggactctgtgcccttgccaccctgccaggagcaacagccaaagctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccaatgctcaaggacctggctacccagacctacatccgttggcaggagctgctgacccacttgccagccccaggcccagtatttcagcccctggaaagacatctaaagggacagggtcagggcaacccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccgctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcatcaaaaaaa

SEQ ID NO: 627644 - DNA, 1471 bp, Homo sapiens
  misc_feature (314)..(314): n is a, c, g, or t
  misc_feature (409)..(409): n is a, c, g, or t
  misc_feature (542)..(542): n is a, c, g, or t
  misc_feature (600)..(600): n is a, c, g, or t
  misc_feature (823)..(823): n is a, c, g, or t
  misc_feature (935)..(935): n is a, c, g, or t
  misc_feature (1225)..(1225): n is a, c, g, or t
  misc_feature (1471)..(1471): n is a, c, g, or t
gctggtcccggttccccggttaccggggcgcgaatgtatgaccacaatggcggacgccatcctggtgcgcgcgacggcccatatcagcggtctcgccgccggccgggagcttccatggctggtcggggtactgtagacgggttgattgaaagcgcccggtactgcctctcttgttgctcgcggctcttgggacgattggagagccatgatacgatgttgacagtagctggcagacaatggcactacatagtgaattgttggcgtatccactacgaggccatggttgcgagccgagggtaacgacccaaccgctnggactgcgtgaccagtccaactgaacgactctcttaagactgaggcgagagggtgcgcgcgctctataaggttgcataccgataaggtacttgangagaccacttggagcacaatcgtgcgccagtcaatcgacgcgaaggcgtcagcggggtaatcgaaccagttcaaatttgggcggggtcccaatgatgcgaaaggtaattagtgacctgcacgggctcggcccntatctaaccgctcctgacacacaaagcacgtgccgcagtgtgtcatctgcggggattntcatgattaataggaatccactgtatcaagccatgagtgagcatagtaacccccgtcggtagtggtgtgcaattccctggttgtgctaagcggaatcgaaaatgcacaggtcccccaattgggcgcgtcggttgattcccgctggttgaacggcgtcgttcttattgaacctaagggcacagcgaacgaaagaactccgcgtaagtgctaggtgcagggccanttcggttgggttgggggcttgggagtgagttaagaaagcctatagggtgccattagagcgtgaccttggtgacacaacaccgtgagacgttctatagacattagctatagangtgccgtgggagattgagcgctaggagcaccacactctagtgttgggcactcccaccggagcgaaggggccttgaatcctaggcaaaggcaagctttgttgggaccttaggttcatcgttgcccggaggaagtatggaacactccccccattcttggattggcgttttacgtgcggacagggccaacgtggcattttggtggcccccactgtggtgcccacgtgggtttccaagttggggagggacatccttgcaaagatctgaaacggggcgcttagaaacgatccctntgtttgacccaagcaggcctcatacaaatgtgggataggtgggcgcgtaggaatgttcaaaacatccaaattagcccccctcatgcgatatggtttgtcacacggggcccctgaaagaccccgctttgagattgagagactttgcgttgtctgccattgggcctaggaacggtgggcccgccaaggggcactggcgaagggaaattcctgcggggcgcctctagggaccgggtgagaacagaaccn

SEQ ID NO: 627645 - DNA, 147 bp, Homo sapiens
tagaggatcccagatgcaaccaaagtcagttcttctacgctactgatcggaaagagactacgggttagggagacctttaacctcagaccaaatgagttcaaagtatatgtctgtcaacgctgaattggagcaaagcggacttggagc

SEQ ID NO: 627646 - DNA, 972 bp, Homo sapiens
ctggggctggatctgggcacagcaatttgcaggcactgctgggcaggagtccctgatggccaagctgctgggctctgtatctcccacaagctgcagcggaggccccatggagcaggagcagaagcacacgttggagaactgaacttgaaggacaggacttacagcattgaggtcacacagctgtcctcgctcagccggctcctgggcctcatgaggcactcatctctcaggcaatacctggactctgtgcccttgccaccctgccaggagcaacagccaaagctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccaatgctcaaggacctggctacccagacctacatccgttggcaggagctgctgacccacttgccagccccaggcccagtatttcagcccctggaaagacatctaaagggacagggtcagggcaacccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccgctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcatcaaaaaaa

SEQ ID NO: 627647 - DNA, 166 bp, Homo sapiens
tattaaaaaggtcctttaaaggcttcttgattggcataaagttcctaaggttataaattttccccccttttggctgtaaagcaaagtgttttaatccccggttgtgccttattgttccattaaaattgtattttcgatccatcaataaatacttgtggttgaaaca

SEQ ID NO: 627648 - DNA, 330 bp, Homo sapiens
  misc_feature (29)..(29): n is a, c, g, or t
  misc_feature (44)..(44): n is a, c, g, or t
  misc_feature (81)..(81): n is a, c, g, or t
  misc_feature (139)..(139): n is a, c, g, or t
  misc_feature (151)..(151): n is a, c, g, or t
  misc_feature (175)..(175): n is a, c, g, or t
  misc_feature (184)..(184): n is a, c, g, or t
  misc_feature (245)..(245): n is a, c, g, or t
  misc_feature (250)..(250): n is a, c, g, or t
  misc_feature (253)..(253): n is a, c, g, or t
gccctcccgaaaatctcctttgaaagccnagacatctttctccnagcttaaagacttgtagataataactcgttcatcttnatttactttccactttgccccctgtcctctctgtgttccccaaatcagagaatagccngccatccccccnggtcacctgtctggattcctcccnattcacccnaccttgccaggtgcaggtgaggatggtgcaccagacagggtagctgtcccccaaaattggncctgntgngcagtgccccgtctccacgtttgtttccccagtgtctggcggggagccaggtgacatcataaatacttgctgaatga

SEQ ID NO: 627649 - DNA, 575 bp, Homo sapiens
  misc_feature (147)..(147): n is a, c, g, or t
  misc_feature (207)..(207): n is a, c, g, or t
gttttcccagagggggggccggtgggcattgtattgacgaactcatccttagacgtggggcttcccggcgggattacgttggtggctcacctcccctaggtcctaccaataggagcgtggattggccatcataggagggttcattcnttgatttcccctattgtcagggaccaccctaggccaaacctacgccaaaatccctttcantattatatttatggggggaaatttaacttttttcccccaaccctttttgggcctatccggaatgccccgaggtttattggattaccccggtgcataccccccatgaaacatcctttttttgggagggtcattcatttttttaacagcgggaatattaataattttcatgatttgagaagccttcggtttgaagggaaaagtcctaatagtagaagacccctccataaacctgggggggttatatggatgcccccccccctcccccccatttgaagaacccggatacataaaatttagacaaaaaaggaagggattgaaccccccaaagggggtttcaagcccaccccatggcctccatgactttttta

SEQ ID NO: 627650 - DNA, 175 bp, Homo sapiens
ttggtttaagtaacaaggtaaaggcctattgtggcatttttcatcacaagtagctgaactaaggaaacttgtggtggagatgttagtgtgtaaaccaaattgaggccggcttagcaacccagcccttggcagcactgttaaaagagttatcttctgaagccggatctaagagggg

SEQ ID NO: 627651 - DNA, 285 bp, Homo sapiens
gcatcagtgtaggtcaggggagtcaggctggagaatctagggctgtactaccggtttgcactccaatctctatcagctttaaaagtactgcttcctacactggagtacacagtggtgtctgtgtcatacggagtgatatcaggactggtagccgcttgtctggtgggagccttcagatgccacagactccctgcttttgctgggcaccattccaccaaaagatggagataatttggttctgtcttccaaagttttcagctcttctgaggcacgaaccataccacg

SEQ ID NO: 627652 - DNA, 136 bp, Homo sapiens
acacaggctgatgagtggaaaagtaacagtgtggggacatgtaattacagttgtatgggctgaccctgtgaaagaaccagatccagaagtcatggctcaggtaaaagttatcgtatgtgagacacttggctactac

SEQ ID NO: 627653 - DNA, 327 bp, Homo sapiens
  misc_feature (30)..(30): n is a, c, g, or t
  misc_feature (99)..(99): n is a, c, g, or t
  misc_feature (315)..(315): n is a, c, g, or t
tcaaagtgttttgaagaggagacgacgagnaagggaaagctggaaatcccaggtgtgaattgatggtcttctggctttcccagggcagccctcccctcntcccgcatcataaatctcagcatttaaaaataactgcaagctgggtgtggtggcttgtgcctgtagtcccagctacctgggaggctgagatgggagaatcccttgagcccaggagtttgaggctgcagtgaactatgattgtgtcattgcactctagctggggcaacagagcaagaccctgtctcaaaaaagcaaaaaacaaaaaagtcaaataanagtaaaaaaaaa

SEQ ID NO: 627654 - DNA, 579 bp, Homo sapiens
  misc_feature (4)..(4): n is a, c, g, or t
  misc_feature (104)..(104): n is a, c, g, or t
  misc_feature (138)..(138): n is a, c, g, or t
  misc_feature (147)..(147): n is a, c, g, or t
  misc_feature (149)..(149): n is a, c, g, or t
  misc_feature (180)..(180): n is a, c, g, or t
  misc_feature (195)..(195): n is a, c, g, or t
  misc_feature (257)..(257): n is a, c, g, or t
  misc_feature (319)..(319): n is a, c, g, or t
  misc_feature (321)..(321): n is a, c, g, or t
  misc_feature (325)..(325): n is a, c, g, or t
  misc_feature (413)..(413): n is a, c, g, or t
  misc_feature (428)..(428): n is a, c, g, or t
  misc_feature (476)..(476): n is a, c, g, or t
  misc_feature (479)..(479): n is a, c, g, or t
  misc_feature (490)..(490): n is a, c, g, or t
  misc_feature (497)..(497): n is a, c, g, or t
  misc_feature (569)..(569): n is a, c, g, or t
cagncgccttcctgccaggatgatgcttcaggaactttctgggcacaaagtgcttctaggtggacaatttttaaaaacacacagagccacgtgggtaacctatngtcaccaagagaaaaaagaacctcaaaatcagtnacgcgacangnagaattcggacctgtcctttctgaggaagtncttatttttcctgtnactgtatgacggcatcacaccttcctcctgaacgtgggggccatagtcactgactccgccancctcccaccagtctcccggtgtaggaggagctgcagacgtcctcaagcagaagtcactcctncntccncagtggtaactcctgtccctgcccaagtcctcccccctcccccgcagctgtattttcccttcgaaaagcaggatgcttccccgccatngccgactccaggctntccacaccacggcacaacggggatcagcagcctcttgccaccagtccnctnggccagcggcngggactncaggctcacgccgtagtctccccgccaatgaccacagcggcgggcgcctctgtgcagtgcgagtggtaactntgaacctcaa

SEQ ID NO: 627655 - DNA, 392 bp, Homo sapiens
  misc_feature (1)..(1): n is a, c, g, or t
  misc_feature (11)..(11): n is a, c, g, or t
  misc_feature (153)..(153): n is a, c, g, or t
  misc_feature (186)..(186): n is a, c, g, or t
  misc_feature (274)..(274): n is a, c, g, or t
  misc_feature (322)..(322): n is a, c, g, or t
  misc_feature (335)..(335): n is a, c, g, or t
  misc_feature (357)..(357): n is a, c, g, or t
  misc_feature (382)..(382): n is a, c, g, or t
nggctgctgantgagattttcacgtcgccgctcaacctgctgctgcttggcctctgcatcttcctgctctacaagatcgtgcgcggggaccagccggcggcagcggaacaaggaacgacgacgagccgccccctctgccccgcctcaaggcgngaacttcacccccgccgagctgcgcctttcgangcgtccagggacccgcgcatactcatgggccatcaacggcaaggtgttcgatgtgaccaaaggccgcaaatttttacgggcccgaggngtaattaaggggtcttttgctgggaagagatgcatccagggggccttnccacatttttgcnggggataaagggaaggcacttnaagggattgagttacggattgaacnttttttgaac

SEQ ID NO: 627656 - DNA, 639 bp, Homo sapiens
acccgtatggtgtactcggaacggtgggtgtgctcgtggcacaatcattggtgctctctcttggcaacttggacgctgcaggatgtatgcggctatgatggatgcccagaggcacaaggaccgtattgacatcatcgttacggggacctgtgaatacagcctgagcagtcacgagcgcagccgttgagggtgctgaatgaggcgctcacctctgccactctgagcgaacccgaaagcaggcatgaatgagatacgcactgcagatgagccattgaacgaggctgaacacagatggatggcactgggactacgtgaatgcccataccgaatgcgtgaactgctgacctacgaacctgtgaccactatgaagacatcacggtcaggccatgtgcgtgcgaactaagcgttaagcgacggatcagctcccggtatgatggccagccaagtgaaccacgctgcttgaggctacgtgctggatgcttcgaccactcgactcattgctaggcattgtgactgactctgcagaattctacataactggcgcaatcggactagtacgagtcgactacaagtgactggccggtctattacaacggtggtagtggccaatagctcgaggtaccgaacttaggaggttta

SEQ ID NO: 627657 - DNA, 473 bp, Homo sapiens
  misc_feature (10)..(10): n is a, c, g, or t
  misc_feature (36)..(36): n is a, c, g, or t
  misc_feature (62)..(63): n is a, c, g, or t
  misc_feature (84)..(84): n is a, c, g, or t
  misc_feature (99)..(99): n is a, c, g, or t
caaaaacggnaatagccaaaaaccccaataatccanttttagggttaacccccaagaatatnnattggttaaaagattaagaancatacatttttgccncctttatatattcagattatgtataagaggaatttaggggaatatcatatagtggcctaagtgcacaggctttggaaacagatttcctgaattcagattcaaatgtcacaatttgctagctgcatgattttgagcactttagcttcactgtaggggataatgggacccacattcccagggttgtcatgttgtttaaatgatataaaaagtttagggccagtgtagtggctcatttctgtaatcccagctacttgggaagctgaggcaggaagatcatttgagcccaggagtttaaggctgctgtgagctatgattgagctactttgctccagctctgggcaatagagtgaaaccccatctcttaaaaaaaaaaa

SEQ ID NO: 627658 - DNA, 349 bp, Homo sapiens
  misc_feature (204)..(204): n is a, c, g, or t
cgtttgaaaactatggcaaaggataggagtggggttcacacagctaagtctgaagggaaacgggaagcagcaaccacctctgcacctcacgctttgtctaagagtgggttcatgtgacttgtggccaccaaaactcatagggccgtgtccctcaggtgcaatttgcagtctgctcctagtgctatgccaagcctttgccagagnagcagctgttgagggttgtgagcaaatgacatgtgaacatgcagatgtgccagttggatgggactgttgtgggaacatgggccaatgggcagctctatggggcttgacttctcaagggctcttgaatcacggtgttgtgtgttgt

SEQ ID NO: 627659 - DNA, 957 bp, Homo sapiens
  misc_feature (413)..(413): n is a, c, g, or t
gggctctctgatgcaggcggggagagagaccagagaatgggagcgacgtttgggttgtggagtgtgtcgggactgagtgagggaagggctaagttaagggtgtcaaggtacggtctgagtgaaggtaggggatgtgcggaaagggaacggagccatgagagaactagggggagaggagtacgcgtgagatgtgagaggcaagtttatttccctagatgcactgccttggtcgcgcaggtaaaaccgctgaaggaaagggtgcgatcttccacgtaggggaacctcacgaacggtgaaaacacttgcgactggccatgtgagccaatctggcccaggatcagaaacttggccctgggggacacgtgtcggtgtgatgacgacctgtcggacccagggaattagccaggacgtgnagcaatattgtccgccgcaagaattcgttgtagttgagccatcttagtggtgacgggaaagggtgccgtgtcattcaaattccagggggaatccagggatacacgggcaggaacacccctgaaatccgtgtgggcgtaaacctgcatggagtttgcccgatggtccctaattgtggacacgaagcgagaggagggtattgacctccaccagggattcaggaattgtattggtcactcgtgtccacttaggatgggtcgacgacattaaggtggatttaaacccccgcgcaatggaaatccgaatgcggtgagttaaaaccttggggagaaagacttgccacgcatggctagttttctttttcccacgggttggggacttatacgaggaagattacggacattctgggcactgggctatggtatcgttggaattggaaatcgagtaggtggtgatgtgacatttataattagcgcgcgaagaattcaaggcaaggggcatattggaatcaaaggatattgctaagggggaatgggacttggagaa

SEQ ID NO: 627660 - DNA, 375 bp, Homo sapiens
aagggaagttatgtacatacatggggaaggatgtacatgagatgcgtagaagtaagggcacgatccatgaatagtgaactgaagggcggagatcgccgactaacaaagcaaaaccccttgctacatgggcaccacaagaactgaggaaactgaagaaccaagcttgatctgttaccattgggatgataacctgaggacccccactggaactctcccatcttttgaccaacctggaactgaggagtgtgcaccggctgctgaatgtctgggactgagcggatgagtgagtgacggcttgaacacacaccacattgccactcctgccacagcagcagccgccgccgccaacagcagcgctgtacgtgagctacgtac

SEQ ID NO: 627661 - DNA, 229 bp, Homo sapiens
cgatggccatggagtattatacactatcaaagtttctagagctaataacagctcagttctgcccaactcctacaagtagtgggtggaattacgtgaaaggttaattgccaacactcaacagagagcagccggatcagctgacacagccacaaatatcttggaaagaagaaacttcagtggctggtaagggtatagtttcatactatctggctatccactcaaccatcca

SEQ ID NO: 627662 - DNA, 801 bp, Homo sapiens
ctaagacagtcctatgtgaaccgtcacgagggtgcactagtttgaaagtaataagcaacatgaaccccagcctgtaaactcagattctgagactatgtacctcaggaaatatacagctcatgggagtcatacagatgtggatagtaatgatagataattacttacaggtagggaaatgtaaacagatcttatcggcaaaatgataatgacaggccaaattgttaaaggtaggttaaaagtagacagcatggtgggaaggttaatcagagtcaaaatgtttcagtgttcttacatttattgggagtagccacgttacatatcaacttagtcttttaaagtatgcatgataacaattccgcaggttaattgctcaaacagtatatcataatcctctaaacatgcaataagtgcatgcagcagcatggctggcgcatacatagggacagcacacccaacatatctaacatctctgcaggaaaatcaagccataagcaaacaggtgcgcctcaacaacaaccagatgggcaaaacaagtccaaatagatcagctaattacaactaaatgctctacacgtatactaaactaggccccaaggaacaacattgcaattcttaacaaagcaaaaccccccaaattcataatggctggtataacaggaaaacacaaacttccacctcaaagggaccatataacgttgttcctgccagctggtgatgtaccaatactacggtgacttgtactaataactgttgcattacacaaaggctgatgtccaaagaaatgtcctttatgatactcca

SEQ ID NO: 627663 - DNA, 1108 bp, Homo sapiens
gggctggggggagctgcttggcggtcgggcggggggagcgcggcgtgcccaagctcgctcggcacgcgccccgcccctcagaggcctggctcccgcacgcaccgtgcagcctgctgtgccctgtgggtcccgagtgctccgccgccctgcccctgagccggtgcccagccgcctccacggccctgcgctcgtactggagcgaagagctggcctcctgaaggaggggaacgggacgtggtgggcgggcacggcaggattaaacctccatttcagctaaatcatgggagagattaaaagtctctcctgattataactgcgtttacgagggtaccaagttccccttaaaaaggattattgtggatgatgatgacaggaaggatatggtcgactctatgacgcgggcacacccggaaagtattcagggtgttcctcatcataattccctggccccctggtagactggcaactgcacagcaagtgacctccaacccgcgcaaggactttatcacggcagcttcctatgaactggcattgccgaggttaaacaggaggaaaacacggcgatatagcgacggcaatcccaagcccaagtacagggagcaccaatacatcgacagttcatgctggactgcaatatcagaacaaaagtataagaacccatttaccagcagccatacagggtttcaatacgttataaaggagcagcacatacataaacggaagacctaacaagcaccccaagaaacagatctgctcgacataccaattcaccaaactagtaccttagaagctcccatatacactaaatcccatcttaacattaccattcacaatcgacaactcatacactcccacaaccaaacacttgtgagctggcaacacagcaatatggaccagtagcttggattataaggacccacggcacaacataggtccattggagcaaacacacacagagggcgcgccgtcgacccaaataagttaagcacaaaggcgttcgatagacatgggaatacaccggcaaaaagccgacgggcgcagaactgcccacgcatatcagacaatacctgtgaatcggcacccagtccatggtgaacacaacatcaca

SEQ ID NO: 627664 - DNA, 622 bp, Homo sapiens
cggacttgtcagtaggcttctgtctctttagagccgagaaaatagtaattaagtggcctagatataggaagggcaggaataagcacttactccccctgaccttccaatgatgaacaggagaagcagtgccaaatcctcaataattgcaagtcctgatgagaagtgatcttgtgagaatgcagcagaacacgataggtggatctggatagacgtcttgactctattcaaccggtacgtctcgtgatctggacgagtgccagattaaggtaacccacgattgttagacaaccgtcttcctgctgagccaaagtttgctcattacccctccactggggaagcagctgaggcccagggccttgctccctgggaaattctcttactctccgatctttcggtgctattggaccatgttactgtgccaaagtgtcttaatgcttgtcccatctatactcagcttggccttggaacccacataggagttggtgggggagggatgggtagatgggtattattcattgtatgttgatccaggtgtgtgtattatatatagagacccctcgccttattgtggtgtttgtccatccctcttccttaacaggattgaaatatatatgcttctgtt

SEQ ID NO: 627665 - DNA, 176 bp, Homo sapiens
ctcggtcctgggctccaaagtgctgggattacagattgagccactgcacccggcctaaatacatcttgatgaaggtttcatggaggatgagagatatgagctgggccttggatggagcagtctccacacgcttacgacgtgagtgacgggccagggatggagtttctctatcttgg

SEQ ID NO: 627666 - DNA, 539 bp, Homo sapiens
  misc_feature (1)..(1): n is a, c, g, or t
  misc_feature (68)..(68): n is a, c, g, or t
  misc_feature (78)..(78): n is a, c, g, or t
  misc_feature (138)..(138): n is a, c, g, or t
  misc_feature (164)..(164): n is a, c, g, or t
  misc_feature (168)..(168): n is a, c, g, or t
  misc_feature (175)..(175): n is a, c, g, or t
  misc_feature (178)..(178): n is a, c, g, or t
  misc_feature (184)..(184): n is a, c, g, or t
  misc_feature (193)..(193): n is a, c, g, or t
  misc_feature (206)..(206): n is a, c, g, or t
  misc_feature (209)..(210): n is a, c, g, or t
  misc_feature (216)..(216): n is a, c, g, or t
  misc_feature (219)..(219): n is a, c, g, or t
  misc_feature (221)..(222): n is a, c, g, or t
  misc_feature (231)..(231): n is a, c, g, or t
  misc_feature (257)..(257): n is a, c, g, or t
  misc_feature (263)..(263): n is a, c, g, or t
  misc_feature (283)..(283): n is a, c, g, or t
  misc_feature (287)..(288): n is a, c, g, or t
  misc_feature (300)..(300): n is a, c, g, or t
  misc_feature (306)..(307): n is a, c, g, or t
  misc_feature (311)..(311): n is a, c, g, or t
  misc_feature (333)..(333): n is a, c, g, or t
  misc_feature (356)..(356): n is a, c, g, or t
  misc_feature (426)..(426): n is a, c, g, or t
  misc_feature (430)..(430): n is a, c, g, or t
  misc_feature (531)..(531): n is a, c, g, or t
nattgtcgctatggagcgagccggagatgcagctcaaggggaagaaagtggtccatgctgtggacggnaccgccgagnaacgggatccaccccctgagctcctccgaggtggacgaactcatccacaaagcggacgangtcacgctgagcgaggcagggtccangggncgggggnggnagaganccggggggntgtggaggggggnagnncgggancangnnctcccgggngggaggatcaccggtggtggcgaggnagaggnaggggagggggagggtgcgngggnnggggggggatgncgaggnngggnagggaggcgcgcgcgcgggtgnagaatggatgttgcatggggttnagccagaagaatgggaggatggaggggcggaggaggaagaaggtggtgggggcgtgtggcaagatgaggnatgnagggggcggagctgggtgggtggcatggcgaagagcggcggggtggaggcgcgcaagggagggtgggcaggcaggcgcaagcggggagtgggtgggcgcgnagggtggg

SEQ ID NO: 627667 - DNA, 302 bp, Homo sapiens
tccataccccagagaaaggaagacagtatgctgaatgatccgtttagaagtttacaatgaagtatgcttctaatactgctcctggcaggccactgcttctggagctcttcccctgaacagctctacaagcctggaaaaaaataatgtgctattcggtgaaagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacat

SEQ ID NO: 627668 - DNA, 684 bp, Homo sapiens
taccatacaatttttcacactgctcatgtgaggtgacagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtcctcttccgcgtctgcttccgcgtcgggcccgggcggggcggggcggggcgtggagccgcgccgcggcctgacgtcacccacacctccctgggactgcgtcactggtgcgcgccgcgggtcagggcgcaatggcggcgctgggcggggatgggctgcgactgctgtcggtgtcgcggccggagcggccgc

SEQ ID NO: 627669 - DNA, 918 bp, Homo sapiens
ggctgccttttctctttttttttaagaaactgatgttattttccatcaaccattttccatgctgccttaagagcctatgcaaaaaccgttaagaccagtcaggggttgctcctacccattacagtggcctgagcacgtgggagctgcagaccagtcttccgggggcaggctgagcgctccagtcttcatctagggaatggctgaataggcacagagggcaccggtacaccttcagaaccagtctgcaacctcaggatgagatagacagtgaactcaggagcgggagcagcaccattacaccctgaaatccctcctgtggtcacgggcttctcagagagacagcgtggtcttcttttcaatctcttacaggatctctgtagaagtacagatcaggcatgacctcccagggggtgtctcacgggacacgtggtgccacgcatgcgcagaactttccagagccagcatccaccacatcacacccactgaagtgagctccctatgtagtcgcatgggatggcaatgtacacatagcgcagaggagaaatctgtgtcaccaggcaaggaacgtaggaaacataacaatgcccctgaagggctggggtccaccctggggtcagccacccacaagacagccgtgattcccggaggttgccgggaccgggatagtcaaggctccagcagtggacaccgccaccatggagtgctcccggggcagagaacactcacacagccctcggcagcttctcggcggtctaccctgacaccgccaggtctcatgcaaaagggagacgtggcaaaaagcaccgacccagatacaacagatcccactccaaaactcggccgccgacaatggcccacagcccgagaaaagaacaactaggaaagcggagacacaaaggacaactaccaagaaaacca

SEQ ID NO: 627670 - DNA, 491 bp, Homo sapiens
taccatacaatttttcacactgctcatgtgaggtgacagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcacca

SEQ ID NO: 627671 - DNA, 109 bp, Homo sapiens
atctgtcactttgcagacccctgccatctcagatactcggttcaagtctcactgatttgtagaggtccaaaaatgtaggatctgtcactttgcagacccctgccatctc

SEQ ID NO: 627672 - DNA, 795 bp, Homo sapiens
  misc_feature (38)..(38): n is a, c, g, or t
  misc_feature (65)..(65): n is a, c, g, or t
  misc_feature (83)..(83): n is a, c, g, or t
  misc_feature (94)..(94): n is a, c, g, or t
  misc_feature (121)..(121): n is a, c, g, or t
  misc_feature (130)..(131): n is a, c, g, or t
  misc_feature (139)..(139): n is a, c, g, or t
  misc_feature (149)..(149): n is a, c, g, or t
  misc_feature (164)..(164): n is a, c, g, or t
  misc_feature (170)..(170): n is a, c, g, or t
  misc_feature (181)..(181): n is a, c, g, or t
  misc_feature (190)..(190): n is a, c, g, or t
  misc_feature (194)..(195): n is a, c, g, or t
  misc_feature (198)..(198): n is a, c, g, or t
  misc_feature (205)..(205): n is a, c, g, or t
  misc_feature (216)..(216): n is a, c, g, or t
  misc_feature (232)..(232): n is a, c, g, or t
  misc_feature (242)..(242): n is a, c, g, or t
  misc_feature (250)..(250): n is a, c, g, or t
  misc_feature (252)..(252): n is a, c, g, or t
  misc_feature (254)..(254): n is a, c, g, or t
  misc_feature (259)..(259): n is a, c, g, or t
  misc_feature (262)..(262): n is a, c, g, or t
  misc_feature (265)..(265): n is a, c, g, or t
  misc_feature (267)..(267): n is a, c, g, or t
  misc_feature (272)..(272): n is a, c, g, or t
  misc_feature (274)..(274): n is a, c, g, or t
  misc_feature (277)..(277): n is a, c, g, or t
  misc_feature (281)..(281): n is a, c, g, or t
  misc_feature (295)..(295): n is a, c, g, or t
  misc_feature (298)..(299): n is a, c, g, or t
  misc_feature (302)..(302): n is a, c, g, or t
  misc_feature (304)..(305): n is a, c, g, or t
  misc_feature (311)..(311): n is a, c, g, or t
  misc_feature (314)..(314): n is a, c, g, or t
  misc_feature (316)..(317): n is a, c, g, or t
  misc_feature (319)..(322): n is a, c, g, or t
  misc_feature (324)..(324): n is a, c, g, or t
  misc_feature (331)..(332): n is a, c, g, or t
  misc_feature (338)..(338): n is a, c, g, or t
  misc_feature (341)..(341): n is a, c, g, or t
  misc_feature (343)..(344): n is a, c, g, or t
  misc_feature (348)..(349): n is a, c, g, or t
  misc_feature (361)..(361): n is a, c, g, or t
  misc_feature (364)..(364): n is a, c, g, or t
  misc_feature (366)..(366): n is a, c, g, or t
  misc_feature (370)..(371): n is a, c, g, or t
  misc_feature (374)..(374): n is a, c, g, or t
  misc_feature (376)..(376): n is a, c, g, or t
  misc_feature (378)..(378): n is a, c, g, or t
  misc_feature (380)..(380): n is a, c, g, or t
  misc_feature (385)..(387): n is a, c, g, or t
  misc_feature (389)..(390): n is a, c, g, or t
  misc_feature (397)..(397): n is a, c, g, or t
  misc_feature (399)..(400): n is a, c, g, or t
  misc_feature (403)..(404): n is a, c, g, or t
  misc_feature (409)..(410): n is a, c, g, or t
  misc_feature (413)..(414): n is a, c, g, or t
  misc_feature (421)..(421): n is a, c, g, or t
  misc_feature (423)..(424): n is a, c, g, or t
  misc_feature (426)..(427): n is a, c, g, or t
  misc_feature (429)..(429): n is a, c, g, or t
  misc_feature (431)..(431): n is a, c, g, or t
  misc_feature (435)..(435): n is a, c, g, or t
  misc_feature (437)..(437): n is a, c, g, or t
  misc_feature (442)..(442): n is a, c, g, or t
  misc_feature (448)..(449): n is a, c, g, or t
  misc_feature (451)..(451): n is a, c, g, or t
  misc_feature (454)..(454): n is a, c, g, or t
  misc_feature (460)..(460): n is a, c, g, or t
  misc_feature (463)..(467): n is a, c, g, or t
  misc_feature (469)..(469): n is a, c, g, or t
  misc_feature (478)..(478): n is a, c, g, or t
  misc_feature (501)..(501): n is a, c, g, or t
  misc_feature (504)..(508): n is a, c, g, or t
  misc_feature (511)..(514): n is a, c, g, or t
  misc_feature (516)..(516): n is a, c, g, or t
  misc_feature (518)..(518): n is a, c, g, or t
  misc_feature (520)..(523): n is a, c, g, or t
  misc_feature (525)..(539): n is a, c, g, or t
  misc_feature (542)..(544): n is a, c, g, or t
  misc_feature (546)..(547): n is a, c, g, or t
  misc_feature (549)..(549): n is a, c, g, or t
  misc_feature (552)..(557): n is a, c, g, or t
  misc_feature (559)..(559): n is a, c, g, or t
  misc_feature (561)..(561): n is a, c, g, or t
  misc_feature (563)..(563): n is a, c, g, or t
  misc_feature (567)..(567): n is a, c, g, or t
  misc_feature (569)..(570): n is a, c, g, or t
  misc_feature (573)..(575): n is a, c, g, or t
  misc_feature (578)..(578): n is a, c, g, or t
  misc_feature (583)..(584): n is a, c, g, or t
tccctgtttttctgtctcgtttgtgcgacgtgctgtgncttggctggtttttctctggcgctttnctttgccttttggctggncttgcgttttncgcctttgttttctgccgctgcggacntgttggccnngtgcggcncccgtcgctnggtgcgtgtgctttngttttncgtggctgctncttcttgtncgtnnccngcgtctncggcggttggnccctctttttgtggcncgggttgccngcgctccncncncctcnttnctncnccccntnccncccntctttctttctctncgnnccncnncctttnttncnncnnnntncttttcnnttcccnccncnntccnnctctcccccccnccntnccgnnctngncntnctccnnncnnttctccncnnctnntttcnntgnnctccccncnncnntngncccncnccccncccctnntnccncggggncgnnnnngnctcgctgcnctgggcggtgtggggtgtgggcnggnnnnncgnnnntncncnnnngnnnnnnnnnnnnnnnccnnncnngnggnnnnnntncntngtcncnnccnnncgncgggnncggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcacca

SEQ ID NO: 627673 - DNA, 885 bp, Homo sapiens
ggctccacggtgcagagctctaagcgcgcgggctggacggctgcggcgcgtcaaggtcagcctggagctggagtggcggactgcctgggggcgggggaccctactggaggcccagggctgggtggcctcccagcgcctcgtgccatatttgaatagcttcgactggaccgctctttgtactgctgaagtcctgtcccaagttccagcctgctgtccctgagtggcctggggcaaggaagacagtcggctggcaagacccgagagaccgccacacaacgttgtggaccgggggcacaacacagtgataccccacgacttgagatgtgggagcacataagaagaccgatgaggactgcacactcgccccgcgcggcatcagcggtaggcataccttggaaaattggacttacccccaagtaccttggttgggggagccggactatggtacaaagacgtggtacctgtgtttgccaggcgaagaagcatttggcagggacgatattgggcatcgggtaccgcgtgagacatagcgggagcgttgacgaccgtcataccgggttcacgccgactctgcagtgggaaagagtccgctcacacaataccaggtagcccccatcaccgtcacaagtaaccttacagggggctacacaaggtcacagtctagcagagatagcgacgaggactcaagtttggcacccaccgatcaacaccacgagggagtagttccatacacccttcgtggcacgaactcctattaagagatgaacattcagtcaggaaggatcaagagggcgcaaacaggttgtgcaagagaggcattggggttaccacacttgggagaggcatatccattggaccggtaataccgcacgaactatggacctt

SEQ ID NO: 627674 - DNA, 197 bp, Homo sapiens
agcgacacggtatgtggatgtggcttatcaaatgagagcatcactgccggcaaaatccaggcttgctgggggaggaagctgacagggcaaaccaccgcggaaggacacggttttcttggcggggggcagacagagttgacatggggcagttctggcttataacatgttcagtgctgacgtgtaacaccaccagtacg

SEQ ID NO: 627675 - DNA, 106 bp, Homo sapiens
actggacagcacagaggaggtggagagacagcccacccttgtgtccactgtgacccctgttcccatgctgacctgtgtttcctcctctgtggcctcctctgtgctg

SEQ ID NO: 627676 - DNA, 80 bp, Homo sapiens
  misc_feature (77)..(77): n is a, c, g, or t
taacagttcagacagctttatttttatcaccagagttttaaataaatacacagttccatcagaccagcccccgagtnccc

SEQ ID NO: 627677 - DNA, 150 bp, Homo sapiens
taaaattgttgttttgaatttgttctcttaatttaggggggagtggtcataaggggcaacaaacaggcaatgataaggagagcaattaaaaccatattgataagcattcttcttcctagcaccagttcactccatatagctagaggggca

SEQ ID NO: 627678 - DNA, 360 bp, Homo sapiens
  misc_feature (255)..(255): n is a, c, g, or t
tcagtgtaggagaaaaaaatccatatttttatattagcatgcgcactataaccaaaaattattcatacttaaaacattcatacaaaacaatatgtgagcagaaatagtgctataatactttgcctaatttctaagttgaagaataacacttgggcacaggttttttaataagagaaatatccggatattccaaattaaaggaattttcttccaaccattgaaattttaaaaccagagttccttttaaataataanccagattttttcttctattaaatattattattaagaattgtttttgtattacatattcatgttaagaaccccgtcttcccttaaaatacattaaaattatgacaa

SEQ ID NO: 627679 - DNA, 275 bp, Homo sapiens
tccgtcgtctaacccaggatacagctttactcggataccagttccactcggcggtctgtttagatcgccagaatcccgcgtttcctcctcgggtctctgtcaccacagtgctgcctctgctccgcatgtgctctgctacgccggcgcgctcctcttccagctgtgccactcggccctggagctccccatattcgcgggcgctctgctgctgtagctcctgcactttctgcagctcctgggcccgtgcctgcagcatctcatcctgccgcgtcacc

SEQ ID NO: 627680 - DNA, 228 bp, Homo sapiens
  misc_feature (2)..(2): n is a, c, g, or t
anatggattggatggatggactgggactggactggatggatggacacggatggatgggtggatggatgctggaaaagtgagatgggaagatgcctcctccagaaagagccgccaacaatccctcgcaagccatctccatgtgactgggcgccacactagagcaggcggactgtctccatggtatcggacatctacagtgacgattcctcactcccaggtgactgtacc

SEQ ID NO: 627681 - DNA, 773 bp, Homo sapiens
ctctcctttgccgatccgccgcccgtccacacccgaccgtccagctcaccatggatgatgaatatcgcgcggcgctcgtcgtcgagcgaacggctccgggcatgtgcaaggccggtcttcgcgggcgacgatgccccccggggccgctcttcccctccatcgctggggcgccccaggcaccagggcgctgatggtgggcatgggtcagaaggattcctatgtgggcgacgaggcccagagcaagagaggcatccatcaccctgaagtagccccatcgagcacggccatcgtcaccaactgggacgacatggcagcaaagatctggcaccagaccttctacaatgagctgcgtgtggttcccgaggagcaccccgtgctgctgaccggaggcccctccgtgaagccctgaggcctaaccggcgagaagatgagctcatgatcagtgtgtgagatcttcatacaccgccaggcatgtacggtgtggtatgcaggctgtgcgatccctgtgcgcctctggccgtggcagtggcctcgtgatggactccggtgacggggtctgccagactgtgcccatctgcggaggggtatgcccgccgcctagtgtcatcctgctgtcgtggatctggctgggcgggacctgtgctgctactcatgaggatcctcacgaggcggttacagcttgcgccacggacgagcggaaacgggcgtgcttggggactggtcgtgcctgggtgggcgaatgccgtggtcgcccgggaaggagtgggcggttc

SEQ ID NO: 627682 - DNA, 515 bp, Homo sapiens
acgctcaatggtgctgttgcccggtccagggggagtttgattgctccgttcgggtctgacgatattatgttgcccgagcgcatagcaatccaggtcgcccatatggacggtaaacccgaggtagggatctgtgctggcaatatggaactgatcgatagcgatggcaatcctttccccgagaagcgcccgtgccgggatgtgccattccgtcgcttggatttcgatgacatgtttcttgatcgcaagccctatccgcctgcgcctaccttgctgattcgacgtgaggctctggagaaggtgggtggcttcgacccgacgatccgtctggaggacctgctgatcgagttgaagatcacgcacgccggttactttatcgatgcgctcggggtgtcgatggccctctatcgtaaacacgccagcaattcatccaagaatcatcggtttatgatcgaggctattctcaagacctatgccctgttcagtgatcacgctgcgtcgacgcggccgcgaattta

SEQ ID NO: 627683 - DNA, 205 bp, Homo sapiens
  misc_feature (8)..(8): n is a, c, g, or t
  misc_feature (10)..(10): n is a, c, g, or t
  misc_feature (13)..(13): n is a, c, g, or t
  misc_feature (52)..(52): n is a, c, g, or t
  misc_feature (54)..(54): n is a, c, g, or t
  misc_feature (82)..(82): n is a, c, g, or t
  misc_feature (90)..(91): n is a, c, g, or t
  misc_feature (94)..(94): n is a, c, g, or t
  misc_feature (97)..(97): n is a, c, g, or t
  misc_feature (103)..(103): n is a, c, g, or t
  misc_feature (112)..(112): n is a, c, g, or t
  misc_feature (152)..(152): n is a, c, g, or t
aacaaccntnttntgttctgtgtccctttaaaaggcagattaaaagctcaancntgtttctagagaacagttgagagagaanctcaagannctnctnggtggnttgcttgcnctacgttacaggtggggcatgtcctcatcctttcctgccntaaaagctatgacactagaatctgaatattaataaaactttatgtactgctgt

SEQ ID NO: 627684 - DNA, 337 bp, Homo sapiens
gacattgggcctgaagaatctcattaaggttaatatcctgccgcttattaccgagaaattaaaactatttggggccgggcgcagtagctcatgcctgtaatcccagcgctttgggaggccaaggtgggcaaaccacctgaggtcaggagttcaagaccagtctggccaacatggtgaaaccccgtctctactaaaaatacaaaaattatccaggcatggtggtgggcacctataatcccagctactcaggtggctgaggcaggagattcgcttaaacctgggagacggaagctacagtgagcagcgatcgcaccactgcactccagcctgggtgaca

SEQ ID NO: 627685 - DNA, 246 bp, Homo sapiens
tggggggtaaaagcctgggggggaataggggggccccagcccaggttttgcccagcccaggacccccgtcccccccgacgggggacccccgggccagcccagacctgcaggccccgctgggaccccactcggggggggtggggcaggccgggcggaggaagggccgggggccctgagggggccgccccccccccgcagccccgggggttttgggggcttagggattttaagggaataaactggccg

SEQ ID NO: 627686 - DNA, 787 bp, Homo sapiens
  misc_feature (787)..(787): n is a, c, g, or t
gcgcccttttttttttgttttatgtgtgggtcgtgcaggtagaggcttactagaaagtgtgaaaacgtaggctgggattaaggcgacagcgattcctaggatagtcagtaaaattagaatggtgaagatgataagtgtagagggaaggttaagggtggatatggctaggggtggcgcttccaattaggtgcatgagtagggtggccgtgcagtaagttgttagcggttaggcgtacggccagggctatgggttgaacccacgcgtccggcaatcccctcaaaaaaaaaaaaaaaaaaaaaaaaaaaaaaaaaaaaaaaaacaaaaaaaaaaaaaaaaaaaaaaaaaaagggggggggggcaaaaaaaccccccgaggggggcccacaaattacagcacgccacccccatcctcgttgggtctgacaacgagcggcggcccccaagaagagagcaggcgctataatcaatacaagccgcagcgcgggcgacggggagccggaacaaaaacaccagcgcgcgcggcacggggagagcaaacccagcgctgcccgcaggcgagacatctcgtgagggaagagccaacccccacccatcgggggggggggagcaacacgtgcggggggaccacccaccacccacaagaaaattgaacccgccccggggcgaataacaacccgcagcgcgcatctgaggcgtcgaaccccacacgaccacatgccggccgcagaaaactcgccgccccacgatatacgcgaaccacatacccgtggcggccatgaaatatan

SEQ ID NO: 627687 - DNA, 391 bp, Homo sapiens
  misc_feature (39)..(39): n is a, c, g, or t
caacccggcagccccactccccaggcccctagtaactcntgccaaaggctctctgactgactccttcccagatcttcctcagttagcagctgaagactgatgctgcctgatcgccttggaagccccctggaccattacggatgctgcgctttggataactcttacagtagaggttccacctggcctaatcgccattcaccagcaaagattcccaactatatgaagacaccctagctggacgatcagttcttattaagaacctgacccctcaaactctacaacctcgatggactggaccctacttagtcatctatagtaccccaactgccgtccgcctgcaggatcctgcccactgggttcaccgttccagaataaagctgtgcccatcgga

SEQ ID NO: 627688 - DNA, 367 bp, Homo sapiens
ttcttccacctccgtctttcaggttcaagcggttctcttgcctcagcctcccgagtagctgggattacaggtgtgtgccaccaccgctagctaatttttgtatttttcatagaaacgaggtttcacggtgttgcccaggatggtcttgaactcctgacctcaggtgatccgcctgcctcggcctcccaaagtgctgggattataggtgtgagccaatgtacctggcccagctaatttctgtgttttttgtagagatggggttttaccatgttgcccatgtgggtctcaaactcctgggctcaagcgatctgcccgcctcagcctcccaaagaggcataaaacacagtgcttggccgtgttttaaact

SEQ ID NO: 627689 - DNA, 244 bp, Homo sapiens
  misc_feature (147)..(147): n is a, c, g, or t
  misc_feature (150)..(150): n is a, c, g, or t
  misc_feature (163)..(163): n is a, c, g, or t
  misc_feature (172)..(172): n is a, c, g, or t
  misc_feature (198)..(198): n is a, c, g, or t
  misc_feature (206)..(206): n is a, c, g, or t
  misc_feature (220)..(220): n is a, c, g, or t
gcctgctgtcaaaaccctggtgggggaggatgtggccccccttaaacccggaggaaacgggggtttgcctgggttttcggaaaaccgcttatgggtgtggtccgtccaaaccccttgtttcaagggggatgggggtgagcgggcaancanagcatcccccccnctgagcaanaacttttttttgtttttaaaccatcncgtcctcntttcccattggaanaaagtgagtttttgaaacctgcga

SEQ ID NO: 627690 - DNA, 755 bp, Homo sapiens
  misc_feature (145)..(145): n is a, c, g, or t
  misc_feature (695)..(695): n is a, c, g, or t
  misc_feature (714)..(714): n is a, c, g, or t
cctatcccttaggtttccagacctgagggatccccagtaaggctgcaaactgcaaagaggacagctgccccttcctctgggagctctgcccagaggggtacagccctggttggggcccaaccacccagggtgtaggtggtgctgnagacactggttggagggtctcacccagtataaagcagctgtgctgtgtgggtgtaccacttctgcccctagttagcttgggctctccaaagtctgtaagctacggaagttgctgagacagaaaaaatggcagccccctcctccctctaggagctctgtcccaggaagttttcaaacctcttagccacagaacatccatgggagtgactggaggacacagttgggaagtcccgccctgcaaggaggaatagatcggggactgcttaaggaagcaggatggccatggtttcatagagcagctgtgccgtgctggggtactgcttctgccctggtgggcgtgggctctccaaagcccacaggacagaatgctgagttgcccaaacagcaacgatggcgcccgcccacctccccctgggaactcagtcccagggtgaaatcaaaacattgtgaaccagagaatacaagtgagggtggctggagggtccagtcgggaggtcctgctcagagatgaagaacggatcagggttctgcttaaagaagtagtcggccantgttgtattagagcagctngtgttgtgttgggggatcccttctgccctgctcggtttgga

SEQ ID NO: 627691 - DNA, 122 bp, Homo sapiens
aggtatgaccccacgagaactcaccttattcttcataccgcctggtgaatcctccagtctttctctacaccctgaaggggagggaggcaaatggataaatgagagagggagggaacagtagc

SEQ ID NO: 627692 - DNA, 155 bp, Homo sapiens
gtgaactggaatgagtgaccttgagctctgtccttttgggaattttggcttatctccagtaaaactagaaggctatgctcttgttgtaccggacttctccaaaaatttgtgatgcgttttgttgatttttgcctaagtcgcccttgttgctgttg

SEQ ID NO: 627693 - DNA, 454 bp, Homo sapiens
acaaaagggctcctgctggctcttgtcataagacgaggttctctgaaagttgtcactcagtattttcacgtacaccccattggcaaaaatatagtctcatgaccacagatagctgcacagcaaccaggaaatgaagtctttattctgggtattcctaggcccacttaaaaaacaggagtctggctgggcgcagtggctcatgcctgtgatcccagcactctgggaggccaaggtgggtggatcaggagtttgagaccagcctggccaacatggtgaaaccccgtctctgctaaaaatacaaaaattagccaggcatggtggcacatgcctgtaatcccagctacttgggaggctgaggcgggagaatcacttgaacctaggagacagaggctgcagtgaactgagatcatgccacttcactccagcctgggcaacagagcaagactccttctcc

SEQ ID NO: 627694 - DNA, 118 bp, Homo sapiens
actctgcatttggtttcaaggtggctcccttcggttgatctgaacgtcaacagtaatgaaggcaagcagaaaaagcgaggaggtggtggcggatttggctaccagaaaaccaagaaag

SEQ ID NO: 627695 - DNA, 143 bp, Homo sapiens
ccagaacacaatgaacgaaaatctgttcgcttcatgcatgcccacataatcctacggctagccgccgcagtactgatcattctatttccccctctattgatccccacctccaaatatctcatcaacaaccgattagtcattgt

SEQ ID NO: 627696 - DNA, 381 bp, Homo sapiens
agcttgtagtcccaacactttgggaggccaaggcagggtgatcacttgaacccaggagtttgagaccagcctgggaaacatggtgaaaccccacctttacaaaaaatagaaaaattagctggccgtggtggcatgtgcctgttgtcccagctactcaggtgagcttcccaggaagtcaagctgcagtgagccgtgatcatgccactgcactccagccaggagacagagtgagaccctgttttaaaaaaaaaaaaaaaaaagactgttgtataagtcagtgcagtttaaaaagtataatttgtccagaagcagaggttgcagtgagcggagatagcaccactgcactccaccctgggagaaagagcgagaccctatctcaaa

SEQ ID NO: 627697 - DNA, 553 bp, Homo sapiens
  misc_feature (6)..(6): n is a, c, g, or t
  misc_feature (151)..(151): n is a, c, g, or t
  misc_feature (172)..(172): n is a, c, g, or t
  misc_feature (180)..(180): n is a, c, g, or t
  misc_feature (238)..(238): n is a, c, g, or t
  misc_feature (299)..(299): n is a, c, g, or t
  misc_feature (330)..(330): n is a, c, g, or t
  misc_feature (412)..(412): n is a, c, g, or t
  misc_feature (435)..(435): n is a, c, g, or t
  misc_feature (467)..(467): n is a, c, g, or t
ggcacngaggattgaaacaagcttgaatttctggaataagcccaatgtgatatttattcaacaaatattcattgagtatacctagtatgtaacatgctttaagaatacaccagtgaaccaaacaaatatctgacattacagaacttaacantccagtatttggagacagacnataaaaangtgaacatgtatatttacagtttgtcaaggaatgataaatgaagactcttaaagtagntggggaattgggagtgaagtctgtaatttaaatagggtgggcaggaaagcttcacagagantgggacatttaagaatagacttgaaggacangcaagagcaatctctatgtttatatgggagaaaaggttccaggcagatgcagtaacaatggcaaatatcctgaagtaggatnatgctggagtttttgtggagcancaaggaggctagtgtgactgccacagaatcanccaagggaagatgagaagatcagaccagaccagcacttgggcatctaatgggaaaagtttctcaagccatcataaaaatttcactt

SEQ ID NO: 627698 - DNA, 202 bp, Homo sapiens
  misc_feature (4)..(4): n is a, c, g, or t
  misc_feature (81)..(81): n is a, c, g, or t
aggngtaataaatactgcatcctttccacaacatagcaggaatcttatagggaaatccatatagtttctgaacatgtattnatatactaagtctatattgtttctttacgaagtgtaaataagtgctgcaccatactgtaaacaaaactcgaatattgactaaataaaatcaaaagttcatcttgtagtcatgtctttctcc

SEQ ID NO: 627699 - DNA, 113 bp, Homo sapiens
gggaagcagcacttggtggtgcctccaggccaaaggcctggacccgcttttccctccttgggcctcctttttttaattgtaacaggggttttttgacccttcccatggttttt

SEQ ID NO: 627700 - DNA, 136 bp, Homo sapiens
  misc_feature (78)..(78): n is a, c, g, or t
  misc_feature (112)..(112): n is a, c, g, or t
  misc_feature (123)..(123): n is a, c, g, or t
ctcatcatcctaccatctagaagtaaatactggttttagttcagagtatgtgtacagatacgtgtgtgtgtgtttgtntgtgtgtttgcaggctgcttggttggtttgagtngggaatagttnagcctgatctggg

SEQ ID NO: 627701 - DNA, 467 bp, Homo sapiens
tcaaaacagaacgacctcacaggcctcagattaaaattgatacaaaaaaaagaaaaagaaaaaaatcattcatgtatttgccagatataatgggaggcccattaccctttgccctgcagagatgtgtggaaagtgtctcctcatacttagatagacagccctgtttgtttaatactgctacccagttttgagtaaactagttatagtcagcagggaattcattcagaagatagattatggaataaaaccaaatttgacatgatgaatatattatttaaactttaaacctaagagatactggtttactgcaaaaaatagcaactaaaaagtattatatagagaaaataatacaatgaaaaactaaaaagtattttatggagaaaataatacaatgaaaaactaaaaatgaaagtaaataaaaaatattaacctcatagcaaggaggaagaatagaatggaaggttttt

SEQ ID NO: 627702 - DNA, 927 bp, Homo sapiens
  misc_feature (637)..(637): n is a, c, g, or t
taaaatgtctaatttcaatttcaagatcaatagacaaactgaaacgtaaaaacaaaatactatgtaggcctgtttgttactaagacttgtctgatatttactaagttagctttatgacgccatgatgatggcctaacagtgtctatagcatctttaactgttagaaagtcttatcatcacatattctttagatattgcagaaaaacgttaagagtttagtcgtgattgtgctctaatcgtgtaaccagagtggctctagaccggaataactgtacaagcagttgttagaagctacttaacagggataatagtacctgaaaactgcggtacaacgttcagggaaaaagcaaagacactgctcgtgcttctaagctcatgaccattagtagccttgattgtgtaccccgacacagccgggaacacattcaatatgcaaggcacgatgttgttcaaccccgtgaaccaaacagtcataatctcatgcagagggatcgacacaggtttgccgaggacaagaggcagacaaaagtgacaattacaacccaagagaacagcgcatagtccctaggtggagatatggggtcttctttaacaaacattgacagatggttacccaaggacgattactaaaggcctnttaacacaggattggaaccacaacatatccagcacatttatggggcgttcaacattggatagtaaacatccaatttgaaggagaaagaagttaaaagatggtttcttagaaaagatataaagaggtttaaaaatggggtgatagaagaaacgaagagaagatgacaagaggatagaaataaaaaagtggccacataggatatagaaggaagttaaagtcaaaatagaaggggatcataagttggataaaagatggtaagaaattatcaaaaaatggatgagaaggcaata

SEQ ID NO: 627703 - DNA, 323 bp, Homo sapiens
cggaggtgcgtgtaatagggaccggctggtcaacacccggtagccaggttctcatgagccgcgcaaaagaagctgtgaagtccggtgcacccagtccaccaagccagtgaccctgacagtggagccgcgccgactcgtgtccgagcggatcacagaagactactactgtccacctcattgctgacaccctgcctgtggccacccggctggcgctctactccacccgagacagcgatgacaagaagaaggaaaaagatgtgcagtttgaacacggctaccggatcggcttcaccgcatgtcaacaagatctacctgcacaccca

SEQ ID NO: 627704 - DNA, 787 bp, Homo sapiens
  misc_feature (1)..(1): n is a, c, g, or t
  misc_feature (180)..(180): n is a, c, g, or t
  misc_feature (192)..(192): n is a, c, g, or t
  misc_feature (368)..(369): n is a, c, g, or t
  misc_feature (403)..(403): n is a, c, g, or t
  misc_feature (405)..(405): n is a, c, g, or t
  misc_feature (410)..(410): n is a, c, g, or t
  misc_feature (436)..(436): n is a, c, g, or t
  misc_feature (453)..(453): n is a, c, g, or t
  misc_feature (462)..(462): n is a, c, g, or t
  misc_feature (464)..(464): n is a, c, g, or t
  misc_feature (478)..(479): n is a, c, g, or t
  misc_feature (481)..(481): n is a, c, g, or t
  misc_feature (483)..(483): n is a, c, g, or t
  misc_feature (486)..(486): n is a, c, g, or t
  misc_feature (488)..(489): n is a, c, g, or t
  misc_feature (492)..(492): n is a, c, g, or t
  misc_feature (494)..(494): n is a, c, g, or t
  misc_feature (496)..(497): n is a, c, g, or t
  misc_feature (506)..(506): n is a, c, g, or t
  misc_feature (508)..(508): n is a, c, g, or t
  misc_feature (512)..(513): n is a, c, g, or t
  misc_feature (519)..(519): n is a, c, g, or t
  misc_feature (533)..(533): n is a, c, g, or t
  misc_feature (539)..(539): n is a, c, g, or t
  misc_feature (546)..(546): n is a, c, g, or t
  misc_feature (553)..(553): n is a, c, g, or t
  misc_feature (612)..(612): n is a, c, g, or t
  misc_feature (756)..(756): n is a, c, g, or t
ntgtctcaagcataaatacaaatcagaaaacagtacaattaggacaatagaatgtggaggacaacaggttagagtaatatataaaacatttttagctggttgaaaacaaagctgtaagaactgctttcacaaagaagtactcctttcaagagtgagaaaaaaaatcaacttaggtttaanatcatatatacngtcctctcagcagttctagttaatgcagtggtgtgtaaaacaacataggcaatacttttgcacataacaatatttgttgatggaaaatctgttagacaagtctggattcatttgttattaaccatgacttaataaaataattgtatcatgatctttttagctaacctatggttttnngctaccacagcccaatgcttgatttctgactaananctganagccttttggtattcacccatctgangatattcttgtattgcnagcctattncngcctggcctgattnncntnctntnnctngngnnctgggggangnctgnnaatagntagatacacatgtnatatgngttaatnttttgtnttggacgatgtctagctgcctgggcctcgcgaaatgagttgatgtcaaaatggcaagtngccactttctgttttaaactaatttatttgtgaaaggacataaaatgaagtttaaagcttagctttcaaagaatattatgggttatgaattctattatcccatctaatttacatacagaggaaatgtactgtaacctgttagangtatctttaacctgaagactgcttgcaaaga

SEQ ID NO: 627705 - DNA, 346 bp, Homo sapiens
ttctttgtgagcttttgtatacttgagcaaatcttaaaagataacttctattatatggagacagtaggtctacaatcatttcttgagctttaatttaaatacaattattatgcctgaatagcaatgaatttgtcataggtagagattgttgcagagccaactatacccatataaaattgatctgctttgctttttaccccgtaaggcattagatagacaataaatacatgtaaggtaaaatgccaaaaatgctaataaacatcagaaagacatttgtacatataattttgtcattaaatgtacttggtaattttttttgctttaataaaaatatttattaactaac

SEQ ID NO: 627706 - DNA, 490 bp, Homo sapiens
  misc_feature (490)..(490): n is a, c, g, or t
ggctgagacttttattagctccactagcgtttttcaatgctttggcctgcagtgtgacgatggtctcggatcacctacgcactaagaaaggtcctaggcgcaccccaaatctcaccacggactcactaactagggcttgtattcatatcaatggtatgggtaagaaggaaaggctgctgcttcactgatacaggacgatccaccttgtccagatgacatgacatagcggagacatgctgcaaaaccaggacggctagaacttgctagtgaagattactataagtgcacttgctcacacgaatgaaggagagcagtgtggactccagccagcctacattcactacacgtgtagacataacagtatctgaaggacatataatctcggactgggcatgacgaacagatcacaaaggccataacggctagcaatgacacaggatgtctactccttaccactcaagctaacgatattgcgaatctgtgccaacan

SEQ ID NO: 627707 - DNA, 122 bp, Homo sapiens
gatctgtcatgctggattgcgaagtcatgtaggaatgtggaccgtggggatcgtcgcttcccctttcccagatgggaactcttggttgccttgcttgaattgcagcttgctcagcgggggat

SEQ ID NO: 627708 - DNA, 198 bp, Homo sapiens
gaggggggttcttcctgtatcggctttgaatttctaattgatacataataatttacatatttatggggtacatatttatcttgttacatgcatagaatgtgtaatgatcaagtcaaggtatttgaggtatccatcactttgaatatttatcattttctatgtgttgggacaattctatttattccattagctactctg

SEQ ID NO: 627709 - DNA, 290 bp, Homo sapiens
cttcaataggttggcaatcctttccatagagtagtgagccttaaaggtctttataatgcccttatttagaggctgagttagagatgttgtgtttgggttcaagtagacccttcaatgcataggtgttgaactcatgaggttctgggtggccaagggcattgtccaataccaaacaaatttaaaaaggcagtctcttactggcaaggtactttctaacttcagcgacaaagtatcagtggaagcaatccaggaagcactctcatttccagccctacttgtggtcaacccaa

SEQ ID NO: 627710 - DNA, 384 bp, Homo sapiens
ctcctgtcagatctgtcagcaggtagaagaggattccctcgtcttctggatgagtcacacagcgtataaggaggcagaaccgggaccagactcagcctgagtttgggactagatagagcatgtcgagggtcttttcacaaaggtgatgggacagaggtcacggagtttcacctgggctcctgccccccacttcttcaccatggcctcatttgcaggattctctgctcctctttgctttgttgccctgtgggtttccagctgctcctatgctcctccctgcgggctacaaccctgacttcaggtgcctggagacttgatgacgggagtgttcaaatctactctgtccctgagagctggcgtgaccttgggcaagttatttaacct

SEQ ID NO: 627711 - DNA, 360 bp, Homo sapiens
tgcttctgctaggccaacttctccatttagaagtgtaaatcaagtttagcctaggcaagtttatgcctccttacatcttttaagtttggcctaaagatttatctgtacatcatgaactataacctaaatggtggtagaaatagactgtaacctactcttgtgccaatcactgagttttggccactcaaagggggccaactgttccagctgagccataaccaatccagctgtttctgtacctcacttccattttttgttcatcactttcctttttctgtccataaatcttctaccacgtctgcactggagtctctgagcctactgtggctcagaaggctccccaattgcagatgaggtggt

SEQ ID NO: 627712 - DNA, 432 bp, Homo sapiens
cagataagtcttttttgttttgtttcgctcgtttgtttgtttgtttgtcttgtttgtttttgagatggagtcttgctctgtcgcccaggctggagtgcagtggtgcgatcttggctcactgcaagctccgtctcccgggttcacgccattctcctgccacagcctcccgagtagctgggactgcaggcacccgccaccacgcccggctaatttttttgtatttttagtagagacggggtttcaccgtgttagtcaggatggtctcgatctcctgtcctcgtgattcgcccgcctcggcctcccacagtgctgggatcacaggggtgagcccccacgcctggccaatgtatcgcgtaagcaaatgcagacttcttatatttagtgtccaagttgaaaggccaatggccaactaggaggccatatttgcgaaaa

SEQ ID NO: 627713 - DNA, 350 bp, Homo sapiens
  misc_feature (108)..(108): n is a, c, g, or t
tactactagtccactgaattctcagtgaggcttcatagtttaactgttcatttgtaggtctttaatttggatcctatctttgtttcaagtgtgacaagaaacctatcnctctccatagaagcaagccacttttcttaatcccatcacgtgacaacccaaccttggctggtttatgtcaagttatccaatatatacgggtctgtttctgagctctctgtcataatccattggtccataaatctgctcttttgtcacatcatattcactttcctcctgtgaccttgtgatgtgtccaaaaatcggatagtgctagttgccccgctctcgtcacctccaccgagaatcagtgg

SEQ ID NO: 627714 - DNA, 472 bp, Homo sapiens
actggggactctgggaggtgatgtggaatacatatcaaagttgttccatccagggggtgaacatatagaagcaattatagcctggctcccatccgtcactggctgacgaatggaaccagggcatcaactctctggcttttttttttctatttctttttctttttagacacagtcttgctctgtcacccaggctggattgcaatggcatgatttatcagaaaggaaaaacaatatgcgtatttcctatgcaaaggctactgctatgaattgaaattcttaaattccaaagataaattaaaatgcttctcaagacacataaactgttagaatctgcttataatgaggctgaagttgattaagaagagaactggcatttaggacactactttacttctgtcgagtactgccaagtttaagttctgcctggaagtagatgcccctcaagggagggttgcatgtacaggtgtgtgtg

SEQ ID NO: 627715 - DNA, 333 bp, Homo sapiens
ggtgagtcaattttcatctatcttggtacagtccgctgttgatctcttccagtggagactcgaaggtcgtgattgaaagacccttctggttctttcgggcgggctcttgggcagagcgggagcggccaaagttcacgttggtgaagccacccatgcccatagggaagccagagaatgggtcatcaatgtccatgccttcctccccgttccgctgcccaaaaaaggtgtcacagggatttctgccaccgaaggactcagaaaacatggcatgagggtctccatggaactgtgtaagctcgaaagaggtaccacttgagccctttcctcccacgt

SEQ ID NO: 627716 - DNA, 741 bp, Homo sapiens
gtcgtgtgagcacaccatatagttgacagtaggaatagacgtagacgcacgagcatatggtcacctccgctaccataatcatcggtatccccaccggtcgtcgtaatgtatttagcatgatcgcgacacctccacggcaaagcaatagtgaacagtgagtcctgctgcaggtggctctgagccctaggattcatctttcttttcaccgtaggttgagcctgattgtgcttgtattagcaaatcatcatagacatcgtactacacgaacgtactacgtgtagctcacttccactatgtcctatcaataggagctgtatttgccatcataggaggcttcattcactgatttcccctattctcaggctacaaccctaagaccaaacctacgccaaaatccatttcatatcatattcatcgggtaaatctaactttcttcccacaacatttctcggcctatccggaatgccccgaagttactcggactaccccgatgcatacaccaatgaaaaatcctatcatctgtaggctcattcatttctctaacagcagtaatattaataattttcatgatgggagaagcttcgttcgaagcgaaaagtcctaatagtagtaggaaccctcataaactggagtgactatatggatgccccacctacaaattcgaagaccgtatactaaaatctagacaaaagggagggatcgacccaagtggttcagccacccatgctcatgatttcaagg

SEQ ID NO: 627717 - DNA, 692 bp, Homo sapiens
ctttgtgtttagggtctcgatttgtaggacatgtcagttgcttcagcagcccattagcaactgagagcccagggatgtcctacaggatagtttcatagtgacacggtggcaacttggctatatagaaatatggctgatatgtgtgccgtgaatcactttgtgtgaccttgacactgggttgtctaattatactcggaccctttttgtgaaatccgtgtatattagacttgtttcggtcacctgggcccggtccagactcgaggccagtggtgaaccctgcacagtgctatgtggcttctctttgaggatttttgggttttggaactaaattcttgctgccctcatactttttatgtattagaatcatattcgtgattgcccttttaaaaccttgggatcctcccaaggcctgccccactgtatttaaccacgtataataccacggaagccactggcacggcacccactgccaagcccaggatggatggtccacgtccctgtgtcacatgggcggtggtttcctgctggcctggaatcactcatcaccctgattgattggctctgtggtcctgggcaggtgcctcataggtgtgtggatatgatgacgttttttttaaatgtaatgtatttaaccaatacttaattgtattaaggtcatgtaccaaggatttgataaagttttaataatttta

SEQ ID NO: 627718 - DNA, 456 bp, Homo sapiens
tctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccaatgagttacaggttttagatttccaaaaaggccaaaagcaagttcaagaaagtcccttgggggttcacttaaaaaaaagtcccaaaaagcccaaaggttctcagaaagttctgaaggtcacagctgggctcattctataaccacagttgtcttttaaaggccaccctctccagccccttgtcccccttgtgttgtgagcccaagtcctttgtgaccattaagtgtccggtccccacccctccacccgcaggtttttggctacaaactgtcccagtatacattggtaataaaatatttccccaaaaaaaa

SEQ ID NO: 627719 - DNA, 136 bp, Homo sapiens
tgaggaggcttcgtgagaagggggatctgaattaaggctgtaaggaaatcggggattgaggctcaaaggtattccagaggggacagccaaatgagtcctgagggggtaaagtgggcttggtccaaaagagggggca

SEQ ID NO: 627720 - DNA, 571 bp, Homo sapiens
  misc_feature (184)..(184): n is a, c, g, or t
aacacatagggacttatagaggtaggaggttataaaattcaccattcaaaagcaaaactaaaaaccccacttcatcttacattccaaaagagaagcttctattaatcctttctctcagtcatagaagaaaagcatctacaacataccaaaattcctaaattagaacttacaaaatcctttccanacaaaacacgaactaaaaccacaattaaaaatatccaactacataaacgacatataaccaaactcaccacgaagagaaagattcaccctcaacctcacaatcaaacaaatccaaccaactatcatcacaatctaaaaaccactctttttccataagctctcaatcccattcccacatctcaaaccaattttcatccaagaatcgagaaaacaattccaaatcccattcccaaaaacaccaccatccaaattacaaacactactctcaatcatactcacaagaccaatcacaatcccacgaccaccattaccaagaccaatcccctaacaaatcgcactctcaaagaacatcctacttacgtaaagccttcctcgatctctcaagaat

SEQ ID NO: 627721 - DNA, 97 bp, Homo sapiens
gggccgcctactactactactgctcgaattcaagcttctaacgatgtacggggacatgctcataaggaaaagaatcgaaaaaaaaaagttgtactgc

SEQ ID NO: 627722 - DNA, 158 bp, Homo sapiens
cagcacggacttcggtctggtggcgagtggcgaacgggtgagtaatatatcggaacatacccagtagtgggggataactatccgaaaggatagctaataccgcatacgatctgtggatgaaagcaggggatcttcggaccttgtcctattagaactgg

SEQ ID NO: 627723 - DNA, 645 bp, Homo sapiens
gaaggccggagggagcgcgtgcgtgctgggtgcgtcatttcagcctggtgtggggcttgtagaacatataacataaaaatgtgttccaaaagagctctgtgtcactcactggttaagaggagcagagtgaccaagtggagacggtcatccctgtagatgtcatgaggcgagctgggattaaaggtcaccgtatgcatgggcctggtctgggaaaaagacccagataacaggtgtagcccggtgatgtggaccatatgtccttgatgccaagcctttgaaagatgcaacaaagacgagggaccatatgattgtggtggtacataaccaggagggaaaatcctgggcgcaacaagaatgaatctggagttctgctgctgtgaagtgagatactgaaaggagcaggaacaaccggaaggggcctgataggccggcatctggttgacagtgtcctaagttagagcatgtatgagggttcaattgaacactaaggtatcgggaacggtaaaagggttaaaaaagaacaacgcttattggctaaagaggacagaaatgatggaatgggaggtaagtaaagcagcgatatttctgagaaattagtggtggaaagaagacggggctgagattcttacaaggcggtgaggctag

SEQ ID NO: 627724 - DNA, 359 bp, Homo sapiens
  misc_feature (53)..(53): n is a, c, g, or t
  misc_feature (87)..(87): n is a, c, g, or t
  misc_feature (103)..(103): n is a, c, g, or t
  misc_feature (108)..(108): n is a, c, g, or t
  misc_feature (119)..(119): n is a, c, g, or t
  misc_feature (151)..(151): n is a, c, g, or t
  misc_feature (154)..(154): n is a, c, g, or t
  misc_feature (167)..(167): n is a, c, g, or t
  misc_feature (176)..(176): n is a, c, g, or t
  misc_feature (179)..(179): n is a, c, g, or t
  misc_feature (181)..(181): n is a, c, g, or t
  misc_feature (193)..(193): n is a, c, g, or t
  misc_feature (196)..(196): n is a, c, g, or t
  misc_feature (198)..(198): n is a, c, g, or t
  misc_feature (225)..(225): n is a, c, g, or t
  misc_feature (228)..(228): n is a, c, g, or t
  misc_feature (245)..(245): n is a, c, g, or t
  misc_feature (251)..(251): n is a, c, g, or t
  misc_feature (253)..(253): n is a, c, g, or t
  misc_feature (267)..(267): n is a, c, g, or t
tgtctttttattatgaaaaactatgttaagggggaaaatgtggattatggtanccagaggaatccctagccctgttttccttaaaanacttgtttagtgtttnatcanacgtctgttgnagttgtagacaggaaagcttgttagaaaaacnccncatggagcctgtnaatgttttngcncnacctgtaaagcnttntnggaagtggccagtaaaaaggggttttnccntttaaaaaaaaaagganctgggncnttgtttacatctgnaactttttcctcccctgttttccttacccccttttggggaaaaagtaggcaaagtagcttcccgttttagaataaataaccctttgggttta

SEQ ID NO: 627725 - DNA, 188 bp, Homo sapiens
aaaaaccccggggggaagggggggggcctttaaagcggcccccaggttaattttttttttaaaacattaatttgggatttttaaattgggggaaaaaaaggtttttaattttttttaacgggaaacccccccccgggggaattaaacattttggcccccatttgttttaaaaaaacattggggcccca

SEQ ID NO: 627726 - DNA, 774 bp, Homo sapiens
gaagagcacagagccctgaggggctgggctgggctgggcctgagcccctggctcttctctacagcttcacagagtgtctttcagctcactttaatcccatggtaaagaggcatcaaagctatgaatgtgaatactaacttgttgtcggaccaatagctagagaataacgacagaagcgccagtggctgaggaaagtgcgttctcccagcactgtcctccatgcttttctccctctcatgtccctccagggaagaatgactttattgcttaatttctgcctttcgccccctctacacatgcactttgtgggccttttgtttagtagctggaaaaatacagagaatactcacactctatcaaaacctgtattggtaatacaaagaaacgagaacatgaccatcgtgtaaatttgcgctcgtgatccagatatcatttgcatcctgtgatgtatgtgtctgtgtgtgagtgtgtgaagccgccagttcatctatttatatggggttgttgtctcatttggtctgtttaggtcccctccctcgtgggcttgtgctcgggatctagcctttctggcctgtctatgattctgaacattggacttgaccccacaagtgacgtctttctcctggtgactcatgtatagtctaattgtgcagctgcggacaggatgctagcccgggccctgttggggcgcgcaccggggtaccattgccttggcctgtgttctgcccactctggccgggggtccccggcccttggggcgtatgtagcgtacgc

SEQ ID NO: 627727 - DNA, 103 bp, Homo sapiens
  misc_feature (25)..(26): n is a, c, g, or t
tgttcagttttgtcattgttctagnntttagttaatgtgtaaaagggttactctcatgctccttatgtacagtaatatattgaaatataaaggttaaataatg

SEQ ID NO: 627728 - DNA, 224 bp, Homo sapiens
ccaacagtgactcgacgtagaagatactcgggtgcttacacctaagacgttcagctagcttagctgctgtggagccttgttataggcgtagcgggatctgtatcgcctccgtagcggagccgaatagcatacctataggaatagaggataaacctcttcctagctacgtaagcgactttacagatgtcttcgagaataacgctcttaagatgcagtcgcgagta

SEQ ID NO: 627729 - DNA, 188 bp, Homo sapiens
tcccaagaatgagaaattgctacgagctacctcgctcacatcctagtatgacacgccctaatccatctgtcatgggagcatactatactgggcggagataaaagttcttttcctcctggtggttagctacatcctagttcctcagtccttggggaggggctaccgagctcgctattcgtcaatcgatg

SEQ ID NO: 627730 - DNA, 274 bp, Homo sapiens
gtgggagctaaaaacagagtctattgatttctttattacggctggcagaatttaacaatattaccacaggtctttgagaaaatttggcttctaagagggattactatttatttcaatcagactgggaggaaagtccctttgaagaggaacctgtatttatttcattttctacaagtccaagagtttgagaccagcctgggcaaagtagcaagaccctgtctctctctctctctctctctctatatatatatatataaacatatatgtataaata

SEQ ID NO: 627731 - DNA, 732 bp, Homo sapiens
  misc_feature (139)..(139): n is a, c, g, or t
ctcatgcctgtaatcccaaagtgctgagattacagccgtaagccaccacacctggccctgttttgttttaatttaaggatatctaatcattccacatcagcatatgtggaatgctatagcacatcagctatagtttccntattctttctaatgatttcatagcatttcattgggcagataaatggtgcaagaatgatttaattagttccctaacttttagatggttttcaatctttttctattgcaaacagagctataagggattgcagctttgtgcttgagtctgtcagtagaatatatatctgaaagtgatcatccacgtctcaggattcctaccctatcaccaactatttgtccttgagaagtttatttgtaagatctgagcaggtgggacaacctcatatccaactggtatccccaggagtctacgcagtgccatgcccttggcaggcactcagagagagtggtttaagggctaacactgcaagcattcacactgtaatcagatggcctcttctaggaaacctttgctgatatccttggccccctttccccatggacccttcattcattccacaaatgtttgtggaaagttgattatggggaccctgtatcaaatcagcctcttaggtatatatagcccggtaagtgaagtaaaaacaaattctggaaagcactctaaggctgtgcttgttgatgggatacattaacttcataccgcttccttaaatt

SEQ ID NO: 627732 - DNA, 282 bp, Homo sapiens
  misc_feature (14)..(14): n is a, c, g, or t
  misc_feature (43)..(43): n is a, c, g, or t
  misc_feature (177)..(177): n is a, c, g, or t
  misc_feature (207)..(207): n is a, c, g, or t
ctgaatttgaagtncaagagcataggtttaggttctgactcanttagttattagttatgtgaataagggcagatcagttcattttactgagactcagttttagagagacagagtagtttaatacgatagtttccaattctagcaacatatcagatttatccaagatttaaaaaaaantttatagatacccaggagattcagattctntaggtccagagtgggacctgggaataatttgaggcaattggacccatctttgaaggccccctacaattttccaat

SEQ ID NO: 627733 - DNA, 199 bp, Homo sapiens
tgagaatcccgatcagcatttcagacacagcagtaataagcctcctatatggcaatacagctcctattgataggacatatgtggaagttagctacaacgtaatacgtatcgtgtagtacgatgtctagtgatgagttagctaatacaatgccagtcaggccacctacggtgcaaaagaaagatgaatcctagcggtctc

SEQ ID NO: 627734 - DNA, 150 bp, Homo sapiens
cttggacgatggctcattttcacttttagcatatagtgctatggaaatgatgaatctataaatgaactatcgtccaaccaatagcccaaagtgaaaacagaaagatcagttagaaacttgcaatagtttcgataaaagatgttatggcgg

SEQ ID NO: 627735 - DNA, 343 bp, Homo sapiens
  misc_feature (31)..(31): n is a, c, g, or t
tgcctccgacggattccgttcggcagtatgntggtctggcatattctttgcttcttggcaaataggtgcagcagcactaatagcaaccaggcactctggacgcatactgaaaagtcggtcacaagaagaatggaatcagccaacccatttataagaaattgctccataaaccagcattaaactgattataaacttaagaccagagacggtaaaaagaacacaggcattatcagccattctctcagacgaatagtatttaccgatgacttcatactgaatgttgacagctggccatggagttgggctaagtcacttccacagatcaacatattatccgaaggaa

SEQ ID NO: 627736 - DNA, 173 bp, Homo sapiens
acactgttaaaacatgcaacatctaattaggaccttacttcaaaataccagaacctccagttaagtggcacaggcctgtcgcagggtgtatcgcaggatgtatacagcacaacccatttaggtcagttcctcattttatacaagccccaggagaggccctgcaaatttctcac

SEQ ID NO: 627737 - DNA, 585 bp, Homo sapiens
ccccgggctgcaggattcggcacgagcgccactgcactccagcctggtaacagaacaagaggacgtctcaaaaaaaaaaaaaaaaaaaaaaaaaggactggtccagggagagtttgctttgtaaccccgacaatcctggagggaatttggtgtttggttaaggaaaagagagaagttaaaagtcatgagttacatccagcagtgtaaaaacgaaatacccgccgggcgcggtgtctcacgcctgtaatcccaacactttgggaggcccaggcaggcggatcacaaggtcaggagttcctggccaacatggtgaaaccgcatctctactaaaaatacaaaaaatagctgggtttggtggtgtgtgcttatagtccaaatactttggaggcttaagcaagagaatcggttgaaccccggaggcggaagttgagggagaatggtccaatgcactcaagcctggcggaaaagggaggatgtctaaaaacaaaaaacaaaaaaaccaataacaagtgaatgcacaaaggattaaaatttggtaaccatgccaattaaaggtgcttataaaggatatttccctctcatgtg

SEQ ID NO: 627738 - DNA, 152 bp, Homo sapiens
tactctcttgctccattgcattctttacgttctgcacttcttgatattgaagtcttccatgcgtcttaattcttcctgtcgtctcatcagatcttggtgcaaaagattgcctgatgttcatgataggcatcttccatttcactttccaattt

SEQ ID NO: 627739 - DNA, 800 bp, Homo sapiens
aaaccccatctctacttaaaatacaaaatcatcctggcatggtggcgcatgcctgtaatcccagctacttgggaggttgaggtaggagaatcacttgaatccggcaggcgaaggttgtggtgagccgagatggtgccattgcactccagcctgggcaacaagagcgaaactctgtctttaaaaaaaaaaaaaaaaaaagggtcagaaagggacggagtgcagggcgcttccagaaggggtaacctagaacatgttcatgtattgagagggtgggcacaccttttctccaaggggaatggaagctccttcaccatggtacatctggcctctgtaactcttcattggacgggtttatttatatcctttaaaataccattggtaagagcctagtaaccaggtttccattaattctggtggagcttctccagcaaattattaaacctggaaggaaggggtggcagaaccctggatttttagccagtgggtcagaagcacaggtaaaaacaacctgggactggggatggacttcaaatgtggggagcagctgggggattgaaccctcatcaaccctgtggggttctgacagtatctccaggtgggagaccgagaaccccccaggtggtatattctggagggatggatggtgaccttgttttttttggggaaagggggtttgccttgtcccccggttggttgcccggtgtggaccttcgtcccgtgggacttggcccgtggttcaaccggttctcgggcaagccctctgggttgcggtttggggggccccggcccggattggtttg

SEQ ID NO: 627740 - DNA, 426 bp, Homo sapiens
aactaatgcaggcccactatggagtaacagtaaacttatgatgtgaatttgaaagaaaaccgtatattcttaaaaacacagctaaaaacttaagactgctaagaaataataagggaaaatagtatcagtagtgcaaagtgtgaattcattatttagaaatgactaaatcactggacaaactatagggtaacagaagtcatatactctatcataacaaataagtccaaacatcacacagttaatctagtcagcatgaaatgtgtatactactactgatagataccaataatcttacgctactagctgtaatgctaatatagtggtttcttaatgagatgtgtgatttacctgcagtataaccaatagtacagagtctaacaaatgagactcagataagctgagtgtggtcatagggacaatggcaac

SEQ ID NO: 627741 - DNA, 183 bp, Homo sapiens
cacgaggggtccgtccgcaggcgctgctgtactataaaggacaggccgtcgatgccgcggagcatgttggtggcaccggtcgccacccagatgtgcgtgcccgatggtaacaacatcgtgctgtgacgcgttcgaacagctgtgccagtgtgtcggcatcgggccggtcttcattgctgcagt

SEQ ID NO: 627742 - DNA, 297 bp, Homo sapiens
gcacgagctccggttcacttcaacaccactgatttcgaaaaggatctgctaattcctgctgtgaatggtaccaagtccattctagaagcaatcaaaaattatgccgcagacacagtcgaaaaagtcgttattacttcttctgttgctgcccttgcatctcccggagatatgaaggacactagtttcgttgtcaatgaggaaagttggaacaaagatacttgggaaagttgtcaagctaacgtggtttccgcatactgtggttccaagaaatttgctgaaaaaactgcttgggatttt

SEQ ID NO: 627743 - DNA, 126 bp, Homo sapiens
gagctgagcgcaggcggatcggttggctcaggagtcaagacagctggcacgtgcaaacccgtcactacaaaaaatacagaaatagcggtgtgtgcacatgctgtagtccagctactgaggtgaggc

SEQ ID NO: 627744 - DNA, 410 bp, Homo sapiens
ggccttaaggcccgggaaccgccgaagccggaagggacgttgccgtttccttgaggaaaagtgagggttccaactttccggctaatctggaaggtgttggccccggccagtcaaaatgccagagaaaaaccagccggtggactaaggccggttagaggaagacgaccagtttgaaaagttccctgccgaaaactggcctgctttaaatgaagatgaagatgcccatgtttggaaggataatgggaatgatgccattgtaaaggatgacttctttaataagttccgacctgacctagggaaccttggttataagagggagacttcttagcatccaaaagaagtgttgaagtaccctaaactggaccggcttaatccattctaggccagagaccccagaatgggacactaaa

SEQ ID NO: 627745 - DNA, 1270 bp, Homo sapiens
  misc_feature (391)..(391): n is a, c, g, or t
  misc_feature (426)..(426): n is a, c, g, or t
  misc_feature (467)..(467): n is a, c, g, or t
  misc_feature (472)..(472): n is a, c, g, or t
  misc_feature (489)..(489): n is a, c, g, or t
gaaaagaccggttgccgacatgatagaacagcacaagcgtaggggtcccagaggttggcgctggtctcgcagtctacgcggcagcatgttgagtagctgtcggtgaacggggctctggcccaggagaccgggcagtcgagcatggcgacgccgggagaccttgctgcgagcgggtacctccacacatgtcgtccgcttcgaagaccccagtcatggctgtgtctcgtggagctgttataggggaagtctagctgtctgctattatccatcccaaaggatccaccttagcatctgcaggatttgaccgactgatattactgtggaatgtctatggtgactgtgataactatgccacactgaagggacacagtggagcagtgatggaattgcnttacaacgacagatggcagtatgcttttctcagcnatccacagataaaaccgtggctgtgtgggatagtgaaacangtganagggttaaaaggctaangggacatacttcctttgtgaattcctgttatccagccaggagaggacctcgagcctttgtctggtacttggcaagtagtacggatgcgcactaggttaaaccttctgggacatctcgggaacgacatgccatcccatccgagcacatttcagaaccactgtaccaggtgtctcagcatgtgactccttcaaatgacaccaacgtgatccacgattcatttctggtggaatagataatgatatcaaagtctgggacctgcgccagaacaagctaatctacaccatgataggccatgcgatgattcaggtgactggtgctgatgtttaagttcgtcgagacggctcttatcttttgtccaatgcaactggacatatacagttcgtgtctgggatgtcctggccagtttgcccccgaaacgagagatgtgtgaagatatttcaacggtaatgtgccacctttgaaaagaaccttctgagatgttcttggtcacctgatgggaagcaatatagcagctggctcagccgacaggttcgtctatgtgtgggatacccacgccgggcatatggttttaccttggccgccatgctgctcctcaaggactgggttcccccttgtgagccctattattcgttcggtgccccgctgtttggggagatcgcgccaatgtggagacccgcgtgtttgacccaccgctgtgcctgtggttctccccctaatcgttcacacggggctctgcccctctcggtggccgtccccagggttctctacgccggttcatata

SEQ ID NO: 627746 - DNA, 226 bp, Homo sapiens
cgtctccctggggccgggactggcagcggggacctcaggcaggcaggcaggcaggcggaaggcttccagggaagatcagtggtttggctgagacagtcaggtgcacaaaagtgaccagtcaggagcacccagcgaaatttcatccatgctctggacggccgggcacagcagccggccccttgggtatatccacttctttgccatattctctttgctggttccgctg

SEQ ID NO: 627747 - DNA, 1071 bp, Homo sapiens
gtcacccaggctgaagtgcagtggcactagtcttgggtgacagagtgagactctgtcttacaaaacaaaaaaaaaaatcttggaaaatggcgcagaacgaggatatatagagaagaaggtattgttggatgagcggaattagtgacgttatgatgccaaggagcgcggtgtaagaggtggtggagctagtgactatacagcagcacgagtgaaatgagctgaaatgttgacgaacgttggagtgagaagatgtagcgagataaagagagaagagtgaagggaagctgagcaaggagaacaacagcccatgaggcacagaaaaagcgcgcaacacaacaaaaaaacgcgaccaaatagcgagaggattagacgcaacaagggaagaccagaacgaaacagaatggccacaaacaacaaaataccaagacaagaaaagagggagcacaccaacacgcagagaagacaaggaaacacaatcggagaagaaccaaggagagagaaaaaggttcacacaacgacgatgagaagcagcaacacacgagacaaaacagcaacacaacacagaaaagaaaccgacagaacaaggagcacgcaacaaaaagaagacacgtatacagagacagagcagccaactgggacgcacaccacaagagaggcagagaagcgcccaaaaagagagagaaaacaccacacacagcacaaaggaaaaccacaagacagcagaggaacacaagcgaagtgaagcgcaaaacacgaaggacaaaccaccacgaaccagggaacgaggaggcaccgaggggaccacaccagaggcagaaacacccaccaagcaaagaagagcacctaggagcgacactaaaagaggaggacaagccaagacagggaaaagaaacagaacacgaagcaagcagaacgccaaagcagacaacaacacgaaagagaggaactgagaaggaggcaacaccgaaaatgatgacaagagcatatagcggagaaaaccagcacgacaacaacagagaggcggagaaagagcgagacgaacaacacacaacaacgggagacaaacagcac

SEQ ID NO: 627748 - DNA, 388 bp, Homo sapiens
  misc_feature (17)..(18): n is a, c, g, or t
  misc_feature (355)..(355): n is a, c, g, or t
  misc_feature (361)..(361): n is a, c, g, or t
  misc_feature (382)..(382): n is a, c, g, or t
aaaaaggttggaaaatnnttttatgaagccttaagaagcactgcatataattatacttcaggtttagatacaatctaatcatagttcaattctaaaataaaggttataggtgaaaccatgaaatttcctaacacttgattttcatacattgcactaattttctaaactgaggatacagtatttacaggtgggtgtacttgtgaaaaactgtcagctgttacgcatgtgtgtatatctaaaactcaagattatatgaactggagataaagattttatgcccgaacagcagaactagaggacaggaagctgagacctggaactgtctataaatatttttcaaagcatgggatctggnaaaggnagagatgtcatgtttcgaaancctgaa

SEQ ID NO: 627749 - DNA, 168 bp, Homo sapiens
aatcatagcatctcacgttacattatttttaattttagcaattctgatgattgtatagtgatatttcaacacagttttaatgtgcatttccctggttgctaataacactgagcatctttttttttttaaattaaggtcttgctatggaaacttctaaaacgggggatc

SEQ ID NO: 627750 - DNA, 350 bp, Homo sapiens
ccatttgccccgcccagccctgccctgcccagccaaaccctgttttgccccatttgggggtgccctgctcagggatgggctggcagggctgtacccaccctccctggtaaacaaaaactcaaaaaacctttggggtcctgttttttggtcgtgtgatcccaggggggcccatgggccccttgggtgttttaacaaaagggcatgggagggagggctgcccccctccagttttactttgttggtgtaacgggcagctgccccctcccccccccccctgccccgcggggtcctgagtcggcaaattaagcattttataaattgtattttaaaaacatgttttaaacttgtca

SEQ ID NO: 627751 - DNA, 409 bp, Homo sapiens
  misc_feature (63)..(63): n is a, c, g, or t
  misc_feature (79)..(79): n is a, c, g, or t
  misc_feature (243)..(243): n is a, c, g, or t
  misc_feature (249)..(249): n is a, c, g, or t
  misc_feature (392)..(392): n is a, c, g, or t
  misc_feature (403)..(403): n is a, c, g, or t
aaagggtttcattgtggttaaccccaggatggtctcgatctccctgaccctcgtgatcccacnccgcctcggcctcccnaaagtgttgggatgacaggcgtgagcccaccgtgcccggcctctgtctgcacttccttaaaagggactagaatgggtcaatccaaaatatgccaagttggggctgagcctataatctcagcactttgggaggccgaggagggtgggtcacctgtggtcaggagntcaagnccagcctgactgacatggtgaaaccccatgtctgctaagaaaaattacaaaaattagctagacgtggtgcgtctgcctgtaatcccagctccttgggaggctgaggcacgagagtcacttgaacctgggaggtggaggttgcngtgagctgagntcgcgc

SEQ ID NO: 627752 - DNA, 469 bp, Homo sapiens
attggaataaaatttgttttatggctaaagatctatgacccctgccttgcgagggcgaatgtgataggggtgtgagggtaatctgacactggttgttgcagctcttaagaaaacaaaacaagggggcatggacacattgaccgtgcggactgcagcacgggtatcataattttcagctgctagggagctgctgacaggctggtcccctgtggccagaggtcacagactgttcggcccacaggcacgcagaggccctggatacctattgcacagtctgtgcagcatgctgcacacgggctactccactctcatgctgctcaaagaagggggtgaggaccagcacctacttgtgcgtcacgtcatcgaaccacgactgacaggcactcgattctcaagacggactatgtatgaggcagtcgaatagacaacactgatcactctgctcaggtacacggctatgcgacacagg

SEQ ID NO: 627753 - DNA, 132 bp, Homo sapiens
  misc_feature (132)..(132): n is a, c, g, or t
ccgaaattctaagtacgccacaatcatactggatttgagaccatcgtcatctaatatgacctgttagtgacagttagttttatgtatcaacttggccaggctatggtacccagctttgaatcgaacaccagn

SEQ ID NO: 627754 - DNA, 646 bp, Homo sapiens
  misc_feature (153)..(153): n is a, c, g, or t
  misc_feature (175)..(175): n is a, c, g, or t
  misc_feature (186)..(186): n is a, c, g, or t
  misc_feature (279)..(279): n is a, c, g, or t
  misc_feature (282)..(282): n is a, c, g, or t
aaaggaccccaacgccaacagccccaggagacccagggccccccgggcagggcccatcatatccaaccccattgaagctggcccagaacctccaggggaccctcaccgggcctgtgaaggtcccgggggtaagggcgcctggcccagcccagnggggccccaacccgaatagganaaggggagggnggcatgggggccctcctgtggacccacccagcagaccccttcctgcaggccgtgcggttgccgccatcctgggcctgggcctggtgctggggntgntgggccccctggccatcctgttggccctgtacctgctccggagggaccagaggttgccccccgatgcccacaagcccccttgggaggcagttttccgggcccccatccaaaaggagcaggccgacgcccattccaccctggccaagatttgacctgggcccaccaaggtggacgttgggccccgccaggttggagcccgaagggtttgttgggcgagcagggcaggtgcaggccgcctgcccccccacgttcttgggccaattttgccccgttttaggtgccgatggctgcctccggctttttgcttacgtatgccatgcatacctcctgccccgcgggaccccaataaaacccttggcagcca

SEQ ID NO: 627755 - DNA, 145 bp, Homo sapiens
cttatacggtctgggccagtttcagtactgctcgaagtccgctttgctccaattcagcgatacagacatatatttgaactcctttggtctgaggttaacggtctccactaacccgctgaggtctctttccgatcagtagcgtaga

SEQ ID NO: 627756 - DNA, 711 bp, Homo sapiens
actttttatgaactccacaggaagtagtaaagctttttgtttttttaattaaaagaatttttttggagacaaagtctcgctctgtcacccaagcaggatggcaggggcataactggtggctcacggtagcctcaacctccggggctctagagttcctcccacctcagcctcatgagtagctgggaccgcaggcgcatgctaccatgccgtggcaaactttttggattttttatagagacaggagggtctccctgtgttgcccaggctggtctgtaaggcctaggctcaagggatcctctgcctgggcttcttaacctgctgggattacaagcatgagacaccattccgggcctaaaagcctatttttaaagaaactacaatctcccagggggacggtttccctgcctctttggtgcagtcccatggaactggcctacagcaagaggcctaagatggaatcttttgggggaaaagtcattctaggatgaaaatcctatgttaaggccgggcgcaggggctcacgccggtaatcccagtacttggggaagccgaggcagggggatcacctgaggtgaggagttggagaccagccgggccaacatggtgaaaccccgtcttactaaagctacaaaaattagcgtgggcgtggtgccaggcgctgggggtcccagctactcaggaggctgaggcaggagaatggttgagcctggg

SEQ ID NO: 627757 - DNA, 603 bp, Homo sapiens
ttacacgttagcccatttatacaggtagaccgcgagggtatcagacaccgtctaatgacctttatcttcccagaccaagtgtctgcaacagagtgagtgctcagttttgaattacagaattaataaaagcacagaggaatgagaagaaagtttaatttacagatgttcacaagactccgtcctcattagaataaatgttttagatatattcagacctcatttagaaacaacgccatcaaatgtgattctttctaaatcagtacaaattttaccttatattcactctggcataatcttcaaactctattaaggttttcgaatgcacaggttctgaaaattaataccaaatgactatctcagcagtgttttcccattatacaaataccttccctcatctctgatgtcagtttcctgtggtcattttcataatggcagtaagttagagatataaccattttgtattactacatatgaccaattttaatatttttttgccataggaaaaacatcatagttattggaaatttgttttataactggaaacagaacgcttacttatatagtagattcagcttcaggtgcaggagtgtctggtctcttttc

SEQ ID NO: 627758 - DNA, 643 bp, Homo sapiens
tggcgcttgcttgtcagtccgccggtgttggggccgccctgctggcctaagccgctcgctgcgctgggctgtgagagctctgttatgccttccccgctaggcttccgtgcgggtaggtggttgattgtcgcctcgggcccccccccgttgggttgcccccggcggccactattttcccccggaggggatatcgcgtccgccctctcgcttttttgctaggggccgactttttcccacccctcagggggttggctccctcacgggccatggtcgagtgttccctcgagcactctccgccctttggtgccccgccgccctatttatatacaggttctctggtgtgtgcgccacacgagttctagatatgctctctctctcggagttgtctgcagtgtgcacacagtctcgcggcgtttgagttcccgctgtcgccggtgtgtccttatggtccctccattttctctctccctcttcggcattcttactccctcagacaaaacagctcatacatttcatcacacatcggcccttctctccccccgtcgataatgacagtactctctctccctcttctcctattattaccaccactcacccccccctacagattaccagcggcgttataatcaataaacaaaaaact

SEQ ID NO: 627759 - DNA, 881 bp, Homo sapiens
aagcaggctggtacgtccgggggtaaggagcgctgctttgtctcttcgtccagagccttatgtaagagctttgtctcgggaaacaggaaggtcctgcttgccaaattatcagcgacaggagtagtgcaggccttattccaacacacccggcccagccttaagccccagaactcagccaggtttctgtgcttccgtgcccctggatactccgtcacccaatcgagcccacgcacactcctgtaccacagccgttcaggtcagcgccactaatgaacctgacgcaccagccagactcctcataggcgtgtgcattgcaagccccgcaggggtccatgacacagtcactacgaccccgggaccaccatgagaccaacgtgacccgcaagaaataaggacgcaggccagactcacgtgacatccctggggccacacaaaatgacctcgtacataagacacaagcacaaaaaccatatacaccatcgcacacgcgagaacacacaagagaggggcacaagcccacaccaatagagcatggcaccatagcaagacagcatgggcccattgaaagtaccaatcccaatggagaagcaagaatccaacactaggagacaaagaggagcccagtgcaacacaacaaatacagcagaaaaacgaggaaaaacaagggcaacacacaccctcgaaactacaccctacccacatggcaagcaggacgatgacaaaaggccacagcgccgaatgaaaacacagacgacgaatcaccaccaatacaagggtccagcacacaccgcacacagaggcaacccacgcaaaacacaatacccgcgcagccagactgtcgcacaacaccgcgaagctcacacaagaacgacgagccagaa

SEQ ID NO: 627760 - DNA, 196 bp, Homo sapiens
ggcgacgtgtaatctaaagacagaggttaacgcctcttttgccagtccgtggtgaatgtcatgttgaatgcaaattcaaagaagcagcttcaattctgccgggacttctcccgccttttttttcctgcggcgggcagaagtagatgtgaagccatgttgattacgggtgtttacgctgttaacctaacaagtttcg

SEQ ID NO: 627761 - DNA, 612 bp, Homo sapiens
caagtacctggtaccacaggcgcacaccaacatgtcccagttaatttatttgtattttcttgtacagacagggtttcaccatgttagcccaggctggtctcgaactcctgacctcaggtgatccacctacctcagcctcccaaagttctgggattactggcatgagccactgtgtccaggcaagttaagtgctaacaaataaacccacctatatctcacttgcaaagcaattttctaagataccttgtccttaggtcgggaagaggtatgagaattctgtgtggatgtaacgtctacaatgtatccagcaatccttgacataatgaaccaaatgctcgcttgagtgccttgttccaaggctcctcaagccagggatctcgacacacacatatccttagctcctcctccctggggtggacaccttgccaggtgagggctcatgctcatgattcctgcgcacgactgatccccgcccacgttgctctcatcttacggagcggagagacagccttgggagtcatctctgccagcagtctcttccttctttgcctgatgttcctggcggcttcagatgacggcgaaggtaatgcagcctgggtgcccttgggctct

SEQ ID NO: 627762 - DNA, 578 bp, Homo sapiens
  misc_feature (478)..(478): n is a, c, g, or t
  misc_feature (561)..(561): n is a, c, g, or t
cagtttgaatcgcgcagcgactaatgagtaagtggtgcgatctcaccgagggtccgattagcctttcctttgccttgcttgcttgagcttcagcggaattcgaaatggctgccggtacggctggaaaggactccggaaaggccaagacaaaggcggcttcccgctcgcagagagccgccttgcagttaccagtgggccgtatacattgacacctaaaatctatgacgaccagtcatggacgagaggccgcgactgccgctgtgtacagcgcagccatcctggagtaccttaccgcagaggtacttgaactggcaagaaatgcatcaaacgacttaacgagcaagcgtattacccgtacgcacttggaactatgtatgcgtggagatgaagaaaaggattctctcatatggctacaaatgactgcggtggtgacattacacacatccaccagatttttccttggaaagaaagaccacangacactgtctaagggatgcgtggttccttgttgtaccaggactctaaatactataacaggtgctccatggtggagaggtcaanggactgttattactgcg

SEQ ID NO: 627763 - DNA, 257 bp, Homo sapiens
cggaacaataaataaagtacaacacgtctcttaaagacacagagtggctccaggcccacaggccccgacagtgggagtcagagagcgtacacatcatcaacccaagggatcaaacggaagccgagttggtgagtaacagacagacaacgggacggtggctgagaggaaccgacagccagcacttggacagccagagccagggcgcagtccaagtagcagcagacagtacaccctggagtggtccgacgcggacgggg

SEQ ID NO: 627764 - DNA, 112 bp, Homo sapiens
gccgcgcttatagtgagcgcgccggtcaaatgaattgtgggtcgagtgtttgggacgggttgagcggatgcgggagcgcggcacgtgtggcccacgctaccatctatcttcc

SEQ ID NO: 627765 - DNA, 557 bp, Homo sapiens
catgggtgtgttctcaagggaagttctgtagcctcagtgtatgatgggaagctgctcataggcccttataccccagagccttgtattgtgaactctaaattgtacttttggcatgaaagtgcgataacttaacaattaattttctatgaattgctaattctgagggaatttaccagcaccattgccccagaaatgtatggcatgggtagttaattttattccagtaaggaccggcccttttagtttttagagcccttttaccaaaaaaggaaaatgaccgggttctttaaaatgccaagcaagggccagaaaagaaagctgctttcgaataaagtgaatcccttttgcccaaagtaagcctcccctttgccttccaactgccagaacatggattcccctgaaatagagtgaattatatttccttaaaatgtgagggccctccctttgggccctgtgactactatggctgtttagaactcctgataacgtattttgatgttttgtccttccatctttgtttccccttaaaaagttggggtttttttaaagcctaccta

SEQ ID NO: 627766 - DNA, 390 bp, Homo sapiens
tttagtttcttttagtagggatgtcctttagaagctaaaattggccctagggattccccctgaaactggatatcattgctttgaggcctttcagcaggcagaactaggaaaatttatgccaataagtggggggatatatatgtggggcccatggatatatgaatacatatttatcatactttttaatcatgagttcatactgaaacttttaatcccaccccatggggggttttttgccttccccccttttggattgtcttttttaccccagcagtaataaccctgggtccccttattttcaatatatttccctcctttggtcaggggtcccataaaaacaagtttcagaatccctacagctctatccacaataaaccttttaaagttcca

SEQ ID NO: 627767 - DNA, 418 bp, Homo sapiens
gtaagattccagacaggctatccgagaatctgagagctgcgcccggctattcctcccgctacccttgtgacctctgtccagttcacacatttccccatgtttctctttgtcatctacccttgtctggctggttttgagggcttgagaatgggtcagggactccaggccacagtccaacagagaccccaaacctcaccacacaccagcagtccacaagctcaccaccaacaatgaggacttttgtggggccacaagtaagaggtcatttctggaatggactcagtagctttacacaggagagttgagcacttccagtcagtttttaagcaaggcatggggaacagggaatagaacctttcaaagaggtagcccagagaaaagctgggcctcttgcattcggcttccttggagcagcctc

SEQ ID NO: 627768 - DNA, 1235 bp, Homo sapiens
acctgcttttactcattttcaatgatggttatttgtacgaaggcaaggacaccaattatgcttgtattcactacagctattactctaacatgttctcgcttctcttgtaacttcctggctacagacccttttaacacatggttcagttgctagtacaaggaatccatttatctggctaacattccttgcgtgcgcctgcgcctagactagctctccctaccacgacaccactaactctctgcgctactactacgcaacgcgcctactcccctctcagcactctatgttcatcacatgcgcaacacgagcctcctctcgttatccttacgccgcttaccctctgcacactcctctgccccttaccttacactacacacgctacgcacgctacaccacgacactttgcacacacgcctttcctggatcaacacgtgctccctgcaacaactatatcacacttcctctgcacaactggctcctctctggctacttcaacacaccctggcaacctctgtctccctgtattctacagggcccttaacgccaaacatcgtcactccacttacaacttgtcttgccccatttgccactctaaggcccccgctatgcttaaaaacataccctttggccacacctcgcacaaattggcttacatcacttgcgcccgcacttttcggacacgtcccccaccacttggttgcacacttccggccacttcaacttccatccaaccagaccacatgactggcgcgccactcaagccatggcaccccttctaacaccatggcacccttccaatctggtcccaccttgtcaactatctccccatttccaaaattcccccctgatgtacacacacttcgcacatagatattcataccacgttcactatcaggctctccaacaattctactttcacccctactaaacagttcatacataaagcttacaccaagctctattacgccgcgcatcaaaccaccctttctccggagccaaccatcacgtatgtcttgacttaagctttgtacacccttacaggtcgacataagcattgcgcaaacctcaaaacgagcatggcattacaaactcttccgcgcacatcatacacattcaaccaaggggcgcgaactcataccgttgctatcgcttcccagacagatctatcacctatcggtgccacaagctctggctgcacatatctactggcgaaacacacctttcctcatccgact

SEQ ID NO: 627769 - DNA, 116 bp, Homo sapiens
  misc_feature (101)..(101): n is a, c, g, or t
actgcccctgcaaccttccagctggcattcggcaccaggtgaaccggcagtcttccggcaggcccaccgccccaaacccggtggctgccttccctccacanagcagcagcgctttg

SEQ ID NO: 627770 - DNA, 916 bp, Homo sapiens
agcgtgggggctggccgcgtggaatttgagccgagtgggccgcgatcggacgaggatttgggggtaccctttgacccaggtcggggcagctgatccggctagcgagtttggggtcccctggtgcgccgaagccctgagttgccagatgttgcaggtaacagtacagttcttctaaagtttgaagtttcagacaagacaggtttcagggtatcgtctcatgtaatgttgagaaggtgagggcgggcctgggcggattcttctccgtatccagaatccctttctcttttcaaaccgcattactagcccgagttaaattctttaactctactcctctctgcttaccctcataaggtttacggccgtatcaggctacggccgcagtctacgggttgtttgattccccttgttggccacaagaaagtggttattcgaactacttggctttcctttatcaagaaaatggcaatgcggtatacatacatgcacacacagataagaagacaaagctacgtttttcaggtggtgttctagatcgtgtagtggctgtgtacttcagggatattttcccgtcaccttgaggatttccctcatctacctttcttgggagatacgatgaaatccaacaaaagccaagttcggtaacctaagagggttaagacaagttgcttctctgttacaggtcatccacgttcctcatctgtaagaccgatcgcccaatggtttgtccagcagctcctctgaatgtaatcttccctgtagtgggtgcctgggagaattacaaggaaccaaggcgatcaggaactacattactatttcgtgagggttaattgccaaagaataatcttataactttgaactaaggcatggtctggtagtgttagcacacgtgataaacttgcaaatattattgaactac

SEQ ID NO: 627771 - DNA, 680 bp, Homo sapiens
  misc_feature (34)..(34): n is a, c, g, or t
  misc_feature (101)..(101): n is a, c, g, or t
  misc_feature (168)..(168): n is a, c, g, or t
cgccacacttccccgtcaaagcgcgaagtggaanatcaagcggacaacaaagtctcgcagatccagaggatgcccatggtgcaggcaatcgcatgtctaancccgcactagagaggacgaaagctgaagatccgccacggtgcggtccactgtagacatagagaaatnccagctcgtcagctattgcgcacgagactttccttgcttatgctagtcaatagtcggagacaagaattggaatgtacgcgtgcacaagaaggtgtcggcccattcagtgttacttctagtgcaccacatagacctttctacacatgtgggatctcattcctgataaggacagcatcgccctgtatagctcaggtgcaactggacaagaatccacattccacaagtgctaaggtcagtccgggtcaagccgcacgaataggagcacgtagccaaggcattgggctggccccagctgtagtcagcatgtctagtgtgagattcactgtgcggaatcctttggattccctgggatcaaggattttcagcatggaccaatgatgtccaggattccgttctttcaatgtgtctttctaaaccaggacatagcccatcgtgtcgcttttgtcttaaataggggcctgcactcgtgagcacgaaaactatattgacgcataataatcctcatcaaggaa

SEQ ID NO: 627772 - DNA, 208 bp, Homo sapiens
tcagagcatgtgactctggcgttcattgctctagcacggaataaatccatggagttagtgaatcgtcatgagtgacgcggttatgactcgtagcgtcgcgtggaatgggctatgcagcgtttgggcgtgcgctgccgtggagagaaagcgtttcatagttgcctctcacgcattagagcaagacgtgtatagaatgtcttcgaccatt

SEQ ID NO: 627773 - DNA, 1201 bp, Homo sapiens
gctctccactctgtttgtccgccggtccgccgtcgcgtttctctgaaccggatcgtcaaatggacctgaacgagatcgccgcgctggtcattgacatctggctccggcttgtgcaaagctagtcttttgactgagggacggacgcctcacccgagcgcggtgatttcctctccgagtcggatcagggcaagcctcgcagactaagcagggcagttcaatggttgtggctatggagtcgcaagacaggcagtccgtacgtgtgagctacgcacggcccagagcaagctggtgtcttcgcatgaaccgcgtgacagtaccacctacttgtagccactgcgcagtcgttatccgaactggagtacctgaccggtggcaggaaagatcttggctaccaccgagctcttccatatcggatcggatggcgtgacagccgatgtggccccgagaggggaggcactcacaagtagcatagcgtgacgcggaggttgcgctgcgcacttgaaggcgcctgaggatgctagcagcagcacgaacgcagtgaccgtcaacacttagtggtatgtgacgcagccttcaatcaacccccggtgcccaatgctagctgcttgcgggcagtccaaggggccgttggctggttaccccgtctagccgggccctcttgtgagctggcaaacacaacgtggggccaattggttccattgtggaacattctttgagaaaagaacctgggggggttcaacccaccaacaaacatgtgttggccccaagttcttagcagatgtggtggctttacatgcactctttccacccaccaaagaggcacaatttccttagtcagtacttgtgaacccctttagggccttggggccctgtagagaacgcctggaacccggaaccttaacgcttcattaggacaggaactcgcgttccagctaggaccggcccgcaagggggcctttaccgaaaggattgtccagagcacaaagccgccaacaggtgacccagatggccaggggtggacacgaattccggattgaccggccggaacacattccacaaaggggacgacacgggcctgcgttggcataaccggttcaggaccccccttggggaaacctttccgaaaggcaagtggaatgactttgatgccccaaccaggcccgacagtcccatcccttcctttactccttgggaagaacag

SEQ ID NO: 627774 - DNA, 417 bp, Homo sapiens
cacttattaatctttcaaatagtgccttttgttgaaacttggattttgaatggccctcaccatactgatgacttgtgactgagctcctcactactccacatatgagaggcaggaatagaatacccctaatagatagacaggaatatcatcacccttattcagcctgagaaagttacagaagatggatcttcatccttctgcaactcttaggattaagggttctcttataaaagagaacagggaaatgtcagaagcatttgagccagggcaactccatcttgaggaggggcttggtaaaataaggctgagacctactgagctgcattcccagacagttaaggcattctaagtcacatgatgaaacaggaggttggcacaagatacaggtcataaagaccttgctgattaaacaggtta

SEQ ID NO: 627775 - DNA, 159 bp, Homo sapiens
acatacgttaagtgtgcatctgctagagtctacctgaatcagcatgactgtcttttaactacatctgtagtactataatggtgaatatagagtatatcatctgtcatagtgtgtgtgtgtgtcgctactactaacttgaagcttttttttctctaaaag

SEQ ID NO: 627776 - DNA, 299 bp, Homo sapiens
attttttagaggcagagtctcatgttgcccagtctgtagtgcaatagctatttacaggcatggtcatggcgtactgcagcccaggatttcaagaccagcctcagcaacatggcgaaatcccatctctataaaaaatataaaaaattatccgggtgtgttgatgtgcacctgtagtcccaggtgcttgggaggctgagatgggaggatcacttgagcccaccatgagagatcgaggctgcagtgagccatgattgtgccattgcactccagcctggacaacacagtgaggccctgtctca

SEQ ID NO: 627777 - DNA, 101 bp, Homo sapiens
cgtctttctttaggcaggaggtctcattcccattgtaggtcaggaggccaccctggtaatggggcaccattggcggtccctgcccaagtgcccgtcttcaa

SEQ ID NO: 627778 - DNA, 1461 bp, Homo sapiens
  misc_feature (214)..(214): n is a, c, g, or t
agctaactgcttacgaacccggcggaggaaggagaggcgattctataccaacgcctatactgactggttcagggcagccgtgacagatagagattctgatccatagccaggtcgttcggaaatagatctgcgccatattagtgaacgtatacgtaagtccggggaagaaagaggaacccattgggaagtacatgaggctagtggctcgtgcagncttatgaaataatcaacttggcctataccgtatgcggtatatagtccgctgtgagggcagcaactcatactacttcgacacgtgacgcgaactaggagcgataggactaacaccgagacactacttgtcagaccatcacgactcagccgatgacatgcatgcggctcatgcgcgcgcatcgcgggggcgttccaagagttcatgttgagagctgggagcttcgagccacgattgttccctacgagcaaaggcaaactgatgggaagatgtagtctaacgtcgggcgagttggcctcggtgatgtctcacctaaggggaccttccagtcatttttgcttttggtatcccaacgcagttcaaagggtcggtgcccttcgaacacatggttcgactcgtggtactttaagactaaatactcttcgaattcgaactttgacggatcaaattcctggtcacctaaaacaagttggaaaaacctgttcaacgtatagccgtgtgggtcaaagacttctagcattatcctccacctttcactgagtcccgcggtgacttccgaaccttactggaaaggctctggtgaaatttctcgagcgcatttgccattcaaagcggaagaggggaggttgtccaactctgcgagcctcggactttctacccacacgcattacatgttcgtaccatggggcacttcacctatctgcggctttaagaggagcaccaagaggatccccttagcaagccccctaagggagaatgcaccctagtgtttccaaccttaattccggaatgaaattaacgagtgccaggggcgggctaaagaactttgcttatatacttttgtccctttcacccccaatcggaaagcagaacatatcgcggtccaggggggcatcaattcgccgggggcaaaagtggccccggcagagaaacaaggtgtctaggcgttcccgagggaacctttaagccaccccgggaaatcgggcaaatgtggacacaggccgaacaaagttggcaaatgaccaaaagtccgccgggaaaattcagaataccctagagggaagaggcgtcagtcgacaagtagtcccactcataggcctatccgataaacacccataggagcaatggggtatacccacaccttagcagagaggacaaagcggtgtataaacaaggtggggacaaactaatatcggagagcgaaacagagccccgatctcactcagggcaggggcagcagaagaacaacg

SEQ ID NO: 627779 - DNA, 420 bp, Homo sapiens
ttcagttgaattgtaactgcttttggtatttggagagagtgactattgaacttgaaaccccaaaaaaaaaaaaaaaaaaaaaaaaaaaaaaagtgtgtgtggcgcgcgcgcgccggggcccccggaaaaagcttttatagaaacacaattccgggtggggcgcgcgggggcgcccaagagggaaagggacagtggggccaagagggggttcccaagagggagaaccgggggccagagaaaaaggggcggggaattctcttcaccaattaaaaaaggcccggggggaaaccgagaggcggtccgcggagaaaacctccagagaggggggtccgggaggggcacaaagggggaccttattaaaaggggaggtccaaggggaacgccagaatattaaaattaagggccccggctgggggggca

SEQ ID NO: 627780 - DNA, 362 bp, Homo sapiens
  misc_feature (69)..(69): n is a, c, g, or t
tctccacaggggtccctgtgccctgagggcactgggcaggcagtttcctttgaggtgtgtgtgctgctntgcgagtgtctggggagggcggtcccaaaggctgctctctctggcccctggaggcctctggcctagtgcttgggtatcccttggactcctggagtcaggggatgtgcaaggggcccccgtggagcaccccctgtgttgggaggagcaggtgcccagggcctgtggctctgcagggctcacctcacagactgggggcctccaagacctgacaaagccactgggcccagggctgatggctgatgaggtattggagtgtcgctcagtaccacaggtcccacgcaccaaacctgtcc

SEQ ID NO: 627781 - DNA, 245 bp, Homo sapiens
tgtaggatcaacgcagcttgctggacaggcctacatggagcggtcgggaaacgcttcaagcgcggcgtcgcagcggctcagcctgcccctctggaactccttatcctacttctagcagccggctggcggccaccacgacggccgtgagtggccgctgactacctgcacgtgtctctagaccttctggagaggaagctgcggtccctgtggcgccggccattcaatgtcactgatgtgctgacgcc

SEQ ID NO: 627782 - DNA, 404 bp, Homo sapiens
  misc_feature (318)..(318): n is a, c, g, or t
  misc_feature (335)..(335): n is a, c, g, or t
  misc_feature (388)..(388): n is a, c, g, or t
ccctggattctatccaagccatgagggattttatgccctgggtttaagttatggtgcatcagggtagccttctaccctttagcacagagcttggtgttccaaaggccacaaggggctttagaccctggaccccgcacatattccaagacttttttatattatgtcagacatgcaaaccctgcctcagcttctgtcaacactcagcttttcccaacagaaaataactgcttatattgtttggatatttgtcccacccagatctcatattgaattgtgatgtccaacgatggaggtggggcctgggtgggaggtgttttnggtcatggaggcagctncctcgtggctttggtgttgtcttcatgatagtgagttctcacaagatctgggncatttaaaaatgtgtg

SEQ ID NO: 627783 - DNA, 429 bp, Homo sapiens
ggcagaactagtggatccgtgagaggtctctcagcgtaggaatgaaatagagctagaatctgcatgttacgatgtgtcctctgtagagcctaagcccctaccacttgtgttcccgagagccccagcaatcactcaggagcttataagaaaagcagagtcccaggccccagtgctgacccgtcttgaatacgaatctgcacttttcaaaagtttcatttgctaaattactatacagtaaattgctgtttgtcatgctcggggtacgaggttctacgaatgtgaggtatatttgtcaattggtattagccaccaccattaatccagatacagaactaagtctgccccagaaactatcttgcattatcctttatgatcacacctatcacccctaaccactaataaccactaatctgtcctcatgtcatacct

SEQ ID NO: 627784 - DNA, 111 bp, Homo sapiens
ggacgcgtgggtcgacccacgcgtcgcccttgcctcgccccagctcggccacttctctgaaggagggctgggttctgggcctgtatcgaataaacacaaacctggatggcg

SEQ ID NO: 627785 - DNA, 870 bp, Homo sapiens
cggtagcagtagcagggactcggcgcctgacagcggggaacaggcggcggcatccctggcggcggcggccgaggcccagggggagaacctcagcgcggtcttcagccggcaactcaaacgtcgaacgcgcaagcacactacgtgcgccgagatagtccacggcgtacgagttctgggccgtgcgttgctgcgggggccctggtcagcgccagcaaccccagagtggctggtggccgcacaattaaccacaggagccgagcagcggcgcggagaggccgggcggtagctgatggaagtccgtctcgaagaggaacatgttcatatgtgtgaagggtactagggttcagcatgttagcgatggaaacttttgagaacctaatttgtagatacatgtagagatagaaggtgtctccagaagaatcatgggagcataatagtacagaaataaggtgatgcatgacgccatggggcgtgtgctccccttggtgccaatggacaggcgcgacgagacggagagagtggctgcgattaacctgaatggacggagagacatgaggaaactccctttgacctaagtcgtgtgagttggcacgctggtcatggtgcatcacataaagaaaagagcgatgtagagttgtatggtatgcatttgcgtgcacaagtacgaagtgctagggtcaagtaaggcctaattggagggagaaaattagctggtatttatgcactggagattggtaggagtaagagggacagcttgggcataggtatgcagtagagaatgctagagtagagaaaagaaggagcacgattgtgttgtttgtcttggggcctttaaaaacaaagtcagggaaggacgaaagaagggttaaa

SEQ ID NO: 627786 - DNA, 194 bp, Homo sapiens
ttttaccttatgcactgacgagtcttatgaagtgacttacgtgggagcgggacctgtctgagtcctaggaagtgacctgcagtgggagcaggagctgtctgagtcctaggaagtgacctgcagtgggagcaggacctgtctgagtcctaggaaggtgacctgcagtgggacgcaggacgcgtcgtgaggtccta

SEQ ID NO: 627787 - DNA, 1868 bp, Homo sapiens
gataccgtgtctataaggagtcctgcttatcaacgaactgaatgtgctccgtgggcagcgctgggtgatctgttgcccagctgtcgtgcacttgcatgcaacggcactccatgcgtatttcataccttcaatgtagtggtagtgccacgggagattcaagtctagagagaattgcgatggatccgtcaagaggtaaaacaatactagcgcaatagagactcgtgacgctaggcacgaacatcgagcgacacttgtggagcagtagtgtcacatatgcattgagcgaaagatcagacaacttctcatgatggccgcccgtgggtatcgtacacgcatgttgaggataataatgacgaaaaggatcaattggacaagaggaactctgtcccatgacacaggagggactgcgaagatcataatcagtggtgcgaccactgaagggaccgcagacaagacctgttacagtccagatgacactggtattactctacgtgtgctgctagtgtaggcacagggatacccaggcaaagacctctagttcttcatctgtgctgctacatagttgccttgatgtgtgtaggccatgccttatcagcaacaagactttggagcagacacgtgacaaacagagcagtactgatgacaatacacagggatatacacatgcaaacacaaaacatacagacaagtgaccgagggaactaagcacaaaaacgattgaaacacccaagataatcaccaattgaccacgtacaatagcgaggcgcgccgcacacagacatccaacacaagagcggcggcaacgcacaggaaaggagaccatatagcatgcacacgaccctgcaggcgtaaccagaaaacgagagcgagaaaaacggtcggagtaaacacaacaacagcgcacaccccgagacgtcacgcaggagtcatggcaaagaaatagagaagacaagaaaaaagagacagaaacgaacgaaaaagcaaagaagagaaataaacaagagagaaaggagagagacagaagacaagcaaagcaacagaggagaagcagaaaaaagaaagagacaaaacgaagaaggaaaaagaaagagaaacaagaaaaccaagacacagcacaatagaaacaaggaagaaacacgcaagaagacaaagagagaggagagcaagaacgagaagagaacgcagagcacagagaaagaaaagaggggaggagaaaagagacgagaagcaaggagagcagcagagacgggggagcagcaacggagaaagaagaaaggaagcacgaaggaacagaggagcgagcggagcagaggtggcgggaggaaggaacagcgccgagagaagcgggggagagacgaggagaacaaagcgcgagagcaagaaacaaagaaaccgaaaagaggaagggagacggaagagaaggaggaaaacgaacacaaggaaacagaggaaacaagaaggagcagaggaggaaagggagggagaataaggagacaaaagacgcaaacacagaaaaaagaagaagagaaagaaagagaaaaaagagaccgagaaaagacaaaaagcgaaaagaagcagagagaaagaaaggaagagaagaaaggaggaagaaagcaagcgagaaggagagaagaaggaggagagcaacgagaaggacgagaaggggaggagtagcgggggagaggaggagaggaagaggagagggagcagaggcgggacgagaggagaaagcgagaagagagagagagcgaagagaagacagaaagaggacaggaggagaaagggcgagaagaaaggagacgagagaagaaaggggacgaaggagaagggaagaacgcggaaggagcggagagcagaaaaagaacaga

SEQ ID NO: 627788 - DNA, 90 bp, Homo sapiens
ctagaagattcagcaaagtacttttgtgctcttggggccttttcctaccttacctacttactgggggatattatccccgataaactcact

SEQ ID NO: 627789 - DNA, 761 bp, Homo sapiens
  misc_feature (29)..(29): n is a, c, g, or t
  misc_feature (31)..(31): n is a, c, g, or t
  misc_feature (57)..(57): n is a, c, g, or t
  misc_feature (65)..(65): n is a, c, g, or t
  misc_feature (77)..(77): n is a, c, g, or t
  misc_feature (90)..(90): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (103)..(103): n is a, c, g, or t
  misc_feature (105)..(105): n is a, c, g, or t
  misc_feature (202)..(202): n is a, c, g, or t
  misc_feature (204)..(204): n is a, c, g, or t
  misc_feature (242)..(242): n is a, c, g, or t
  misc_feature (248)..(248): n is a, c, g, or t
  misc_feature (289)..(289): n is a, c, g, or t
  misc_feature (377)..(377): n is a, c, g, or t
  misc_feature (381)..(381): n is a, c, g, or t
  misc_feature (411)..(411): n is a, c, g, or t
  misc_feature (421)..(421): n is a, c, g, or t
  misc_feature (426)..(427): n is a, c, g, or t
  misc_feature (430)..(430): n is a, c, g, or t
  misc_feature (442)..(442): n is a, c, g, or t
  misc_feature (445)..(445): n is a, c, g, or t
  misc_feature (454)..(454): n is a, c, g, or t
  misc_feature (456)..(456): n is a, c, g, or t
  misc_feature (458)..(458): n is a, c, g, or t
  misc_feature (518)..(518): n is a, c, g, or t
  misc_feature (699)..(700): n is a, c, g, or t
  misc_feature (732)..(732): n is a, c, g, or t
ctgccgccgcgccgccgccaccctcccananagcactggccaccgctccaccaacanttgcccanagtttgggccancgcccgccgccancaacncananaanancggcccctgtctgctgctcgcgcctggagatgtcaaaagtccccgttgctcgcgtctggctggtactgctcctgctgactgtccaggtcggcgtgananccggcgctccgtggcagtgcgcgccctgctccgccganaagctngcgctctgcccgccggtgtccgcctcgtgctcggaggtcanccggtccgccggctgcggctgttgcccgatgtgcgccctgcctctgggcgccgcgtgcgggtggcgactgcacgctgcgcccggggantcanttgccgcgcgctgccgggggagcagcaaantctgcacgcnctcanncgnggccaaagcgcntgngtgcaggantntnacgcctccgctccccatgctgcaaaggcaaggagccctgaaaacaccaaagagcacgganataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccnnggcacaggagacatcaggagaagaaatttccnaattttacctgccaaactgcaacaaaaat

SEQ ID NO: 627790 - DNA, 293 bp, Homo sapiens
caacgatggtcctcagctatccgtaggctgagactaggagtagttgcttgatacctgggaggcggagattgcaggtgagctgagattgccccactgcactccagcgtgggcaacagactgatactctgcctcaaaaaaaaaaaaaaaaatttaaaaaatcaatttttacctccgttggaaactttgtgtaaggtgccccaaataagattttgcaccaaaggctgttgctgtcctcgacgcggcttcttgagacagcatgtgttaaagcattgctctccttttccccttggaat

SEQ ID NO: 627791 - DNA, 238 bp, Homo sapiens
ctccagcgtgctattctgtagatgcgagagattgttgactatagtgaggcgcatttatgaagatgacaagagacggtgcaacgagacctccctcacacctgatcgcctgctttgagaatgccagctaaggtgttatacagtctatgctgtccctctggcccatatacttggtcgaccctgacctgtataagtgtatcaatgtgggcaggatagtatacagcgggcatgggccagaccc

SEQ ID NO: 627792 - DNA, 242 bp, Homo sapiens
cagtccttctctaaattccagctagtgtatagtgtgacactctatcttaaaaaaaaaaaaaacaggggtcaggcaaggtggctcacacctgtaatctcaacattttggaaagctgagggggaggatcacttgaggtcaggagttcaaaaccagcttgaccaaaatggagaacccccgtttttactgaaaatacaaaattagcctgccaggtgtggatgtgtgcctgtattcataactcctca

SEQ ID NO: 627793 - DNA, 136 bp, Homo sapiens
  misc_feature (65)..(65): n is a, c, g, or t
tcgccccggcgatgcccacgaacacgaaccaccagatcgggctgaagtagtggggggcggtgggnatattcaggaagttgtacaccaggatggtgctcacgaaggcgagcgcggcgaatacgcggaggagtttgtc

SEQ ID NO: 627794 - DNA, 332 bp, Homo sapiens
  misc_feature (70)..(70): n is a, c, g, or t
  misc_feature (105)..(105): n is a, c, g, or t
  misc_feature (179)..(179): n is a, c, g, or t
  misc_feature (204)..(204): n is a, c, g, or t
cccccttttgtgtgcttatttaaacccattccttgaatgagcaggtgaaacccatcaaaaaattgggtgnccacgtgcccaacttgggcaaaatgggagcgcccnaatttggcttgggggaatatttttttgacaagccccccctgggagacagtgaaaatgaaaattaagcctcgggntaatttccccaaaaccgtggggtgncttccctggtcccaaaggaagggaaagcatgttggggtttcctttcccttttttaaaagttggaccaaaaaatccccttaagttttttgatttggcccattccttcaaaaaaaaaaatttgggcccca

SEQ ID NO: 627795 - DNA, 275 bp, Homo sapiens
  misc_feature (127)..(127): n is a, c, g, or t
atttgagcgctgggttctgagggatcatactaaagagaagacaggaaaacaccagtaatggtgaaggtcttgagaaaaggacaggacccgcaaatagcgagagatcagaggaggccctaatttctcnttcctcattggtcctttccacaatatcccagaatgtgcaatggcattcaaaccctggggaaagacagaaggcagaaagcatcaagctctctgtttatcccaattcaatgacaaccagaacttattttttttgagatggggtctcgttc

SEQ ID NO: 627796 - DNA, 162 bp, Homo sapiens
  misc_feature (20)..(20): n is a, c, g, or t
aaaatcacggaatagaacangtgtgtctgtgctgagctcaagacctgtggaaagggactgcccccactgggattacaggcgtgagcaccatgcccagccctatagtagttcttcttttgccccttaatatcctcacccccatgcccgcctggccacccgcga

SEQ ID NO: 627797 - DNA, 518 bp, Homo sapiens
ccagtgttctagttacattaatgagaacagaaacataaactatgacctaggggtttctgttggatagcttgtaattaagaacggagaaagaacaacaaagacatattttccagttttttttttctttacttaaactctgaaaacaacagaaactttgtcttcctactcttacattctaaaccgatgaaatctttaacagattacactttaaatatctactcatcattttctctctcagagtcctagcttgagttgcactgcatgtatctgtgcatcttgttctcttcatttaatgctgtactgttctgctgagctctgagggactatcttgagagatgtaatggaaggaaagcgtggtgttaatctgcgtactgcttaagacagtatttccataatcaatgatggtttcatagagaaactaagtcctatgaacctgacctcttttatggctaatacgactaagcaagaatggagtacagaattaagtggctacagtacacacttatcaaaataaatgc

SEQ ID NO: 627798 - DNA, 468 bp, Homo sapiens
  misc_feature (11)..(11): n is a, c, g, or t
  misc_feature (85)..(85): n is a, c, g, or t
gaagacgacanaggggagaaggaaagcccacggacggagacccaggatcctgaaatgcagtgcgtccccttcaaacgttctgagnataaaaaaactgcaagccccgggaggaaaagcaattcctaaaacttggcagaaacaacataaaaaaaatcttgctgttgaaaaactgacctaagaccaggcatggtggctcacacctgtaatcccagcactttgggaagccaaggcgggaggatcacttgaggccaaaagttcaagaccgcctgggcaatgtagtgagaccaccccccatctctacaaacaaatgtaaaaattagccagacatggtggtgtgcacctgtggtcccagctacttgggaggctgaggtgggaggatggcttgagcccaggaggttgaggctgcagtgagctgagattgtaccactgcattccagcctgggtgacagagcaagaccctgtctcagg

SEQ ID NO: 627799 - DNA, 330 bp, Homo sapiens
cttccttcactgggccgctccatctgcctcatagtctagccaaatgctgttttagatcaagtgacctacgatcaacaatgaggtattttataaatgtatttatgctgctagactgtgggtcaaatgtttccattttcaaattagttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacattt

SEQ ID NO: 627800 - DNA, 416 bp, Homo sapiens
  misc_feature (8)..(8): n is a, c, g, or t
  misc_feature (365)..(365): n is a, c, g, or t
  misc_feature (410)..(414): n is a, c, g, or t
cagtaggnatgccccgggctggactgtgccctgtcaactcccctgctggagggtggctgtgaaatttcctcatgctgcccttccttggaattgtagcccagagtgcatcccacaaaacaatgctgcgggatgctgaataacagcccccagtcatacacaggtccttatccttaaaacccatgaatagcctgtaatgaggccgaggtgggtggatcacctgaggtcaggagttcaagaccagcctggcccacatggcgacaccccgtctctactaaaaatgcaaagattggccgggcatgtgtgtcacgcctgtcatcccagcactttgggaggctgaggcgggcggatcacaaggtcaggagaangagaccatcctggctaacacagtgaaaccccgtctttactaaaannnnntt

SEQ ID NO: 627801 - DNA, 500 bp, Homo sapiens
taaccccaaggatcttaagccatagaggatagacaggaatatagtgcctttgatcacttttttttttttaggaaagggagtaccggctcttgtggcccaggctgaagtgcagtggcgcaatctcggctcaccacaacctctgatccccggatccaagcaattctcctacctcatcctcccaagtagctgggataacaggcttgtgccaccacacccagctaattttttcatttttagtagagatggagtttctccatgtgggcccgtcgggtcttgaatccctgacctcgggtgatctgcccacctcggcctcccaaggtgcggggataacgggcttgagccacctatagacttttcgcagtgctcccatttcttttcaactagtcatgaatgtgtgtactttttaaacaacaaacaagcaaaaccatttgccacgattgacaaccaaaactagtattatatattcttaggggaccctgtggggctaatgggaccctggg

SEQ ID NO: 627802 - DNA, 908 bp, Homo sapiens
tcagtgataagtctgttgttgcttgttgctgtctaatacagacttccaaatagagctgggagagttaacctgtgtgacagcattgaatactgctgtaggaaaaaaagcagacagaataataagactttgcttgaaaaccattggaatggaaagatggatcacgcagatggctaagcaggtagaagtaattaggtcatgaatcctttttttcttttttttttatttttgggagacggagttccgcctctgtgtggcccaggcttggagtgcatgggcgcgaaatgggctcaccgggacctctacctcgtggggtgtcaagcgattcctccgtgcctcagcctcccgagtagctgggattaacaggcagtgtgccaccacgccggctaatttttcagagacagggtttcaccggggtgggctcaggcgggtctcgaactcccaacctcaggtgatccgcccactttggcctcccaaagtgtggggattcacaggtgtgagccagtgtgccgtggcatgagtctgttgacagttcacattttggggccatagtacaggtcatctaaacacaaagtacccgggtacggtactaagaaataggggcttataaacgaacctttatagacgttgaaatcattggactttataaaacctgtagaaagatcttgttgctctctggcaaaccgagttctttacctgaagcccccatgttggtttttcccttgaagtgtttcgcaccatttcacaccacaacttgattggcgggcaagtcccggcggggtgagcgcacataaaatgcatggtccgtccacgggaaaagtggtgtgacttggggcacggcaaggtgtatcggatccacacaaagtaatatcccccagtggacaaccagggcattgtgaaaagcgactacg

SEQ ID NO: 627803 - DNA, 225 bp, Homo sapiens
  misc_feature (4)..(4): n is a, c, g, or t
  misc_feature (180)..(181): n is a, c, g, or t
aggngcccactgcctcttcccttcttctcgcttgggaactctagtctcgcgcctcgggttgcaatggaccccaactgctcctgtgccgctggtgtctcctgcacctgcgccagctcctgcaagtgcaaagagtgcaaatgcacctcctgcaagaagagctgctgctcctgctgccctgtnngttgccaagtgtgccaggctgctaggcaaaggggcatcggagag

SEQ ID NO: 627804 - DNA, 96 bp, Homo sapiens
gatgtcagattgatttgaaaggtgtgcagcctgatttaaaaccaaaccctgaacccttgtaaagggcaatataacaaatattccacgctcaaaaaa

SEQ ID NO: 627805 - DNA, 819 bp, Homo sapiens
  misc_feature (3)..(3): n is a, c, g, or t
  misc_feature (90)..(90): n is a, c, g, or t
  misc_feature (95)..(95): n is a, c, g, or t
  misc_feature (111)..(111): n is a, c, g, or t
  misc_feature (125)..(125): n is a, c, g, or t
  misc_feature (127)..(127): n is a, c, g, or t
  misc_feature (131)..(131): n is a, c, g, or t
  misc_feature (177)..(177): n is a, c, g, or t
  misc_feature (183)..(183): n is a, c, g, or t
  misc_feature (252)..(252): n is a, c, g, or t
  misc_feature (255)..(256): n is a, c, g, or t
  misc_feature (262)..(262): n is a, c, g, or t
  misc_feature (267)..(267): n is a, c, g, or t
  misc_feature (272)..(273): n is a, c, g, or t
  misc_feature (279)..(279): n is a, c, g, or t
  misc_feature (286)..(286): n is a, c, g, or t
  misc_feature (288)..(288): n is a, c, g, or t
  misc_feature (292)..(292): n is a, c, g, or t
  misc_feature (304)..(304): n is a, c, g, or t
  misc_feature (317)..(317): n is a, c, g, or t
  misc_feature (331)..(333): n is a, c, g, or t
  misc_feature (335)..(335): n is a, c, g, or t
  misc_feature (362)..(362): n is a, c, g, or t
  misc_feature (368)..(368): n is a, c, g, or t
  misc_feature (420)..(420): n is a, c, g, or t
  misc_feature (480)..(480): n is a, c, g, or t
  misc_feature (489)..(489): n is a, c, g, or t
  misc_feature (516)..(516): n is a, c, g, or t
  misc_feature (518)..(518): n is a, c, g, or t
  misc_feature (521)..(521): n is a, c, g, or t
  misc_feature (529)..(529): n is a, c, g, or t
  misc_feature (536)..(536): n is a, c, g, or t
  misc_feature (539)..(539): n is a, c, g, or t
  misc_feature (546)..(546): n is a, c, g, or t
  misc_feature (588)..(588): n is a, c, g, or t
  misc_feature (590)..(594): n is a, c, g, or t
  misc_feature (603)..(603): n is a, c, g, or t
  misc_feature (607)..(607): n is a, c, g, or t
  misc_feature (609)..(609): n is a, c, g, or t
  misc_feature (613)..(613): n is a, c, g, or t
  misc_feature (615)..(617): n is a, c, g, or t
  misc_feature (619)..(625): n is a, c, g, or t
  misc_feature (628)..(628): n is a, c, g, or t
  misc_feature (640)..(641): n is a, c, g, or t
  misc_feature (643)..(644): n is a, c, g, or t
  misc_feature (649)..(649): n is a, c, g, or t
  misc_feature (652)..(652): n is a, c, g, or t
  misc_feature (657)..(657): n is a, c, g, or t
  misc_feature (666)..(666): n is a, c, g, or t
  misc_feature (669)..(669): n is a, c, g, or t
  misc_feature (676)..(676): n is a, c, g, or t
  misc_feature (679)..(679): n is a, c, g, or t
  misc_feature (686)..(687): n is a, c, g, or t
  misc_feature (689)..(690): n is a, c, g, or t
  misc_feature (692)..(692): n is a, c, g, or t
  misc_feature (697)..(697): n is a, c, g, or t
  misc_feature (721)..(721): n is a, c, g, or t
  misc_feature (729)..(729): n is a, c, g, or t
  misc_feature (814)..(814): n is a, c, g, or t
gcnggcattacaggcatgagccaccatgcccggctaattcttgtatttttaatagagacagcatttcaccatcttggtcaggctgggctngaacncctgacctcaaatganccacctgccttggncncccnaagtgctgggattacaggcgtgagcgaccatgcccggccatttgtnattgtnatcgcattggctctggcatctaccaactaagaggataagttctttgaagttgacacataatagttttcnatnnatggtngctangatgnngatgangatgatnangcanaatgtatgatanccatgaggatgangatgatgacgaaannnangatgatgaaaatggtgaagatgacgangacganggtgacgtgtgaggtatacgagttcaggctcttgttgtattttgtggttgtntttaaaccaagtgatctgaggctcggggacaccattagcatgacagtctaaagtggtggnactgctganggccactgtgtcatcactgaggtttcncnggnggtatggngcttccnganctctgantgtaatttctttcttctggaggatttcttcccctgtgtatantnnnnngggctcggnaggnanaggngnnntnnnnnnncanggaaacaaacannanngaaanaanaagantgaaggagngcncctaagnganggccatnntnngngtgcnaatactgtagtgcattgttctgtnataactgncgcagtaaaatccaagtacgtctctgtataagacttgtaactgtgcagacagtttcaggtctctcctccgtcggcatttttccantaaca

SEQ ID NO: 627806 - DNA, 491 bp, Homo sapiens
  misc_feature (394)..(394): n is a, c, g, or t
  misc_feature (405)..(405): n is a, c, g, or t
  misc_feature (449)..(449): n is a, c, g, or t
  misc_feature (455)..(455): n is a, c, g, or t
  misc_feature (458)..(461): n is a, c, g, or t
  misc_feature (466)..(466): n is a, c, g, or t
  misc_feature (471)..(472): n is a, c, g, or t
  misc_feature (474)..(474): n is a, c, g, or t
catctgctggccctatctcactcctgcttccaggggaacccaaccaagccaccctcctgaactgttctgtgtcaatgaatgagtgtctctcaatgagtgtaagctggagggaaacaggactctctggcccctgcacacagggcctcccatccacaggctgccccttgattgcttttgcacacctttaaagatggggtttgtttctctcccatcatgtactcctcagcagagtggagtatgctgtggtctgtctccttctgaaatgcctagaagtccagcaggtctgaaggcctctcacaggtccatgaggacaagaggcaaaagcctgggtggaggttccaatttggggtgagtcccttctcctccctggtcccttctcctccctgggtcttantgccccatttntgaatggacgaacagaccagagggtctctctctctccccctcangtcccncgnnnngaccncaganngnatctgttacttaattga

SEQ ID NO: 627807 - DNA, 329 bp, Homo sapiens
tcagccatacatctcctactgtatctaagggatgaatggactgaatagaatgcactgcaataaaaggatacgaatagaatgaaaaagaatagaatggaatagaacagaatggaatcaaatcgaatgaaatggcatggaatagaaaggacctggcatgaaacggaatggaaaggattcgaatggaatgcaatcgaatggaatggaatcgaacggaatggaataaaatggaagaaaactggcaagaaatggaatcgaaatgaatggagtgttatggaacggaatcaaaaggaatgtaatggactggattggactaggatacagtagggaga

SEQ ID NO: 627808 - DNA, 464 bp, Homo sapiens
  misc_feature (1)..(1): n is a, c, g, or t
  misc_feature (196)..(197): n is a, c, g, or t
nttaacctcccaaatagccctactgctgaccggaagcccctactgataatataccacaatcaattagccaccatattttgtagggttaatatgtattattgtacctatatccctgacaaatacagtaagctagagaaaaaaggttattaaagaaaataataaagaaaatataattacccatggctgggggtgggtnncacgcctgtaatccccagcactttgggaggctgaggtgggcagatcacgaggtcaggagattgagaccatccctggctaacatggtgaaaccccgtctctactaaaaatacaaaaaattagccgggcgtggtggcaggtgcctgtagtcccagctactggggaggctgaggcaggagaatggcgtgaacccgggaggcggagcttgcagtgagccgagatcgcgccactgcactccagcctgggtgacagagcgagactccatctca

SEQ ID NO: 627809 - DNA, 1288 bp, Homo sapiens
gggtgggcagtgggctgccccgaggtcgccgtgccaccacgttggaggcacgaagctggaacggaggaggctgggaggaaaccccagctggccgagagcccagctgggacgtgccctgcacagatgcggaggcaccgatgctggggactgtgcccagaccttcaccaccctgagaaagctagcggaagcaccaagaggcccactggtgtggggctcccgacatgctccctgtggccgggacgggaggccctccaccctgctttacctgcccccgactgctgccacatggtgtgcaatgacctgcatgtctgccctgagcctgccacgggcagaggcatgctgctgacgctgtgcccgtggggcacccccaacccctgtacatttgcctattccaatggtgcagctgctggcaccaaggcccggggatgtcacggcaggaagccccccaagatgatgcaagtctcctcatccagcggtgaggcaggtgggctgggagcactgcttgctgaggaagcttccgagaccgtctcactccaggaccctatcatttcagggggtgaggagcctcacaggtaagtaggcaatgctggtggctgcatgctatggtcttacccaaacattgtgccaggaactatccacctgggccttgaattggcggagctggcctgtgaaacatgagcggaagagcaagtgggcaaagtcctggggaagtgaatggtgccaagtggatgtgcctgtatgaaggggcgaccagggactggacggcgcatacgggcgcttgacacaggtcatcttcataacccttgaagcctaacacgactcgtatcaagtgaccccccagattcttgcatgactaccctatacatactttcagtacatacatgccagataagtccgcggatgtattttcacacctggataccctcctttgccttacagaaggtgagtagcgggtaccaccctacctcataccatcacagggtgtcattgttgccatcagactgatagagccccaagagcggacaagccactggcggctgagacgtaggctggtcgccatagcattacactacagcaaggccctatagaacagaagtgcacagtccgccgcctactagacacgcaggtagacgatagcgaggccagaacgtccgcagaaactatagcaacaacagcagacagcaaggagcggaaaagatgcaggcgaagcgatacagcagaacagatcataagacacagcgtagcggcccgatggggagaagtaagaagagcagtgagaggtctaggg

SEQ ID NO: 627810 - DNA, 1186 bp, Homo sapiens
cgagaagtggaactgaggggtcacatggcacttctgtgttgggagcaggccccccaaaatctggccataaactggccccaagaactggccataaacaaaatctctgcagcactgtgacatgttcataatggccctaagagcccaagctagaagcttgtctatttgacggggatgagggcaaggaacacttggcccaggccagggtggaaaaccacttaaaggcattcttaagccacaaacaatagcatgacgcgatgtctgccgtaaaggacacgtgctccgtgactgacaaggtcaactaggcccaagaatgatatcctttacatgtgtggaccctagtcgcctatcggatttccacagataaggggaataactacaaaacagatatcaactaaacaggacttcattattagaaaaaagaaagttggcataagatgacagtggagatagaggacgttggttacaattagagagtcagagtaggggataaataatcatagtaggttacaaggagagcattcgtacaaagccgtcgttgaaaggggacgttgataaagagaacaccaccattaggaaaaatcatcaccacaatatatatcccaagcaaaatgggatcacaaactaggtaacaaaaacatagcgtgtaatcacattgtgacgagaaacaataaaatacaaaattagaaccaaatacacatcaagaaaatcacacaatggaaataatgaggaaaggaaattaacagtaggaaaaacaataaaagaaccacaagaaaaacaagcaaacaggaaacaacgagaggacaaccacacaacaaagaaacacaaaacaagacatagaggagggaaagaaagaaaacaccacagcaggacgaaaagcaaccagacacacgaacaaaacactacagccagccggacgaccaccgccgaaacccagaagggaggtacagggcaacccgagcggaacaggaccacgaagaaacaccacgcaccaatgaaagtaaccagacacgcgggaaaaacacaacacacaggcaaacgagacacaatcagagcacaacagagagaaacaacacgacagcagaaccacaaccacaaccaacaaaaacaacaacaccagaaccaaacagaaagacgaggacacgacacagacagacgccaccgaagacgcaggaccggagcagcctca

SEQ ID NO: 627811 - DNA, 256 bp, Homo sapiens
caacatatacaagactctgaaaaattatgaactctaattaaaaccaaaaagaaagaagcattctattatttatgacctttcctaacaggactcaatgtgccacctgacatctgctagtgatgatctggtaatatacaacctgtccagtagccgaacagtttgtctatattgtgttatctaaccgtaagagatcattaaaggcaacagcctatatgacgctgtacacacaaaaaaatggtcaccgtgggccatacta

SEQ ID NO: 627812 - DNA, 388 bp, Homo sapiens
cttcatcatgctagcaggagcgggaacggcggcagcagcagtctagagcggggcgtggggtgtgccccgaggaaggatagcctcttgaagccagggctcagtggctgttgtggagaggggccgccgccgatgtccactcaatgccatgcacaacgagctcgcgctaagtccatgtgcctcccaaagcagtgggctgcagctggggcagtggagccccctgccccatgccccatgccatcccaaagagccccattcccaatagactggaccaagcgaccagcacactgctccactggccacgttggcgtccacttcagatgaccaaagcagcttccatcttcctgttccatcctctcagcagtggctctggacccgtcctcgcctgacg

SEQ ID NO: 627813 - DNA, 134 bp, Homo sapiens
ggtagccgggcagtactgggctctctgcactgccctcctgtgcaaaatctgattttgaagctactctcatcctctgcagccctcgaccgctacacagagttcttccaactgttccttatttgtcattactaccc

SEQ ID NO: 627814 - DNA, 579 bp, Homo sapiens
ccactggcgtcgcccacgcgctccggcctgcgtcgctccgggagctgccgactggacggagcgccccctgcccgcgacctgtctgagcctaccgttgccgcaatgcaccgatcgtctgaacagccgaagaggcatgacatgactgtctacccggaccgcagcgacgacggtgaccacgattcgtgacgcagcaccagaatgagaaacagagtggccacagtgtgctgagatcacacggaggcctatgtcactagcacgcagcgacggaccccaacaggaggcacagccgaccacggagatacaaccgcctgggagcggacaggtccaagtacgccacgaaacacagcgacggactagtcaaaaaaccccgggggaccaacccacgagtacgctccctgttgacaccaggaggggagcatggcggacaaggacgagcgacagaaacgacaagagcagataccgagaggagcgcaaaggagggataacacagcggaacgaacatcatatacagaaggccgagataaagtgcgggagcgacaccacgggcaaccgggcggcgcataacagacaaaccacaca

SEQ ID NO: 627815 - DNA, 383 bp, Homo sapiens
atggcccctcccatctacacagatgtcttagagtttgacgatggtaagaggcctggagtctcctacccccagggatgctttccctgtgttcctgggtccaggaggtcctgcccacttcttgtctggggcgtcttctgtgcatgtctcaggaggcttttgggctccttcagttttgcgtatgtccggaggagggtactccccctttgatgccttgtgtaggggcagtgtctgcttcacagagggggggcatgatcccaggttggacatgagcctgagaatagccctcactgcttgtcgttggccaggcaccccagctaccatgtcccagatagccaaggatgtgtgcaccttcctgcgctgggcatctgagccagagcacgacg

SEQ ID NO: 627816 - DNA, 1022 bp, Homo sapiens
ctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtcta

SEQ ID NO: 627817 - DNA, 1644 bp, Homo sapiens
  misc_feature (640)..(640): n is a, c, g, or t
  misc_feature (1177)..(1177): n is a, c, g, or t
tgtttgtctttacttctttcacttccttccttgctctcttggttctcgcttccttttttctctctgctacgttctttgtctctccttttcccttcgtgtcgtccgtttcttgtcttgctgtctggttgttctccctctctcgctagtctttttgtcctctggtcgcctgtatgtgttctttgttacttctgtttccgcctttgctcttgacttcttgtttctttctcgtttgttttctgctcttgtctttcctgtctgtccgcttttgtgtgtttcctcctctctgtggttatattttcttcttcgttgcttctagggttgttgtttttctgttttttgtgttgcctcctctcgtttgttcttcttctccgtgtgcgtgtcgtcgcattgcttattcgttgtccgcatcgtgtggatgtgtgtgtgttgcttgtacttatggtgtctcttgtgtttgtgttttgttttttttgtttgtttcttgtttgccctttttgttttgttgtttgtgtggttttttcgtcttgtttgttgtttgtggttgtttttttgggtttttgttatctctagtctttttttgtgtggttttggttgtgtttggcgtgtgtggggggttgctgttgttggtgtgtgtgttttntgcccgccgcccgacgtgtgaagtaagaacggcgtcaacacaaggtggtaaaaacgcagttcacccctttattgggtggatccacagaaacacacccataaacgcgatttttttaagagggggcacccccctctatataggaggaactctcgccaaagagtgatcgcccaccccacgaggtgtggtgccacccccaaaaaaagcccccgcgccctttgttgtttaaacccggcccccgccccccccgtgttgacacttttttcaccacgggctctctctataagggttttcccgaagcgccccctggggtgtgcccccgaaaattcttcgcgcacacccgagaggcccttttgtgcgctccccctctgtggggaggcgcccctctctctgggggggacaccgggggacacttctctataagaagggagactctatattttctcttggagaagcgccttggtgggttccccaaagcccccactattgttgtctctgggcgaatatataaacgcgcggggtcttctccgggagacaccnaaaagggggagcccacacacccacgcgctctctgttttttataagaatgtgaagagtgtttctacgcccccgcgagagatgtgaacaccgcgaatatttctatattggggcccagaagaataggcgcctctttatgtttatatatataatacacccaagaacacccaccccgcgtccactccctcgggcggcccacacctccacacccaaacccagagtctatcttggggagaaagatatacatctcgggcccccatggagacaccacatggccaatggttctcgtgccccaattctccgaacacccatctttctcctgcgtaagcgccccttggcaccaccacgaatcccgagtgatgcctgtacccccccaggattttaactaaccggaaaatcccataaataaaagtggatttgttgctcttgtatttttaaatgggatttaaaaaccttactcccctttaaaa

SEQ ID NO: 627818 - DNA, 884 bp, Homo sapiens
ctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtcta

SEQ ID NO: 627819 - DNA, 497 bp, Homo sapiens
tgcgtgatacagaagatagtcgcctagagggctggtgtctgtcaggaggttggggcccagcaagaaagtacatccgtatgaaagttcaaatggactatatcctgtagcttcttgaggataggctctaattctaaggagggcaaatggtaaaagtgctgtccagtcttttttaagttggaggctgagcttggtgaggtgtgtgtttaaaagaccattagttctttctacctttcccaaagatgaaggatggtaaggagaatgaagcagctgatggagccacaggagacgctgcaggggtgggggctagggaggctttagaagggggaacaaacacgagatacgcttattgtgtccgcgcctgggcctgctctagagctcatcgcgatccactggaatataaaggatgctccaccctgtcctgactcatatcgaccaggccaagcccgcaggcagaccccatggcgacctctgaggatgccgctcagatacacgatgaa

SEQ ID NO: 627820 - DNA, 1626 bp, Homo sapiens
ctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtctaaaaaaaaaaaaaaaaaaaaaaaaaaaaaggggggggccctcaaaattccccccggggggagccaaaagcatcgtagccaggcacccgcaggtcgttgttggaaaagggggggccccattagtaggggagggccgatatatataaagagacgcagagagcaagcggagggcgcggtcttataaaaagaggtcagggaaatagggggaaaaaaaaacgtcaatacacgggggactcttgtggtgagaggagagaacgcaccaacattccggcggggcggggagacacacctaagggtgggggagaaacaactcatccccgcagagagaggatatataagagacccctctgtgagaggggagaatatatatataagcacacttttagaaggggattatatgatggtggtggtaacaaaccaagagcgaggaaaaataatatactgtagcgggtggtagcgtagaaagaaagtgtggcccacgagggggagaatagtaattgtgtggaaaacatattatttttagccgagggagaacgtgtgtataataataggtagtatgtatagatgaggtgtgtaatagaagtggaagtagagagaagtgcagaa

SEQ ID NO: 627821 - DNA, 521 bp, Homo sapiens
cagtttcgatgggaagagtacaccttccacgggagactgctactattactggccagggtgaccacaacgattcctacgctctcctgggcgagctgtgcccctgtgggtccacagacaagcagaactaacttaagacggtggtgctgctggctgacaaggaagaagaatgtggtggtcttcaagtccgatggcagtgtactgctcaacgagctgcaggtgaacctgacccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaaacacctggaaggcacagtcaagctggcatgacacgctggactggttggacgatccc

SEQ ID NO: 627822 - DNA, 390 bp, Homo sapiens
agcggccgcctactactactactactactactaaattcgcggccgctcgacttttttttttttgagatggagtctcgcactgtcacccaggctggagtgcagtggcgcgatctcggctcactgcaagctccgcctcccggcttcacgccattctcctgcctcagcctcccgagtagctgggactacaggtgcccgccaccacacccggctgatttttttgtatttttagtagagacggggtttcaccatgttagccaggatagtctcgatctcctgaccttgtgatctgcccgcctcggcttcccaaagtgctgggattacaggcgtgacgactgcaccctgcctggctcccccgcccttcactctcccttcgtcctctgtctgtcgacg

SEQ ID NO: 627823 - DNA, 984 bp, Homo sapiens
cctttagtgtgggcacagtggggcgaacgggtcggtgcaatagggtggggccgagttggggatcgcgtacgaatgtgcgcgccggctgtctgaggtttagagcgctgtttgtgttgcgcgcggctaatgtgggcgcgtgttggcggcagatttgggcggttggtagcagtacgaggcgcacgcgatggtgggttgggggggtcaattcacaggctccggggagtgaacggacgaactatattgggagacagtttgtggccgctctgttcgcctcgcacttggcggcgtgtttgtgcaagcacacggttctgtgtccgggcgggcggcggggccgtgcgcgcgcgtttgatggaggggcagggcactgtgaatttagatgtggccgttgaggtcattggggcacgggtctcctgtcaagtgttgaccgatagtgagttagcgtcgtggcctcccggaggctgccttgtatggtttggttgcgtggcccgctggttagcgcaagggcgactcagggacgtgtgaggccctcgcaggatgtggacgtagcccccgcacgctcgctgtcttctcgctcttagggtgtcacgggcccgccgccgtcatagcggcgtgtcttgtgtgcccccatcgggactgctgtgggttgacgtatggaagggttctccggctaagcactcttgggctctcacttctggtgcccccgcttttttgtggcccctccttccgcccttgcttatgaactcgcaatttgttatcgatcaaggcgctgtatttgttgtaatgccccaccgtcatttagcgcaggtgtatcccccacatgttatactcaacgtgaggatagagtgaaactacgccacgtttgtgccacaaacacacaagtcccccccgcttgtatctgtcccaccgcctctgtcctgccccttcaccttcctcgggtctccagccacatttcgcccccttttataatctacgaactcccaaaac

SEQ ID NO: 627824 - DNA, 1130 bp, Homo sapiens
  misc_feature (535)..(536): n is a, c, g, or t
ctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttgggatggagtcgggtggagagcccactctggctagggggcggcaggctgagagctcacctgttcagcagagaagtggaactcactttgctcctggagcctnnctacacagtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtcta

SEQ ID NO: 627825 - DNA, 80 bp, Homo sapiens
  misc_feature (14)..(15): n is a, c, g, or t
tttacataaaattnnatatatatattttttcttccagttaacagtcttttctcttgggtgggtagaccaaacccaagatc

SEQ ID NO: 627826 - DNA, 164 bp, Homo sapiens
gggggggtcccccccagccccccgccccgtttcctttttgtttttggtttggggccccggcccgggccctttgtcctggtcggtttttaaataattttttaccgggggaccttttagccctgggtgccttttccaaggggccccataaaaaaaggggagcccca

SEQ ID NO: 627827 - DNA, 120 bp, Homo sapiens
ctatggcacctcctggtgtctaactcccccaaagacaatgagttatgggagagaattagaacggcgtgttacagttattggcaaagaagcatgacaagagcaacagcactttgaaattta

SEQ ID NO: 627828 - DNA, 1140 bp, Homo sapiens
  misc_feature (233)..(234): n is a, c, g, or t
ctccactatggacagagcctccactgagctgctgcctgcccgccacatacccagctgacatgggcaccgcaggagccatgcagctgtgctgggtgatcctgggcttcctcctgttccgagagtcacaggtctggggctggggaacaaggctgttgtggaaactgcaggtgaagctcatgaggtggcattttcacaggccgagacttttcccagcctccctacccactgttttnnccaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtcta

SEQ ID NO: 627829 - DNA, 816 bp, Homo sapiens
  misc_feature (738)..(739): n is a, c, g, or t
ctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgagagcgggaggagaaggtgggacataggagggaaccctacccctggaattgacttggactctgggtctggaaacgcaagttcaaatctcacccatttgttccaggaggttctggctgatgaggaagacccttgtgggaggggggcccctgccctccagttagctcttcttggctgtgctgggttccatgttctcatgcagggatggagtcgggtggagagcccactctggctagggggcggcaggctgagagctcacctgttcagcagagaagtggaactcactttgctcctggagcctnnctacacagtacttatctgggaagggaatgccggactcttgttggcccctttgtccccccgactggcccccttcgccg

SEQ ID NO: 627830 - DNA, 803 bp, Homo sapiens
  misc_feature (577)..(577): n is a, c, g, or t
  misc_feature (601)..(601): n is a, c, g, or t
  misc_feature (605)..(605): n is a, c, g, or t
  misc_feature (611)..(611): n is a, c, g, or t
taaactttgctagagaactagtttgcctcccttaaactgccttctgattgtgatcatgatcagtaggtgggattaccatataatattcttgatggtgacctgttgctgtgacttatctcgcaactgttgtataccttcacgtgcaggtgagatagtagacgttacagagatcttagtcacatgattgtgctgtctttgctgacatgcgacaagtatccctcaacgtggagtccttgctagcactcgtgaatacaatatcacaggccacgagaccctttgtgttactctcgtgttatataatacatagaatgaaaatcacatttttgttccatagtggcatgtagctacaaatatttaaaggaggagaaaaggtaatataatttgtgaggttataccaagatatggtgtgtattcaaataatacgttgagccagttatctaaaatgtacgataattttgaggtagcttatgaattgattttaattataatgttcacaagcttggaatattagatattatttggcatctgtaaactaaccgtgatcatcatttcttgtaatttcttgtacatgtatatnacttgttcttaatagattttgganacangacttnattgagatcagtttggtttcctgttaattacctgtttgactttataatgtgttttagttttgcagaggacactgttgtagtttagaggcttttcataatccctcatagcaaagatgaaactcccactattttttccctctgaggagacatactggaagaaatgttagcatctgagtgtagtatagctattgt

SEQ ID NO: 627831 - DNA, 143 bp, Homo sapiens
ctagaggacccgacatagccatgcatcattgttgctacgaggctcgaagtctatacaccacgtgcagtagctttcctccgtgtacaagtgccgtcgacaagtgagcaccgtgctgacctccaaatatcgttaagctggagcct

SEQ ID NO: 627832 - DNA, 592 bp, Homo sapiens
taataaaaaaaaaaccccgaaaaaaagtgaggggggagaggagagaaaaaaaaaaaaaagggggaaaaggtttacaaaacacagggacaaacagcgcgcaacacagagacagacccacatgtagcaaaacggggggggcaagcaagagaaccccaccacgccggcgggcggaaaaacaccagcacacgagaactacgcgccaccaaacacacccacgcaacccgcacccccgcacgactccctcctttcttctatcctccccactatcctcttttcaactctacctcaccacacaataccttctcccccaacactacacccatccgatctttgctatcacacaccccttctcacactacccactctcatccccaacaacactcactacacaccacatcaacatttactgctgcgtctcttcactcctctctctccttatctccttccccaccacaactcccaatacctcttttccccctccgcccacttaacacctcctttctcttcctccactcttgtactctacctgtcctcctcctaccacccaccctcccccctccccctctcccttctctctcccttcccaccactt

SEQ ID NO: 627833 - DNA, 302 bp, Homo sapiens
gggtttccccccttgggtttttccccccccccccccttttttaaaagggttgggggggggcctttttgtaaaaccaggggggtttttttgattttttttcccctttggggtttttggggggggggggggggggccggaatttccccccccccccccctttttttttttttttggtaaaaaaaaggggttttttttttggggggaaggggggggggggttttgtccccccccggtttttttttttttaaggccatccccccgggcccggggaaataaaaaatttgttccctttaaaatcccca

SEQ ID NO: 627834 - DNA, 771 bp, Homo sapiens
  misc_feature (123)..(123): n is a, c, g, or t
  misc_feature (143)..(143): n is a, c, g, or t
  misc_feature (493)..(493): n is a, c, g, or t
  misc_feature (671)..(671): n is a, c, g, or t
  misc_feature (686)..(686): n is a, c, g, or t
  misc_feature (700)..(700): n is a, c, g, or t
tgggaagccccggcacacgggccagaacggcagggcccggagcagggcgccttcgtccacgatccctccaggggcacagttcaccacacgcaccccctttcttgcacgtgggcaaagggtgtntgtcattcagcaagccgtgntcggtggagggcaggagaaggaggtggtgcacaggtgagtgaaactccacagagaaggccagaatctccctccgaggggccagcgtgcgtgaacaccaaagggaggccgagaaccctcgtggggaaagtgagtggggctcataccctaatagtcttcatcccaagaggacgtgcatccgggatagctaccgtctcttcccaattccgtgcccgaggccaagaaattccccagggctctttcccatttcagcctcgtgttcccagtgaaactttcttccggctcccattgtggccggtcctttcactcgaagccgtcgccgtggggaaatcgtgcctgtggccaggccacntgatcattccacaaggtgagtctctggcggcactgaggcgtgttcccatggggggtgttcataaccaagatgcccttcctggtggcgggctccagatccacatggtccacacctgtgccagcctgcccaccacctgggagtttctcagctgcgttgatgactcaggggcaccttgggnggcaaagcgaacaanagggcttcacaagncctgagcccgaataaacctctgggaagggctggtttcccccatggggccccattgagaattcccgcgaggg

SEQ ID NO: 627835 - DNA, 939 bp, Homo sapiens
  misc_feature (184)..(184): n is a, c, g, or t
ggtgggggctagtggcaaaagatggtggttgccgtacagtcccgggtggtccggggtcctgtcattgtcaccgtcctgccattaactgctgtagccacatctgtgtgtctacggtccacccatgctagccagctgcattctatgcccttctatgcctctatgtggtaacgggggactgataccntgcagttcagttggggaattgtggccacttgatgtatcgcgtagtcgttactagagattcgtgtgtggcgatatgttgtcaaccacctctggacgcaatggtggtcacaaggtcacatcataccctatcgagtgtgataaatatgacgtcatgcacccttggtcccaatgtgggtgaccctggtgaccagccttctgttaatctggaaggggacgcgagagaataatcgaattctattccgacgatgtatgtacagatcagcatgcgatgtgtggtcattcaatcttagtggtgacgatgactggagataacaaaaaacgtttgattttgcgctggaatgtattgcgtgaaagatgcccctaagctacatgttgctctaactgttcaacggaaagctggcaggtggctcattcattctatgttgtcatcactctgaatgctgacatattgtaacatgctctctctaggattgcgaggactctagggggtcggcgacgacagttcgtgagagatgcatgtccggaggcattcatcgtggacgcggcggacgttttggacgacggtttgattcgtaatgctttgcaagcttgcatcgggtcggtggatgccctggttctgggctggagccggtatcaccggtttctcgtgttcccggatggttgggtcagcccgaccgggggccttgtgtaggccgcggccccccggggctggggccagggtcaccccgtttagggaggtttcccggggagggggcc

SEQ ID NO: 627836 - DNA, 373 bp, Homo sapiens
ggagacagagtctcgctctgtcacccaggctggagtgcaggggcgtgatcctggctcaccgcaacctttgcctttcagggtcaagcagtttttttgcctcagcctcccagggagcagggattacaggcaagcgccaacacgcccagctaattttttgtttgtttgtttgttttagcaaagacagagtttccctatgttggccagtctggtctcaaactcctggtctaaagtgatctgtccgccttggcctcccaaagtgctgggattacaggcatgagccaccacgcctggccaatatccatcattaagggttaagttaaaatagcttataatagccataggatttagatttgctatttgcagtaaatctaaa

SEQ ID NO: 627837 - DNA, 179 bp, Homo sapiens
  misc_feature (126)..(126): n is a, c, g, or t
  misc_feature (170)..(170): n is a, c, g, or t
gagaacttgggaccaggtttcctatgggggactcagtttcagagaactgagacagaagctcttctgtcgttatattcttctttcctttttttggatttattaaattattttctagtggtgtgaagntgacttattaacatccacacgacattgacgtgacttacttacanacttccaca

SEQ ID NO: 627838 - DNA, 1288 bp, Homo sapiens
  misc_feature (916)..(916): n is a, c, g, or t
atctccacaccgcccctcgtctgtccgtcttgtgagttgttgttcgctgtttttcgtttgtcgtccctctgtggttacatatgccatcatctcctgcagcaaagatgtgccccacaaccgtggtggtttatcaacccccggtgttgtggtggccccctgtgcctgtttctcccgggggcgctgctcgatcctcgtcgtgctgtcttttttccttggggggtgctattaaccccctggttgtattaccacacacaccggtgtggggctccgttttatatccccctcgcttggcaatatactaccccccacggaggtgtaatccgaagattttttggggggacgctccctcataccgaatgggaggaaaagggcccccaactaacaggggggcggccccaccacagacaaacgggggagccttgctaaaggcccccggccctccgcggggtcttcgcccgcgccacaagagccccacaagggtggccaaaacctgtggagacatctggtctcacaaatggagaggtatttgtctctcggagaggccacctcttgtgtagaggaaaatctcctatagaccactgtgggcgctctgatctcctcgtttgttttcgccccacaagatgccccctcttcgggacacactttggtgtccacacaacacttctctccccccacgtgttccccactcacacggtcacagaattttgtagaggctggaaaaggcggccttatcgagatgtcccccgccacacgctggtgaaaacacatctgttctctatgggtgcacacaggaggccgtggggtgtctgccgcggtcaccccttgaagccctcttgtgtgtgcttcccggccacacacacgagggtttcccgcgggtctctggcccacatggtcccctcaacgccgggccacatgnggtgtggaggccccctcaccacggcaaagggggcttgtctggactttcccactgttcacgggtggtattttctaaagtgctcccttatatgtgaaatttcacaacacacgcgtattggaaattcacttcccgccactggaacttctgggatcacaaggctctttccttcttcttgtttgaggacagttggttgttttaaagcttaaatgtaagtttctacttttacaaataaactttttctggctgtggcactctttttcttgaccctggtataaccgaacaagtagtttcacgagtatttgagtttaacccttttcccagaaagtaatacatgatatggatttatttatgcacttaaaagagccaaattta

SEQ ID NO: 627839 - DNA, 283 bp, Homo sapiens
ccattgagcatgagctgggctcagtgacattccgccggctcaggtccattcgaggactacagactgcttgtcataacacctggcggcactacggggggagacagagacctcagccctcgagctctcagcagcaccacagttcccaggctccccagctccaagggtgcaccccagctctctactggccacacagactacagggtagcaagaagcacctgacctcagccacgagcactgggattggaacccaactccatcactcactggaaatgagacctgagca

SEQ ID NO: 627840 - DNA, 405 bp, Homo sapiens
gacgttgaaacttttgaaaactgttaatggcaatgtaaaatggtgcaccactttggaaaggagtttggcagtttctcagaatgttaaacatagagttaccacatgactcaccaattccactcctagatacctacccaaaggaagtgaaacatgactgtgcaacaatttacacagaaatgttcatagcagcactaatcagaatagtcaaaaagtagaaataacccaaatgtctatcagctagtgaatggataaagaatgtgacatatctataaaatgtgataatattctgcattaaacaacaacaacaacaaaatttaagtgctggctaggcacggttacagatgcctgtaatcccagcattatgggaagctgaggcagaaagattgcttcagaagtttgagatga

SEQ ID NO: 627841 - DNA, 287 bp, Homo sapiens
agaggatcccgctggcatggactacacgaggcggagtgagttttgggctgatggactgtccagtggttgctgcgggcttggggtggtcgctggtctgcacactgcagctgtgggctaggtgaagtgttgtggctcctgccatactggcagcagggtgcagcccgtcagcacagctgagtgccaggcgttgggtgacccccattacgtcactctggatgggcaccgattcgatttccaaggcacctgcgagtacctgctgagtgcaccctgccatttgggccagcggg

SEQ ID NO: 627842 - DNA, 797 bp, Homo sapiens
gagatcaggaccatcctggccaacatggtgaaatgccatctctactaaaaatacaaaacttagctgggcatggtggcacatgcctgtaatcccagctactcaggaggctgaggccagtagaatcactgcaacctccactcccgagtagctgggattacagacatgcaccaccaccctcagctaattattgtatcttcttagtagagacggggtttcgacatgttggccaggctggtcttctaactcctggcacttacgtgatccgccacacccttagacttccaaagtgctgggattacaggtgtgagccactgcacctgagcctgtacgtcgcttacaacacttttccttgacgaaacattcctgacctttacaaaactaacccttatactcagtacaagtgacttgtgacaaactgacgtaacacaatggccattcatgatgctctgacaaccaaagccctacaactcgaacacttcccgaactcagcactacactgaatttcccaccacgcgcacccttcaaggctttccaccactcctactgactcgaaacacacaactctatctcgaccacacctcctcaactttcacttcctttccctggtacggacttattggctacctcaatacagctattgcagacatgaactacaagatggcatgggtacaccttgcccagtgggtgccagaaactgaactcagacttcttgttgactgttgctcctacggataaccatcgccccacatcaattgcaaatgtaatgatcttgaatctcgaatggtttacccaataca

SEQ ID NO: 627843 - DNA, 343 bp, Homo sapiens
cagaacaggaccttgtctataaataaagaaataagtaaaaatataaataaaaataagtaaaaataaatataagtaaatataaatataaatacatataaatataaaaatgcatacatgaaaagaaacaatttttaaatttaacatcactgagggcatcctatccatttcatttcatgattccattacatcatttcacttagatgaaatgataagatgacttgagatgagatgaaatgatgagatgaaatgacgaaatgagatgagatgagatgatgagatgaaattttgagatgaaatggtgagtagaaatgagatgaaatgatgagacgaaatgacaaaattg

SEQ ID NO: 627844 - DNA, 1216 bp, Homo sapiens
agcggaggcggggtgacgtgtggttgacgagctcggacggcgggtttgctgagatctgtgtgccggctggcagctggtgcggggagtgcagctgagagctgagaggtgggtctggggaacggtgtgtgagccagtgtccactgacggaggtcaagtgccgaagctagtggtgcctcatggaaagcgagcccctgtggtggttcttcagcctgatgctcatgtaaatggattcggttgccgatggagacccagtgtagaaagacactatatgggaggtatttgcgagcactgacggaagttgtcgaatatcacttaaatgcgcatgttcactggggcttacattcggtattcgtctattccaaggtgtgctgcgcccaggtgaggagaggaacctatgccagggctccttgatgggtttcagggatcgtcacaagaacggttggacatcgactccatatgttttccggcctcataggcaagtcgttacattttgacactatactgtcttttgttgccctaaccttccatgtgtctccgattagatgcagtttggtgcttgatcgtggcaactgtgaacccgcgatgacaagcgcaatggtcacctggttccaaggtgccgagtgacagtttgattcgaaggacagtgtctttaaaagccaacatcttttgtcacactgtagaaaggtgttgtggaagttggcgattggcgtttatttggagagaagggcatttggatgacgaattggtaaggacgaaaggtatcataggaaggtgattggaagtttcggtggatggaaaaggaatagacagccagagtttcgcatagggttttgttcaggagcccaaagggaaagcagttggtgtaaaaaaggagtgttgtgatgggaacaggttctctgggaagttaacaccggacacagagaaaaacaacttttcaagcgttctagtaagcgagtctggagaggcaggaaaagtgaacatgtctcattctcgttccaagcaattctagagtgtgccgacgagacgttaagttggtcttatccgccagttggtgtcttcaaagtgcgcgcgcatgcgcacggtagggtacttgataatactctatagtagcgttgggggactttccaccgaaacagtacacgtgggagccccgcacgtgtttggatgtagtacaagggatcgtccaagttgaccatgcattcagtgcccacatgtg

SEQ ID NO: 627845 - DNA, 376 bp, Homo sapiens
gcggcggcaattacaattaagttggcggcggtcggaccccaataattctaagaacaaggggacatgggattcttgaaggtgaaaattgaggtgttattccggatggaggccccaattggtttattattacattacaaggaggtctggaattaagaattgtcccaaattaaggtttaaaacagttgcaattccggaagtttaaacaaaccatttaacggctaaaggaccgggggtaatactagggtcaatgctctgaaatctgtggagcaaacacagtttcaatgccatcgtcctagaattaattcccctaaaaatctttgaaatagggcccgtatttaccctatagcaccccctctacgccttctagaaaaaaaag

SEQ ID NO: 627846 - DNA, 109 bp, Homo sapiens
atcactccgaaagcatcggccgtgctccgcaaataagagagagtggtggatgcgaaatggcggatccgcggcgcaaccaatgatcgagacgtgctgacatcttatctgg

SEQ ID NO: 627847 - DNA, 844 bp, Homo sapiens
  misc_feature (246)..(246): n is a, c, g, or t
gtgcctccacgtcgccggctcaatctgggcagatgaacccagacttccaccgcgcagccccgccagatcttgcgagacctctagcggcgagctgctagtgtcggcgagacctgcctccgtttgcctgtgattcatgggtggctcccatgaatggccaagtgtgtcgtggtgactaggtggccttcgcaggcggtcatgtggcgctggtcggcatgggcgcttagcagactcgtgcataatgacatngcgtccacatgtttacatcactggccggcatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccagggctcatcgtggtcatctcctccccaggaagcctgcagtatactgttcaatgtcccctatggtgtgggcaaaagctgcgtgtgacaagctggctgctgactggtgcccacgagctgcggcgccatggggtcagctgtgtgtctctgtggccggggattgtgcagacagaactgctgaaggagcatatggcaaaggagggaggtcctgcaggatcctggtgttgaagcagttcaaattcagcttctcatctgcggaaac

SEQ ID NO: 627848 - DNA, 415 bp, Homo sapiens
  misc_feature (354)..(354): n is a, c, g, or t
  misc_feature (410)..(410): n is a, c, g, or t
acttcacaatggcccccaacgtgcaagagtaggtgatgctggcaattcacacatgccaaagagaagccataacgtgcttccattcagtggaaaggtggaaggtctcaacttaataaggaaagaataaaaactgtatgctgaggttgctatgatttatgttaagaatgaatcttccatctgtgaaattgtcaagtaggaaaaataaatttgtgctagttttgctgttgcgcctcagactgcaaaagttatggccgcagtgcatgatgagtgctgagttaagatggaaaaggcattacatctgtggatggaagagaaacatgttccaattagatggcaatctggttcggtactatnccaaggtcttcaggcatccactggccggccggatgggggttttctgggagaatatnccccc

SEQ ID NO: 627849 - DNA, 822 bp, Homo sapiens
ataatagtagcattaagcatctcactatctaggaatactagatatatcgcgtcacgatctgcatatcctcccgtacatatgccgtagaaggaataatactatcgctgtgcattagtggctacttctctataaccctcaacaaccagtccctctgtagccaaatattgtgccgtatgcgcgagtactagatcattagccgccttgcgagagccaggcgggtgggcctaagccatactagtctcaatctccaaaactatatggcctagattacgtacataacgctaaagctactccaaggctaaaactacctcgtagccgtaaaattcatattagtacacgacatgagcatgactttaccaaaaatacacacagtaagtgtcgaatcaagcacaatccaccacactagtcgtagattatggtagggatctatccctctactattttgtataaccaaatcagcagcaacctgttgagctgtatcccgagacctttggctgcgagcgctctaaaaactcccacgactctaagtactactcggacctgaagtcctacccgttacaatccattggaagacctacatcgccaattactcctgtaggatagcaatatcagcgaaaatatgtctagactccattatattaaatttagcttttgaaatcttccttcacttataagatggcaaggccacgagagggagtcatggtatgtctttaactacgaaaacatgttgatcccagctggtatacccaccgacgacggaaccagctaaagcgggcgggggcaattctagtaaaactataggctctcatgatagcagattaa

SEQ ID NO: 627850 - DNA, 266 bp, Homo sapiens
aaaaaaaaaaaaggcatttaaaacaatttcaaaacttgggtaatggtaaggattgggatacctctgaaagaatatggcatagctggtatatgtaaggtatgaaggcataatattaaacttctggatttcaaggggaaggaactgggccccttacacccacaggcatataaaaggggtctggtggttcccttcccttcacttccaggcacactgggtggtcctctcttgcacaggacacattttgggaattaccttgaggctcataa

SEQ ID NO: 627851 - DNA, 302 bp, Homo sapiens
ttctgttgatcgactctagagtgtatccccccggagatggggctaggatgattttggctcactgcgacctccacctcctgagttcaaacaattatcctgcctcatccttcggagtaccttggattaccggtgcgtgccaccgtgcccggctcatttttgtattcttagtagagacggcatttcaccatgttggccaggctgttctcaaactcctggcctcaactgatccactctctattggcgcttccaaggctgctgtggattataggacgtgagccaacctaataactgtgttcagttca

SEQ ID NO: 627852 - DNA, 185 bp, Homo sapiens
  misc_feature (136)..(136): n is a, c, g, or t
cccactacgcgttcctgacgaccacgcctgcattgggaactctacacgacgacggacaacctacactgtgacgtgacggacacgtgacctgtactgtggacctggtggacgacaacgtacacgtcaccgttggtgncctcttgacgagacccgtggacctggggtttacggacaccacgttgtac

SEQ ID NO: 627853 - DNA, 135 bp, Homo sapiens
tcctagcctcgacaggagtcccaccaagccctgccccctggtatctctgccttccacgccttcctctttatcctctgtggtctcactggcgaggctaggacactggcgaggctaggaccactggcgaggctagga

SEQ ID NO: 627854 - DNA, 500 bp, Homo sapiens
  misc_feature (237)..(237): n is a, c, g, or t
tctccgggcaccgttcgatgagttttacataaacttcagagccctgcgatcgtgatttcttctctcacaaggggatgagaaatcttctcttagcggctcgtgttcttccccattcctgtgtcctctgctttgaagtggcattccttcgttgaccagaaaccctatcttgtgctcctcaatgggcctgccccggtgcagctaagggtgaggacagctgaactttccattccttctttnctcttaagcgatgggggtcttgctgtgttgcccagcctggtctcaaactcctggcctcaaacgatcctcctgcctctggttcccaagtagctaggattacaggaaacagcccctgtacccagtggagctctccatttcaacaaagagttctgtgcgccaatgcattcccttcagatgaccaatgggcaaagccagtttcttgttgagatttaagccacgaactgaaatatgggatccaatgcttccaaaaggcccagaaatca

SEQ ID NO: 627855 - DNA, 130 bp, Homo sapiens
accgtgctcagaagcttctcgcctaccttggtgatcttgctgtcaacggcagtcagatcaagggtcagatcggtgagcccaagtttaagggcgacatcgctatcccaactctccacgatgagcagaagaa

SEQ ID NO: 627856 - DNA, 381 bp, Homo sapiens
agcgtagagctcccgtaagccttgattcatgcatctcggcaactattgccagagggctatcgtgttctcagtggacattcttgatagctccctcagcttagccttgactctctgcgcatcattgagagcagcctctgtatgctctaaactagtctcgatctgtgttcacatccttgactgcggtatagaattctgatatagcgagcgacctgccctgattggacatttactggagctcagtgttctatctcagtctcgtaccctgggacctaacatctgagtcaggtcatcagcagatgtactagcagcagcagcgttttcatcatgcctagaactctggaggctcagtgcacctgggttagcggcactctgtgtgcgcgc

SEQ ID NO: 627857 - DNA, 211 bp, Homo sapiens
ccttttggttgccgggtcattcacaatcgctacggatgcctcgaaagctgtcttggcgccaaaccagctgtcgtcgtcgacctcgtacggccccagcacaatatctatcggacccttgaggccgacgaatgcgacatcactggcgtagtagtcgtcgtccagcagcgctcgagcccgcaatgtcaggtatgtcctgagcgtcggctcgtgg

SEQ ID NO: 627858 - DNA, 181 bp, Homo sapiens
agaggttcccctctcagcttgtgtccagtagtttcaatcggtcagtagtaaggcatcatataacatagttacaattcagaatggttatgttagggttgtacggtagaactgctattcttcatcctatgtgggtaattgcggagtatgctaagattttgcgtaactgggtttggtttaatcc

SEQ ID NO: 627859 - DNA, 1592 bp, Homo sapiens
  misc_feature (453)..(453): n is a, c, g, or t
  misc_feature (467)..(467): n is a, c, g, or t
  misc_feature (526)..(526): n is a, c, g, or t
  misc_feature (1592)..(1592): n is a, c, g, or t
ctaccataaccctcagggaacgtaccactactatcagcttcgagtctgctgccctgagaggatacgtcatacaaagcctgagaccctgggtgaagtgcgtggagtggcggaccggaagtggtctgatgtctttagtaagtgagattcgcggcgttacggcgacaatacagtggagaggacgaattctgtgtcgcgacgagtgcgagcatcgagttcatgctccagagttgggcgtcagctgcagcactgggctcactctgagaagaactgatatcgatactttgagatgtgtggatggataagatgaactcagccatggtccgcgggcatttgatgagggcgtccatgtggacgcgaggaaggtggcttcaccctgaccaacgaacgagccacatcaagggagtaagcatgattctggtaacacacgactcatgtgggccatgcgtatccaancactgtacgcaatntgcccattggttgagaaccgtacgactatagtattcccgccacatactgcctcttcagntggcacgggagaccgttcgaatgtcgcgctcagcgagagccatggggtgaatgcgtggctgtaccgctaacccatgggacctcaggtatcgcgtctagaagacgcgttaagcccccaacccatatactcacttacgccagttcgccgtcctggtgatacctggccatgcaacctcttaccacgttcgggtacgcgcggttccgggcccgattggaccagggtcgtcccgctgtggtcgtaacgggatgggggtggattcccgttggcccctcggaaagcactctcgggacccattcccatctcgggcttcaggtcccggttgcatgtcaaactcatgcgcaattgcgagggccctcgtagggactcccctcagagctctgggatagggcagttgaatggatggagctggtgtctccagtttgcgtaaaattgcccgttgatgcccatctgcggaatatgcaccttgggcctgcgtggttctcaacacctctagagcaatggcgacgggaggagccaaatacatccccgccaacgtggtgtcctgggcggacatcgaacctatttggaaccaagagggaatgacaaaatagggacatggggaaacgacatccattccaataaccaacgaattgccctacacagcgagtcccacccaccataaaccgagaggaacacaggcgactaggcgccatgcgccaaggcgcggccgcgcttgccccagagagcccctgagcaacacgggcaacaggggcgtaccaacggtcaaaggacaaccggcccggggcacgtggccacacacagcacccgtgacacggaggaagccgagaaaaccaaacaggcagactggggtggcgggcccagaaccggacagacaccgcgcaagagaccagccacttaccgcaacaggcacggtcaccggagcagacaaatcaacaacagacagactggcaacatacgagaagagaacacaggctcaagacccacacccgcgcacacacgactaaacgacaccacccaagccagcagcaaacaacacacacgaacgcaacagacagagcacgatgtn

SEQ ID NO: 627860 - DNA, 451 bp, Homo sapiens
ctctagagtatcccccagtccacactgcaacatttcagagagcccacataatgtgacaacattatcagtacatatctttaaataataattagtgatgagaaaaaatatttaggactcactggtctattctactgaaatagcccttcaaagtttcttagtatacttgggatgccgataaacacattctgccaagcatatgatgcagaagctgagtgatatagagacgccctataacattacagaggttttgcaaagctatgatcattaataatatgaatattagcaggtaagttattgctgaattgctggtccctacttgagctgtaaagtgagtcctttgtgtaccacctcccaatgagtgacactgtttgtataggccctgattatccattcttgtttaccagacgcccatctttcaggacctcaagaataggtgggaaaagtacagtcg

SEQ ID NO: 627861 - DNA, 109 bp, Homo sapiens
gtaatcgtgtggtagtttctagcaggatccccccaccagaagggcgaaggtataaaagactagaagaaagtatgtcactataattttacaactcaatggctgctgcgat

SEQ ID NO: 627862 - DNA, 150 bp, Homo sapiens
cccctccccccccttgggggtttttggttccctggttttttggttgggccccccccccaaaacccggtttggtggtattattttatactggtggtttggttggggttttttttggttacccaataaaacataataggatttcctaatgga

SEQ ID NO: 627863 - DNA, 1230 bp, Homo sapiens
agcggggcacggctggtctcaaactcctgaccttaacgtgatccacccacctcggcctcccaaagtgctgcgcgattacagcgtgtgagccacatgcacctggccatggttacgctctgtctctatctccattatctcgaacagccagcgcgctgttgaactttcctccaaccttcctataccatattaacctgctctatcccctcacctctcaactctcctcgtcacctcacactgctctcacttactcaatttcttcgaacgactctagttcatatcgacacacggcacctactcgttacacctacacccctgctcacctactactcctctgcatacaatcgtgaaccccgtctctccactcactctactcatacacattgcccccctccctttgcccctcctgtgctacagcacacatcctacccgttcctataccaccgctccctactcttgcgtcctcgacccattctaacctttaaagcccaacttctccaagcactccactcctctcacgggctttacccttacttctccttccacctgcgacacctacatcttaccccccctgtcgctcccttccctcgaaatctcttccacaccgcctactgcctgctgaccctcttgcccccgcccaccaaacattgacgactactcctctgataaccgcccttgcgcgccttaactacaatcccggcgccaaccaacctgatttccacccccactactctctatggcgacacccacctttcctcggctctaatctacaaccacctcggacaccccaccgttctctcaccctgcctaacctatcctttaccttaccaaaccccgcctcgacttttaacccctcgccattcccatctctacctattcctagccacctttatcaacatcatctctctgcgctccaccttctctaaccacttggctgctcttccaaccccaccttaattctgctccatagcgacggcacccaccgtctcccaaggcgtcatccgccctggctcatacctgttcccccattctccctcttcttcgggcacctctacaaagcgcatcgtcaataagctcatcccaaacattcgtcacgattgcatcaatcacaccagcgatggctgagggcccgtgggtaccaacgcctggtatcccaccacagcacagcaggagaccaaattcgagtcaccagcagcggcgtacgcccagcacgtccaggacacttcagaatgt

SEQ ID NO: 627864 - DNA, 359 bp, Homo sapiens
gagccctgcacttctaaggctgacgacaatagaagccactgctgataaatgctctgattatttcttcttatttccctttaatgaaaactctgaacagaaacacttggcttacttttgacttcataaagggaacccaggcataatgggaaaagcatacactttcaaatagaagaggttttcaatgcgccgttctcataagactgctgtttgctcatctaaaagctaacagcagtgtctttactgctcttgcggactcttatcttcggtgtacttctgtttttcttattctgagtctttataggaaaggaagaggcgcagctcatgcggttaagcacacaggtgctactaaatggcgcaat

SEQ ID NO: 627865 - DNA, 362 bp, Homo sapiens
caaaaactgtcagggagtttggttgcacacttcactgattggcaggtgggcatccttttcaggtggcccattcgtcacaggtgaagagaggattgccagcaccctgcctgtacatgttcagggttgcctctgtgctgtctttcttggccgccaccccccccaacacaaccagagaacccacaagtgtagctgtcttcatgtttaattttatatgcagagttgtcttaaagttgtagctgctagttgggcacagtggctctctcctgtaatttcagcagtttgggaggcagaggagagaggatcacttgaggccaggagttcaagactagcctgggcaataaagtcacactcttgtctctaca

SEQ ID NO: 627866 - DNA, 992 bp, Homo sapiens
gcacaatctcgagagacccaggccgcaagggagatgacgagggtgcgctgggctcctttacgggaactgtgccagataatcatgcttggagcgctgttgaacatggtgatacaagatgggttagccgcaacagtgatgcgattggaggcagaggcaggagagacagcgtcttcgagaacctaatcactgtcatgcaagcatcggagaattgggcgtgttcggaccatggcgtgaactgggcgaggattgcgcgcaatagaaagcatgaatgtcacgaagttggtcggggtacctctcggaagaatccactgggccagttgccaatgaggctctaccgatgtttgcacatgggattgtcaaactaggatcgtgtacccctttgccatctgatgggcacgagcactggtgactgattaactagacacagctctgtggacggttatatggggcccctgacaggccaaaagatgaccttccatctctgtcaacaggaaggcacttaaaacccattgtgggacgatgatgctgagtaccaccagtggtggcaagtggattatcggggtgccgaaagggcttggccacccgatgctgggagaatctcattggtggcattgcctggggcgaacagtcactggggggggacggagatctgtgggagctgtgctcggttctgccggtcgcaggaagacctggatcttcaaaccggaagtacgacgcagtgaccatgcaatcacagccgcacgccgggccacttcggggagtggtaactaactccaaaccataatgaataaaaattcaacgacagatccaaaggcgggaaggtgggcccaaggtctttcaaacatgcaacgcgtggtggcggactctcctcttgaggcacaatgaatggggcaccggttggacggggcgacaggacactctgcggacagaagaaagccatggtaagcgccaccaacacacgcatcaacgtgccaaaaaaaagcggggagaac

SEQ ID NO: 627867 - DNA, 221 bp, Homo sapiens
aaaaggtatgggggctcgtcccagtcggggaggaacagtggtgagaaaaggtatgggggctcgtcccaggtcagggaacagtggtgagaaaaggtatgggggctcgtcccaggttggggaggaacagtggtgagaaaaggtatgggggctcgtcccaggtcggggaggaacagtggtaagaaaaggtatgggggctcgtcccaggtcggggaacagtggta

SEQ ID NO: 627868 - DNA, 456 bp, Homo sapiens
  misc_feature (395)..(395): n is a, c, g, or t
  misc_feature (401)..(401): n is a, c, g, or t
gtaaaacaagaggccttccatccacatgaaaagactgtattttgattgcctgggagattcaaaatgatttctaatcttgccacaactgtcttctgctgtataaatgaaatgtttcattttcaaagagactgtcaggatattctgaaaagagttccttagctgctctgcaataccttcccccccaaataaagtgctttgttttgtattttccaagagaacaatggcattacttctcatattggaagatacgattttcagcaagtcctaaaatgcttatttgctaggcagtttgtttcatcaggttcctcatagggaatatcttatttaattcacttacaaccaaaaattcccagttttgtgaggtgggtcaaacagggatagtaggccttctggcnttgggnaaaagggattggaacccataatatggcttatggcacactggttatccttttttgg

SEQ ID NO: 627869 - DNA, 105 bp, Homo sapiens
tctagaggatcaccgcccatgatggacggggcatgggatacgtgcagcccaccaacgcctaccctgggccatggaacctccggtcagcggcccgtgtccacctct

SEQ ID NO: 627870 - DNA, 695 bp, Homo sapiens
ccgaaccgggggcctgttcccgaattggccagaatgccgcttggattgttccccccgcctaagggcaggggtaaatccaggccccccaaacttgtggtccaaaaggccggggttgggccttcttttgaaaaaaacccctccaaaatgtgggaggggcaagggttcctccttcctctcccctccaaaatcggggtgttcttcccaaatttaccccccaaaacgcggagggtaggagcctggcaggaaacccccaacggtttcccacggggcaacattggggttggcaaaacaaaaccttttttttgggaggggaaattcccagggggaaccccaccaaaacccggggggggcggggccttggaggaaaccccccacggtttcccaaggggaaacattggggttggcaaaaaaaaaccttttctttgggagggggaattcccaggaggaaacggccccacttttttcttcccctccaaatttttaaaatggaacccaccgtccccccttaggggttttggccgttccccccacccaccaaaaaaaaattttcgggggcttttttttggccaaaatggggtccggggtttttttgggcccccttcccccccccaattttggggaagccccttcctttttgggcaaaccctttttggccctccccttggggaaaaaaaaaaaatccccggttttgggga

SEQ ID NO: 627871 - DNA, 453 bp, Homo sapiens
aggtgatctagagtatccccccggaagattggacctctaaaaaatactgtacagacagtgacgatagagcagatcttggccaagtcatttatcttccctgaggcctcattctattccatctgtaatatttcaataacagttgctctgtctagctgttttgagatcatgtgagatgatgtaaaaatacttggcaaactgaagcaatgctcacattaatggtattatcataggccataatatctcaagtttctgacagtgtatctgacaaataaagttatggcctgctccttttgcattcagttgagaactcccagtgttgattagattgttatggagagaatggagccgaaatttatgccaagagaaaacctctaagttttagcatccagaattgtatcaagtacagtttgtcgcgaatgggaaacactggtttgaaggggtatacagaatacc

SEQ ID NO: 627872 - DNA, 867 bp, Homo sapiens
tgctgtatccttttgccacgcgtttggatgcttctatgggcagttttccacaatgagtggtcttacccacaggcgatctagcacacagggttgtgtccgcccacttggcggccgccccaccagtgttggcgtaaacagcgtgctacaaaaggtccgccgaggcttgccccattattcatcgcggatcatttgggcctccactgtgaaccgtgcttgtgccgctggtgacagaagacgccccctccgataatgtttcacgcacggtcccaaggggggggaccccccaaaccgggcgtgaataacgccgaccctgggggaaattctctccccactgggacccacccctgaaaaacactacgacccgaggggcgacccctcatttaataaccagccggcaacacgctccgaaataccagacagggagggccccctcgcccgccggggaggaagctctgagtggccactccccctcacgtcgggaccccgtcgggggcgtcacccacgcggagaacatccccctggctctcaccctgggagggatcccatccgagctccgcgatgcaccgggccagtcatggcgaggagacccccgtcgggggcccacccgaaggagagaccggccacacgctagtgcctagaaggccttacacaccttctcagtacgcgcatgggggacccaacaacggcgccaggcatagtaccccggcgctgctaatcctcgagaccattccgaccatcgcggcatgtagagggtcgaggagggcacatggcacactccctatgaggccacggcccacaagggaggagggaagctgagtccccccgccctaataaaaataaaaatttttcaaaaaaatccacatgaca

SEQ ID NO: 627873 - DNA, 334 bp, Homo sapiens
  misc_feature (293)..(293): n is a, c, g, or t
tagaatcgagctcgtgacctgcagctctctctgatgcccaggtgtagcacagtagctgatctcggttaccgcaacctccgcctcccaggttcaagcgattctcctgcctcagcctctcaagtagctgggattacaggcacgtgccacatgcccagctaattttttgtatttttagtagagatggagtttcaccatgttggccaggctggtctcaaaacttctgacctcaagtgatccacccacctcagcctcccagagtgctgggattacaggcatgagccagcgtgcctgancccaaggttatttttaatatttagaaaaaatagtaactacc

SEQ ID NO: 627874 - DNA, 293 bp, Homo sapiens
ctacagactcgccggactgcagtacgtgggctggtacggcgtttgtgtgcgggcggttctcaggccgatgcagcagcgctctgcctcgaggttgcgcagagggacgctgtgagggtggcgctggttgtacccaggctacactggtgcgactgtggatgaggagctgccctcgcggttcagtcagagggggcgctgtgagaatgggcgctggtgtgtaaccccggctacactggcgaggactgtggggtgaggagctgccctcggggttgcagccagcggggacgctgcaagga

SEQ ID NO: 627875 - DNA, 129 bp, Homo sapiens
gtggctcgattggtagtagccaaaaattagaaacaactgagaaagcccatcacgagcaatatgggacattcttatgtacgacgatatatctgtaaaagcaacaaatgaaatccacatgtattaacagaa

SEQ ID NO: 627876 - DNA, 120 bp, Homo sapiens
gctgcccctactactactaaattcgcggccgcgtcgacgtgtacaaagggcagggacttagatctaagggcaatagccctgtatggacccgcacttactgggaattcctcgttcatgggg

SEQ ID NO: 627877 - DNA, 129 bp, Homo sapiens
gttgagctggtaaactggtacactttcttttttcccttccaatgggttgtcaacagtttgttcctaaacatttcaggagttctcaaaacttttcacatacaaaggggaagcattattcaccaagcttat

SEQ ID NO: 627878 - DNA, 242 bp, Homo sapiens
ctgaccctctctgggtgctgatgtctttgtggttgttgagtatagtcaacgatttacgaacataggtaaaatggctgagtaagcattagactgtaaatctaaagacagaggttaagccctctttttgccagttccgtggtgaatgtcatgttgagtagcaaattcagagaatcagcttcgattctgcctatatttctcgcggctttgtttgcctgtggggggccatgtaaatggaagccagt

SEQ ID NO: 627879 - DNA, 424 bp, Homo sapiens
  misc_feature (81)..(81): n is a, c, g, or t
  misc_feature (173)..(173): n is a, c, g, or t
  misc_feature (207)..(207): n is a, c, g, or t
  misc_feature (242)..(242): n is a, c, g, or t
  misc_feature (266)..(266): n is a, c, g, or t
tcacaagagctcagttgttacacctgaggaaagacagaggtactggaacacagaacagtctttgtaagctgggtcctgctncgtgtgcatgtagtgtgtgtcgcatggtgctcagtgtgcgaaaaggtcagatcctctgacagtctcaatcagtaggactaccactgtgagcnactcctctgcttctgtacctggtgccactttcantttgcatatgttgaacataccgtatttgccaatgnctgacccctctagactgtattgtntactgagagagaatcgcatcttaattaattgtacccctctgcattgtcctgtcacaaaggaagtacccatcaaggatttgttggaccaaagtcccttagctgcacactgtacatatgttgttaatgtatcttacaaccagaataccattttttagcaa

SEQ ID NO: 627880 - DNA, 607 bp, Homo sapiens
ccggttactagacacgactctaaagatcactgggacttgtgtcatgatgagctggaagatttttatagacttgggtctatagcaaccttgcgttgtcgtgtgaactggtctgttgactacagacagcagctgtcccctgtggtggtgtggcagtgcctgtgttctctcctaggcaggcctctcaactccaggtgctgtcctaagaatttttacccagggcctgtcttcccaacccctcacctttccctgaggagtgtgttgtagtccctgttgaaaaaagttacaaaaataactcttaaagttagttctttgtaacacgaacttaactgtcagacagttagtgtaggtgtgtagcgtcatctgttttcaaccagattgcatttatggacttttcacacactcattttgaggaccccaggttcaaaagtaaaggcagtggccctgcttttggggtccaagaataggagtgatgggtgaagggacctaagctggccaatagccctctgccccagacatgggatgtggatccttgaggtttctggtgaaatctgcacatctgtgtttttatatctgttccctacctgtaatcctcacacgtgcacatttc

SEQ ID NO: 627881 - DNA, 376 bp, Homo sapiens
caacgatggtcctacagctactgtaagctgaggtgaaagggtgctgagcccaggaggtcaaggctgcagtgagttatgattgtaccactacatcctgcctaggcgagaccctgtctttgaaaaaaaaaaaagggaaatgaaagaaaggcaaaacaccatttctccttctggtctttacgggatcccagtgacattttactggcaacaaaaccaaactggtatgaagttaagcccggtctccaggaggcatgaaaccacctccacttctcgtgatgcgggcttcttctcaaaacaatctcaaagacagctcccgggatatttggaaaattcagcttctgtttttctgagaaaaatagaagcggaggaccatcgttgg

SEQ ID NO: 627882 - DNA, 238 bp, Homo sapiens
cccaggaagaccgggttcagcgggtcaatgccattgcgatcgagcaactccgacggctgagcgggcagcagacgcggagtcttcccggggcggcgggtccccatggggagacggaagcaccgacagaagagacagaaccggattgatgggatggcgcggggacgggacggggcagccaccgccgcacgtacccgcacccgcctgacgcactgcttgggagagtccccagaagacccgt

SEQ ID NO: 627883 - DNA, 372 bp, Homo sapiens
  misc_feature (155)..(155): n is a, c, g, or t
  misc_feature (161)..(161): n is a, c, g, or t
gtagttcttaatatattcatagttttataaccattcccccactccagcaggcagcagagcaaggctgtcttaaaaaaaaaattcatattttctatggctgaggcaggaggatcacttgagcccaggagttttagactatccttagaaacaaaaangaaacnccattttttacccctccctccccgacacacacacatacacacacacacacacccaaaattaatagggcatggaagtacatgcttgtggccccagctactcgggaggctgaggcgggggaggatcgcttgagcctgggaagttgaagctgcagtgagccgtgattgtgccccccccctccagcctgggtgacagagcaagactccctctcca

SEQ ID NO: 627884 - DNA, 451 bp, Homo sapiens
tatgtgggccaggctggatctcgaactctggccctggtgatccacccacctcggcctctcaaagtactggggcttacaggtgctagccaccacacccggcctcttctcgatagatcttattgggctgacaacgaaagctgaggtgcgggtagcatcatcccttggcatgcaaaagataaactgaaatctaaagtagccatatccttcgggccaggtttttcaagggggttactcggttctgatcatggtcaggacgggaatagtgaaaataacaataaatcatttttcttaaacgatccatttacggtatgcggggcacggcacaaaagggtttacatggtttatctggtagcgtcccatttaggtcggctaagagtagatgctatcattctctccattttacagataagaaaatggaggcttagagaaatggagtaattttggccaatcc

SEQ ID NO: 627885 - DNA, 330 bp, Homo sapiens
  misc_feature (260)..(260): n is a, c, g, or t
  misc_feature (304)..(304): n is a, c, g, or t
attttatcagtaataggtgtcagtttttaaaaaattgcttgtaggctgagcgtggtggctcacgcctgtaatcccagcactttgggaggccaaggtgggtggaccacatgaggtcaggagtttgagatcatcctggccaacatggtgaaaccctgtctctactaaaaatacaaaaatgagctgggcatggtggggcgtccctgtagtcccatgtacttgggaggctgaggcaggaaaattcttgaccccaggagacggangttgcagtgagctgagatcacaccactgcactccagcctgggtnacagagcaagactccggctcttaaaa

SEQ ID NO: 627886 - DNA, 607 bp, Homo sapiens
cacgaggtgtaaatctagatatgtatttttttctatttaatcctaacaataactccatgggatatttttcttatccctattttatctgtgaagaaactaatgtttatagagctgaagtaatcttagtaaaaatcatgaacctggaattagcagaaccagcggtcaaaccaaggattatttagctccagaccattgctttactataaactatactgggttaatttacatttttcttcataaagctatgctagttatgatttactgtcttgctgtcaaaagattttcagtttttcatatttagaatttgttccagtgtactctacaatggtagatctcagagtttttgaaatgcagatttgtgggcccaaaccctggaccgtatactgattcagaagtggtggagatagggccctacagcaagctctccaggcaattctgatgcatggggaagtttgaggaccactgcttttgaatagcagagttaagctgaattggttcattctcttactttgggagatgatggtcctttctttcaggacatctcttcaatcttttacagaccaataaaagtgatattttgtagatttgtgattacagtgtcacaaat

SEQ ID NO: 627887 - DNA, 558 bp, Homo sapiens
  misc_feature (120)..(120): n is a, c, g, or t
  misc_feature (160)..(160): n is a, c, g, or t
  misc_feature (212)..(212): n is a, c, g, or t
  misc_feature (233)..(233): n is a, c, g, or t
  misc_feature (274)..(274): n is a, c, g, or t
tatgatgcatttgacagcttcctccataaatacgctaactagttggattattatatgtaaccagtgtggccatgatggtttcttacaaaagggagcttcatcctggtgatcatgtgaagnacaagcagacagcactaatatatctaatcgctatcaattnggtctggaattcattgttacacatcagttaactataaacttcgaatacattngaataattcaagataatattngaagtaaataatgttaaagtgtttttactattgtttattgnatcccatatattcagtgttagtctgttgttactgttcatgaacagctatcatttttaatcatgaataatttattaaattaaataaatttattcatagaaacttttctgggttttagtaaaattgctaaaccctccccaccctttaataaatgaacggggcaagtgggccggtataacgagtatccctggtaacatgatttgagaaacatgtttattttttgaatgttcttgtgttcaactaattttctgctgtggaaataaatacaaaaaatatataaaaaaaa

SEQ ID NO: 627888 - DNA, 1540 bp, Homo sapiens
  misc_feature (813)..(813): n is a, c, g, or t
  misc_feature (869)..(869): n is a, c, g, or t
gctgggtggattattaagtaggagtgaggcggatagtaatatcgcgggggtgtgcactacagctgaaggaagatgatagtatatttaagagggtccgctgagagactctgcttgctggggacaccgctgctgggggtggtctagacgccctcgtgaagctgttgcgtgttgaaaaatggagctgtttcgcacgcgaagtgcatgtgcgtcgtgtgggcagcgccgaaactcatagtgatggggcagagcgggttacaacatcctcttggacgccattgggtgctagtccgcccgtggtgtaattgcccgctactagtgggggggaacaacccttaagggtgggtcaccaactcggggggggaggagataccgcctcttctccacgggagaatttgttgtcgggggaacagtgctctacagggggtgcccacgaagatcaccttggggggcggaagagacacagcaggcttggggagttaatggggtctcggcccctggagaggagtggtctttgcacaggaagagaaaccattcggcgttgtgtttggtgttgatgattgcgacgaagaggccgtgtgtgttcctaatccgcaaggaaggggttggccagactgtagacgacttcgttggtgtgtgagaagggcgcgaacaacacggtgtaggtttaaaatggaggctaattcgcaagaccctttgtcttgtggagagaaagcccgccggtgtatcctattaggggtgttgctgccacagaaaccccacgcgtagttggtggacacaccccgctgggggaaggggtgccgcagaagagtgtcnttttgtcaacggagtgttctccgccacaccctcctctcccgcggggagatggtggnccccctcctcgggagaaaagagagcgggtttccttcgctggggtgttccacccacacagatatacgctcggaaaacaggggagagcgagccgaccctcttggggggagactcccgccactctgtttcaaacaaatattctcactgggtgaggcgagaatttttttagaagagcgcccccacacatgatgctctagaataatatggtttccttgtgggtaagagtggcgttataagaggaaaagcctgttttgtgtacaaaggacgcccagtatacccgcccgacatgctgttttggtgcggagatttgttagatcgaaacatgctttggttacagtctcaggagcgccacatttgtctcgcaaagccagggtcgcacacacaccccccaataaatggatggaagaataatagtttttataaatctaattgccagatagggacatctatttcccagaccaagccatagtcccaggacattcatgggaccccatccaatgggattgttttttgaagaactggccaatataagactgtcccaagtctcaatatcccgaataactgggtttaagggatatagacccactgataattttttcatgtttagaaatatttttttggtattattcaagaaaaagtttttaatcaaggttataaacttttttggggatga

SEQ ID NO: 627889 - DNA, 168 bp, Homo sapiens
gtgacttagaggatctctcgaggatttgcgacacctcaagctcggaggtacgccgcagatacgccggagggcaagatcatcctcgacgtggacatcaacaaggacagccgggttgagaccacgcttgcgggatcggtgatcaacaccaagcacgtaaaggacccaggt

SEQ ID NO: 627890 - DNA, 818 bp, Homo sapiens
  misc_feature (53)..(53): n is a, c, g, or t
  misc_feature (64)..(64): n is a, c, g, or t
  misc_feature (103)..(103): n is a, c, g, or t
  misc_feature (105)..(106): n is a, c, g, or t
  misc_feature (110)..(110): n is a, c, g, or t
  misc_feature (146)..(146): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (170)..(170): n is a, c, g, or t
  misc_feature (226)..(226): n is a, c, g, or t
  misc_feature (238)..(238): n is a, c, g, or t
  misc_feature (276)..(276): n is a, c, g, or t
  misc_feature (279)..(279): n is a, c, g, or t
  misc_feature (302)..(302): n is a, c, g, or t
  misc_feature (308)..(309): n is a, c, g, or t
  misc_feature (319)..(319): n is a, c, g, or t
  misc_feature (333)..(333): n is a, c, g, or t
  misc_feature (338)..(338): n is a, c, g, or t
  misc_feature (342)..(342): n is a, c, g, or t
  misc_feature (344)..(345): n is a, c, g, or t
  misc_feature (347)..(348): n is a, c, g, or t
  misc_feature (358)..(358): n is a, c, g, or t
  misc_feature (364)..(364): n is a, c, g, or t
  misc_feature (403)..(403): n is a, c, g, or t
  misc_feature (414)..(414): n is a, c, g, or t
  misc_feature (423)..(424): n is a, c, g, or t
  misc_feature (430)..(430): n is a, c, g, or t
  misc_feature (500)..(501): n is a, c, g, or t
  misc_feature (503)..(504): n is a, c, g, or t
  misc_feature (506)..(512): n is a, c, g, or t
  misc_feature (580)..(580): n is a, c, g, or t
  misc_feature (591)..(591): n is a, c, g, or t
  misc_feature (798)..(798): n is a, c, g, or t
attcaactgttctcaagtcagtgtacaggtaaacctggctgcctccacccacncccagggagancaaaagccttcatacatctcaagttgggggacaaaaaangnngaanggggggcacgaaggctcatcattcaacacataaaanaaaataaaaaaatatnaangcnancattaagaaaaatgtttgcattcactactaatttacacgaaagacgagatgctatnacctcccctgtntcggacttgggaagtaggactgggaccattctccttancanacggacgtggggtgtgtttttangttggnnagggacttcntgtaacaacgcatntcatntttngnntnnttattaaaanaacaanaatgtgcgaatcgaaaggtctctcgggcacatctggtgnactttgggggntgctcgctnnaaccgnctgctgttaccttcaccgttccagtttttaaatcctgagttaagccataaaaaaaaaaaaaacaaaaacnncnntnnnnnnncaaataaagccatgccaatctcatcttgttttctgcgcaagttaggttttgtcaagaaagggtgtaangcaactaagtnatagtccgcctagaagcatttgcggtggacgatggaggggccggactcgtcatactcctgcttgctgatccacatctgctggaaggtggacagcgaggccaggatggagccgccgatccacacggagtacttgcgctcaggaggagcaatgatcttgatcttcattgtgctgggtgccagggcagtgatctccttctgcatcctgtnggcaatgcaagggtaaatgg

SEQ ID NO: 627891 - DNA, 480 bp, Homo sapiens
ctaaggatctttcggattgtgcatctatggtgcgggtgtcgtatgattatgggcgtgattagtagtagttactggttgaacatgtttgtggtgtatatattgtaattgagatgctcgggggatcagtccatgtgaaagcaaaaagaggtcgggatgaggggtgcaaaggaatagtgaagaaagcatctttgaggttgaggacagaataatgagttgttgagggaggtattgaggataggagagtatatgggttgggcaccacggatggataggttagacaactttggttaatacaagcaaagatcctgaaccaacctgtacagatttgtctggtttctggacaggtaggataggggagttgtaagaatttgtaggctttagaacggccatgctgtaacaggagagtgatagcaggctttagtccttttaaagcctgttgtgggatggagtactggtgttgcgtggggtaagggtgattag

SEQ ID NO: 627892 - DNA, 309 bp, Homo sapiens
  misc_feature (78)..(78): n is a, c, g, or t
  misc_feature (82)..(82): n is a, c, g, or t
  misc_feature (85)..(85): n is a, c, g, or t
  misc_feature (95)..(95): n is a, c, g, or t
  misc_feature (100)..(100): n is a, c, g, or t
  misc_feature (120)..(120): n is a, c, g, or t
  misc_feature (123)..(123): n is a, c, g, or t
  misc_feature (127)..(127): n is a, c, g, or t
  misc_feature (131)..(131): n is a, c, g, or t
  misc_feature (155)..(155): n is a, c, g, or t
  misc_feature (163)..(164): n is a, c, g, or t
  misc_feature (171)..(171): n is a, c, g, or t
  misc_feature (196)..(196): n is a, c, g, or t
  misc_feature (201)..(201): n is a, c, g, or t
  misc_feature (232)..(232): n is a, c, g, or t
  misc_feature (302)..(302): n is a, c, g, or t
attttggaaaaaaaaatgaaagttttgtttgtttatcccttgcgatttggggagccccctctcgatatttcccatccngggnacnttttttaaanaaaanaagtcctttttttttggccntgntaanggcnacaaaaaaaaggggttctttgggnggtccccnnctggtgngggtgggtccccagggggccccctncggcntgggcccccctgcccccggccagcttcctgntgatgaacatgctgtttgtattgttttaggaaacccggctgttttgtgaataaaacgaaagcatgtttgngtcccga

SEQ ID NO: 627893 - DNA, 396 bp, Homo sapiens
aattatccaacagtgcttcactaaggttgtgtttgagaccagcgtgcacactaccatccccctctccctataattactcacaaacacattctacatggctgctcttttctgacttgatgtgattgttaaagccacccttcttacaggactccatagaatgctcactgttttcggtggtgggaggagtccaggccaaaatcatcaaaacttaattgaaacttcaccttaacctctccagttttggttgattttttttttctctctataattgtgttaggaatacatttgtcatacgttcagctagggctccctattcatgcctttcccgaaaaggtcatttgtaaaatactaggccaggggtggatggtgactgagggcaccaaagacaggcaggca

SEQ ID NO: 627894 - DNA, 761 bp, Homo sapiens
ggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctaatctgatggggttagagtgcctttgagaagaaatcagtggatactggattggctcctgtcaatgaagtttaaaggctgtaccaatcctctaatatgaacatgtggacaagaatgaagagcagcagtaaaagaaatatctagtgaaaaaacaggaagcgtattgaagcttggactagaatttcttctgggtattaaagagacaagtttatcacagaatttttttcctggtggctatggtataccaatgatgttgagtggcatatt

SEQ ID NO: 627895 - DNA, 571 bp, Homo sapiens
ggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatctgatggggttagagtgcctttgagaagaaatcagtggatactggattggctcctgtcaatgaagtttaaaggctgtaccaatcctctaatatgaacatgtggacaagaatgaagagcagcagtaaaagaaatatctagtgaaaaaacaggaagcgtattgaagcttggactagaatttcttctgggtattaaagagacaagtttatcacagaatttttttcctggtggctatggtataccaatgatgttgagtggcatatt

SEQ ID NO: 627896 - DNA, 793 bp, Homo sapiens
ggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattggtggaactctcaaggggtgtggggtctcatagtgcatgtgtagtgacactgtgggatatagagagggacaggatagtcttttcgtgggcattacgaagaggtaaagcggggacaaaataatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctaatctgatggggttagagtgcctttgagaagaaatcagtggatactggattggctcctgtcaatgaagtttaaaggctgtaccaatcctctaatatgaacatgtggacaagaatgaagagcagcagtaaaagaaatatctagtgaaaaaacaggaagcgtattgaagcttggactagaatttcttctgggtattaaagagacaagtttatcacagaatttttttcctggtggctatggtataccaatgatgttgagtggcatatt

SEQ ID NO: 627897 - DNA, 240 bp, Homo sapiens
ggtacgacggatcataggcaatgtaaaagcaggcagtatgcagtccctggatgcaaggctgcactttggcaatctagccggactgggtgcttaccagatgtctcaggatccaaagaacgtttgggatttcctagctacatctggtaacttggctggcattaagggagagaggttctaccactctggaaaattcatgcctgcagagataattgcaggtgccagtatgctgatggtcaccaa

SEQ ID NO: 627898 - DNA, 228 bp, Homo sapiens
tctataaggccagatgaggtagtggtagtagtcacgttcaagtcgccagatgtggtcgagagatcctgccggatgatgaatggcatgaagctgagtggtctgagagattgacgttcgaattgatagaaacgcttaagcagttgccgttcttaaacattgatacgagacctctgaatttatattttttatgcgataaccatttccctcaattttggtggccttatcgag

SEQ ID NO: 627899 - DNA, 216 bp, Homo sapiens
tcaggattacctcctatagcgcactcggttgtgtcgggggatcagctgggagctatggaggcagcgtgagctgtggttttggtggaggggctaggtagtaggcttatggaggtggctatggacggtggccttggacggtggctatggacggtggccttgtgcggtggcttatggtagggggttttagctaggtggcttatgttagaccttttggcg

SEQ ID NO: 627900 - DNA, 698 bp, Homo sapiens
  misc_feature (247)..(247): n is a, c, g, or t
  misc_feature (258)..(258): n is a, c, g, or t
  misc_feature (266)..(266): n is a, c, g, or t
  misc_feature (293)..(293): n is a, c, g, or t
  misc_feature (331)..(331): n is a, c, g, or t
  misc_feature (391)..(391): n is a, c, g, or t
  misc_feature (401)..(403): n is a, c, g, or t
atatatccaatctaccacagaaccaagatccagatctccaactagttctcataccctctgttcctctcctgtcaccctttgtggggccaccgtatctttcctagatgattacagggacctcctaactggtcgccctgattctccctggtatataggaaacacagcagacacagtcatcatcctgtgacacctgtgtccagtagcctgtgatggctgcccgcttcactaggagggaaagccaagtccncacaacagccngtctaacntggagccttctccacccttcttttctncactctctctgtccactcaccatactggccttgtaganaaccactttaggcctcaatactggctgttctctgtgcctggaatgctcttcccacttacntccccatggnnnagttctctacctctttcaagtgtttggttcgatgtcatctttcgagtaagttttaacatggtgacccgcctacctctagcacttttagtatcttttcctgttttaattattcatcgtttcttacttcctaatacgctgtgttgtttacttccttaaaatttttactgctccttgcctgtttcccccaagaagaatttaagctccctaaaggcagagtatctttgtctgtcttactcactgacaatgcctggcacaaaatttgcactccacaaatgtcagttaaatgaattaatga

SEQ ID NO: 627901 - DNA, 691 bp, Homo sapiens
caaaatactgctcccagttaaaggattcccagtgggattctgtactccacatcgcaacgtgatggagagaaaactcctggcagggccctatggtgggaaaggctggagtcttctagtcccaagggatgggagatgacaaaatgaatttttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcatgcgcaccatgcccggctaattttcgtatgtagtagagatgaggtttcaccatgttggccacggctggtctccaactcctgacctcaggtgatccacctgcctcgacctcacaaagtgcctgggattacaggcatgaaccactgtgcccagctgcacaaaaatgaagtttcctcacaagcttgcacgtgacccaagcgaatgacccactactgggaatcccaaaccataaatcggggccgtcatccatacggggataactcgcattggcgtggcctcactaccatcacgaactcacgaccggtactcggtaacaacaccgcccgaaccagcggaggacaacaccagaaacgcccgaccgcaaaacaaacgagccggcgcaacacgacccaggggcccacg

SEQ ID NO: 627902 - DNA, 170 bp, Homo sapiens
acagaacgagcttcccccatcactctcatgccgacacacacatgtttattaattggaactctgatgagaagtgactgataaggatccagcctcttcagcctctgacattggattcgttgtcctcatacggagatgatgcccttacgcaccttactgtgagggtagagggg

SEQ ID NO: 627903 - DNA, 1860 bp, Homo sapiens
acgcgtcgcctggacaggagcgatcctccccagagatttccttaaggaactctgagccagggttgagtgggtgagcacaatcatggctttgcattttccagagactttcaccaggcgtctcacagcagccaggaagtggaggcagatgaaatgagagtttgaaacccctggaggccttcacttctgcctcttcaattaatggaataccatactttcagaggactggagtcttgggccattggctaaggttaacagaacctgcagtgggaagcctgcctcctcatgcagagatgacgttatcaataatggtagggtgggtaacagcgtggggattggagccctaacaaggtcccagaataatcatcaaaccagaggagacatgtgctgagtagggagagctgaagaggtgcttgctgccagctaagcagcctggcctgcagccagagcccggctccccgactggaggaagaaaaaatgggtcctgtgggctgtgcccgagcacccaactacaaaggcagcacctgatgttaaggcatcaagagatagggaatgagctttggatttgccagaagtcctctaagtaaaagaactgagtaggggacccaaaattctgataataagtttggggtgagaggaggaagccctccaaggcacagagtggaattatagtagataattgccaaatgccatgtaagagactctaaatccatttaacggtgagggctttccttttatgacagaggggtacaagttggggtcaagagggaggagggactgctcactggccccagctgtccctgctctgtccttatcccatgtgtcatcattctctcatgggttagactgtctcccaattacttgcccatccagagtttccacatgtctctcttcagccccaaagatgggacagtcagaatcttataacactgttagttaaagctttgtgcccctaagtgtcagtgccctgaaagaaatccctggacactcctttgctgcctctgttgggactcggtctgcctgggcagcacatccaccctgcaaagacacccgtggggaccagtgacagctgaaggactgccagcagcccgcgtggggtccacgcttgacacatccctaaagcaccatgttaacttccattgtgtgacaattctttgttaaatgtgtagacgattggatagatggatgaataaataatctgatatgtgaatgactcggtgaataaatgagtgaataaatttgcatgatagttatctggggtaggaaatgaaactgtgacctgtggaacatttatttctctatacaaaaccagaagagacgcaaatgagactggaaccctcagcctgagtcatatgctaactagcagagctactctgtccagcaaagacacctctcatggcagtgattaagcccgacttgctggggccattgccatggtaattatggcagcaccaccacggtacctcctgacagcaagcctcttaggaggcaggtagccagagatttttcactgacctgttctctgttttcttttcagattatcaaggaggtccctccaccccctgccgaggagagtgaggtaagtgaccacagcaggatggcagtgggtgggcagggtggcagagtagggtggagagctggctgggcagctggacacttagccccctgcagagcagagctaagtcaagctcaaaggatttaatgtacctgcctgtgaagcagaagggaggaaactgtctggcctttcctaaccagggatgaacaagaaactgaactaaactgccagaaaagacaatgagttttggaggtttttctccctgcagagataaaatgtgagatggaaataaatgtttttatcagtac

SEQ ID NO: 627904 - DNA, 945 bp, Homo sapiens
atgagaacgtgctgggcagatcgggctgaaaaacgcggagtaaccgctgatcatagaagaagtcttgtcaccggtcttctgatgaagctgtcttagtcgtgaagtggtgtctggattactagtacggtatgcactatggatactatttactggatatcttgaagtatgaagtatcagtcttaaatgttgagtgaagtagaaatggtcatgaagtatgttgtgatgaattcgatttgagattcttctatcgttgtcatcatagtttaagttatggttaggattagatgagggtataattagtggcttgtattgtgattttatcagttggtccaatggaatgagttggctggcattattatgagtgtaatcgaaataaatgagatgtgagtatattctgtcattcttgatgaaaataggtgtaactgcaattgttatttgactagaatatcaaggacgaatgtggggtaactttctgttgtaagggtcgtacatactcgagattagatagtcctcgagaatgtgagaggggacgaaatttcggtgtggggaaatgcagtgtaaaagtagggtgggaggaacatcatttggaaatggttcctcatatagaaggttataaaagcgtgtgtgcgaactacttcgggactgtcgtaagatatatacatgtttaaaggtggttaaggcagaacaggggtgaaaaatgaaggggatcgggagggatctcgaatatcaaggtggaaggtaaacctagatgtagaaggtggtcaatgcgtacttagaattgattttacgtgaggaattcttgtggaagtatggggcacgtatgttccatataggagcaccgttagagggacatctaaaaggcggcttaagagggcaggaaatagagtataagaatcattgagaagggaggctgtaaagggccgaaaaattatggtgagggtgaag

SEQ ID NO: 627905 - DNA, 160 bp, Homo sapiens
  misc_feature (95)..(95): n is a, c, g, or t
gtactgcagaagagacgagagtgatatcagtttatgggggaaggcgctttgtgaagtacggccttcatttgctcttgtccgtttcgttacagggnaggaatttgaagtatgatagaaaccgacctgagattactccggatctgaactcagtatcacgcta

SEQ ID NO: 627906 - DNA, 318 bp, Homo sapiens
  misc_feature (33)..(33): n is a, c, g, or t
  misc_feature (42)..(42): n is a, c, g, or t
  misc_feature (203)..(203): n is a, c, g, or t
acacaatgagtgcccttcagctatcaaaaaagnatgagattntggccaggcatggtggctcacactgtaatcccagcacgggaggccagaggcgggtggatcacgaggtcaagagatcgagacctcctggaaaaacatggtgaaacctgtctctactaaaaatgcaaaaaaattagttgggcatggtggcgcatgtctgtaancccagctactcgggaggctgagacaggggaactgcttggaactcaggagatggaggttgagctgggactgcaccattgtactctagcctgggcaacaagaataaaactccatctc

SEQ ID NO: 627907 - DNA, 724 bp, Homo sapiens
cgctcgtgagccatgccgtccaagggcccgctgcagtctgtgcaggtcttcggacgcaagaagacagcgacagcttgtgatcgcactgcaatacgcggcaatggtctcatcaaggtgaacgggcggcccctgggagatgattcgagccgcgcacgctacagtactatctgctgcgaacgccagttctgcttctcggccaggagcgatttgcttggtgtatgacatccgtgtccgtgttaaagggtggtggtccacgtggcccatatttatgctatccgtcagtccatctcccaaagccctggtggactattaccagaaatagtgtggatgaggcttccaagaaggagatcaacagacatcctcatccagttatgaccggacccttgttggtagcctgaccctcgtcgctgctagtccaaaaagtttggaggccctgtgtgcccgcagctcgctaccagaaatcctaccgatcagcccatcgtgtactcataatctcacttgtcataataaacagtcttggcgagggattgtcaccagtttcaacttgatgagatatcagagaggagatgccggcatcattacatgggagaggcgagatgataagagggcttctaggtgtccttgggtacaaggtttaccgaaaccgcctgttgtgtccacttgggcgaatcgccgggccaccgaagtgaccggtaatacccatgcccgtgctctgtaaacgaga

SEQ ID NO: 627908 - DNA, 109 bp, Homo sapiens
  misc_feature (61)..(61): n is a, c, g, or t
gcctttgcggacctgacctgggtctgacgctctcaattatcacccacggacccacacgtancccggctctgggcggggatggggccggggctgctcggggtccgccagg

SEQ ID NO: 627909 - DNA, 427 bp, Homo sapiens
acctcacaatcaccctatgaggtagggagtctcactaactccatttcacagatgaagaaactgaagacaggaatgtttagaaagctgcctgatatggtttagctctgtgtccccacccaaaactcatgttgaattgtaattcccagtgttgggggagggacctggtggaaggtgattggatcgtgggggtggatttccccctggctgttctcgtgatagtgagtgagttctcacaagatgtgatggtttaaaagcgtgtagcacctccccctgcacgctctctcctgatctgcaatggtcagctgtgcttgcttccccttcgccttccactatgactgtaagtttcctgaggccttcccagtcatgctacctgtagagcctgcagaaccgtgagtgaattaaacctcttttcttcataagttaaaaa

SEQ ID NO: 627910 - DNA, 463 bp, Homo sapiens
  misc_feature (15)..(15): n is a, c, g, or t
  misc_feature (89)..(89): n is a, c, g, or t
  misc_feature (111)..(111): n is a, c, g, or t
  misc_feature (163)..(163): n is a, c, g, or t
  misc_feature (208)..(208): n is a, c, g, or t
  misc_feature (296)..(296): n is a, c, g, or t
tttattttttcggtnaccttcagccttaatttaagttatcagttggtaaccacttgggtaatttaaacttaagttgcatttatttggtnacattggtaaccaacattgttnttaaaagttccttgcaacagaatgactataattgagataaaacgttaatttngaggctttaattttgtaatatggattagtggccgggcgcagtggntcatgcctgtaatcccagcactttgggaggccgaggcgggtggatcacgaggtcaggagttcgagaccagccatggtgaaaccccgtntttactaaaaatacaaaaattagtcgggcatggtggcgggcccctgtaatcccagctacttgggaggctgaggcaggagaattgcttgaacctgggaggcagaggttgcagtgagccgagatcgcgccattgcactccagcctgggcaacgagcaaaactccatctc

SEQ ID NO: 627911 - DNA, 349 bp, Homo sapiens
cagctttgtttactttcaccaaagcatttcccatctgatatggtttggccgtgtctccacccaaatctcaccttgaattgtagctcccgtaattcccacgtattgtgggagggacccggtgggaggtaattgaatcataggggtggtttcccccatactattctcgtggtagtgaataaatctcacaagatctgatggctctataaggggaaaccccttttgctttgttttcattctgtctcttgcctgctgccatgtcagacgtgccttttgccttccaacatgattgtgaggcctccccagccatgtgtaactgtgagtccattaaacctctttttctttataattt

SEQ ID NO: 627912 - DNA, 535 bp, Homo sapiens
tgcagtggtcagagtatcccctctggatgcaagagtcacgggtaaaactctaaaaggttattttctgttaaatgcagtagatatgaaagaaaggttggtattactcaggaaatgttttctgtaagcttttcctttctcttacacctgccatgcctcaccaaattgggcatttatttcatctttaaactggtcgtcctgttagtcgctaacttagtaagtgctcttcttatagaaccccttctgactgagcaatatgcctccttgtattataaaatctttctgataatgcattaggaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgc

SEQ ID NO: 627913 - DNA, 701 bp, Homo sapiens
  misc_feature (9)..(9): n is a, c, g, or t
  misc_feature (74)..(74): n is a, c, g, or t
  misc_feature (79)..(79): n is a, c, g, or t
  misc_feature (92)..(92): n is a, c, g, or t
  misc_feature (279)..(279): n is a, c, g, or t
  misc_feature (524)..(525): n is a, c, g, or t
  misc_feature (527)..(527): n is a, c, g, or t
  misc_feature (547)..(548): n is a, c, g, or t
gcccattgngactgcgggctgggggaccccaggcacttgaccgtcccccgtgggacctttttggggaaaaaagnccttntccaaaaagggtngcccacatttatttcccacaaaggggtttaaacttttcccccttttaaaatccaaaaggggaactttgtggggtaaaggcccccccctcaaaaaaatttttaagggagaaacattgccggggggggtttattacccaaggggggcgggttaggggtttttttctggggggagggggagaaaaaaagnccttttttttttcttttttggggggggggcggggttttttaaaaggaggggggggccccttttttttaaccccccggcggcaaaaaaaaaaaaatttttttttgggggacccccccccccttttaagtgtatgggtgtttctcttcagggagagaggggttcttccccccccccccccccccgggggggggggttttcccccccccttcttttttttttttttttctcaaaaaaaaaaaaaaaanntncccccctctctttttttttnncccccccgcgcgcgccaaaaaaaaaaaaaaaaaataaaaaaaagggggtgtttttttttttgggccgggcgttttttttttaaaaaaaaaaaataattttctcccgcccgccgcccagtgttaaaaaaattaataggggggggggggggggag

SEQ ID NO: 627914 - DNA, 139 bp, Homo sapiens
ccaggtgcagagatgcacaggctcaagagagtaaaccaggactgcatgaccgcacagcttccctcccgggacactcacctcgtccatccctagccgtcccaaggactctctactcaacagatgagtagggacaagcccc

SEQ ID NO: 627915 - DNA, 211 bp, Homo sapiens
agcgaactactcatgaacaggctatgcagtgatccctatttcttatgaagacccacttcctacatcagacgtttttgccggttgtcaaatcccttactcaaaagcgagaatttttatcggatagaagaacctgatgacgaaggagacagaaaccagcagcagcagcagggcatataaccacactaatggaactcggtcatagtgtggtggc

SEQ ID NO: 627916 - DNA, 185 bp, Homo sapiens
cctcctttggtttttttttttaagaaacccttggcacttttttttggggtccattgggttttgtttttcaattcccccttgagaattttttattgggttccccttaaatttccggtttgccatttttttaccccccgtcctgggaaggtgggtgtgttaaaattttaaaaaaattggctttccca

SEQ ID NO: 627917 - DNA, 891 bp, Homo sapiens
gaatagaccggtgcgagtcctttgccggggtgtggggggcaacaacccattttgggtgccggggacattttttggcaccggccctttctcctggggggaagtgttctttctaaagcgggagagaggcgggtcttctccctcctaccacggcgcctggttggggaccgagcgccaaaacaagagacactgggggggggagccggcccaatcactcctcctgggggcgttggctgcaccacggcgccgggatgatggcgtgtgcctcccctggcggtttaccgacggacattgtccaccaatgcctcggggcacacagcagtcgtcctgagcgagcgccagcagaggttaagaatagggggggcgcccccccacaaagtcggcggttgataattcagggttattcctcctgacgcgccgccaactctgggcgcaggaaacggggggctgtcaacaattctcgcgccccccaataaggtgacacagtcggtctctcccgccccacttgcggtgtcccgcgcgccgtcccacactgccgctcatatcttgataggtgcgcacccccggggctttttgggaggagtccaccacgggggtatactttggcttctcccaccccagagcgaggccctctttgttaaaggatacgccaaaggtgtctttcacggggaggcaaaaactggggagcccatttcgggggaagtacaataattgcccctatctccccccgcccacatgtgctttggtttgcattcaagctccagaacccctcttcttctatgacaatgcgctgaaacacaccccttctgcccatcctcagacgcacattatccgttcgaacatcaagatcaagcgcgccccccaaacaaataaaaaaaaacaaaaaacataaca

SEQ ID NO: 627918 - DNA, 501 bp, Homo sapiens
ccagctacggatgtggagaatcgaaggttccaacaatggtgcccgtggaacctgccacatattgacagttctatggaggcgacagcgtacatcattctgtacgactaccggcatggtggccgccaggggcagataatctataactgggagggtgtccagtctacccaggatgaggtcgctgcatctgtcatcctgacgtgctcagctggatgaggagctgggaggtacccctgtccagagccgtgtggtccaaggccaggagcccgcccagctcatgagcctgtttggtgggaagcccatgatcatctacaagggcgggtactcccgcgagggcgggcagacagacccatggcagtcaccgcctcttccaggtccgcgctaatagcgctggaggcacccgggcgtgttgaggtattgcctaaggctggtgcactgaactccaacgatgcctttgttctgaaaaccccctcagccgcctacctgtgggtgggtacaggagcc

SEQ ID NO: 627919 - DNA, 245 bp, Homo sapiens
gatatgtcttcagagcagaactaaagaaatgcaaatgtgtccatctttacagcaagcctatatcacatgtttatgtactatgctccctaatgaagatgctattaaggagattgcaaaggtcgactgcaacgaagtactacacatcgtttgtgatccgtaatctgtaggggctggataacacagcatttgttctttgtacgacttaccttacccagcagactccaacatctgcaagtgtatattgt

SEQ ID NO: 627920 - DNA, 556 bp, Homo sapiens
cgttgaatctagaggagtcccctgacgtgtcctgctccattgaacataagcgccctccgccgaaatctccatgtagttggagaggtacagcagcgaggtgtagtctaaggatgccgtacgtcaccttgtccacgtgcgcatgccattactcgtcgtgcgctggaagagccttgcgctgtttatgcgggagaagaaggtgggcttggtcagatgcagcgaggatgcgctgatgccaaaagcctcagcaatggtgagctggaccttctgccgcacctcccggtataaccggaagtcctcctctgagaagatgttctgtattttatccccgaagtatctgtacaggttcacaaagtgcttcccgacagacagggcccctgagtgcaagtccagaatggatgcccctccgtcagatcctcccagggagagccccttttcagctacgctgcgaatccgctccgcttcctccctggtgatgacgacatcggtgacacctctgccgcactttcggggagtgcagccttcgaacctgcggtgactgtcgtagtcctcagagcag

SEQ ID NO: 627921 - DNA, 476 bp, Homo sapiens
gcccagcatgagtgtcttcgaccgtccgcgctttcatgtgtacttcccttaggatcttccccatccgaagtgcgccacgttccaacgtatcactccgcttagtttcgtccggcacagctattttcaaggagacccaccgcacgtcttcgaacacctcgataacacccccctcaggagtcactaggccatccgggcatggtgacgctgcccgcgctggcctgtccggcgctgttcatcgccttcgccctattcttcgttctgcctctgggcttccacggcctctgggtgccggatgaaacgcgctatgcacaggcggtccaggagatgctgaacacggacaactgggtggtgctcgcacttcatggggctgcgtgatttcgagaaacccataggaggctattggttgatcgcgatcgcccaggcgctattcggcgacaagctcttcggtacgcgcatagcctcggcgcccccggccg

SEQ ID NO: 627922 - DNA, 371 bp, Homo sapiens
atcattaacagcgtaatttttcatgcatatttaaagctgagtttaatatgatatgtattacatataggcaattgtagggcaatacccacagcaagtggagtttcttacttggccaagagaatgcttatttaagaggtagacttccattctgacaaaatctcgcccaaatctgtgagagctttctgcttgctgcatttgtcccccttactttccttgagctaaagacagtctttttccaccagcatcatcactgctatcatcattaacagcgtaattatacaagcatatttaatgctagactgcaggggattcttttggagcgggctcccaggctcgcagctcttgacttggccatagttttacactgtggg

SEQ ID NO: 627923 - DNA, 898 bp, Homo sapiens
aatgccccaactaaatactaccgtatgggccaccataattacccccatactcctgtacactattccgtcatcacccaacgtaaaaatattaaacgacaaagtaccacgcatacctcgcctcagccaaagcccaaaaaaaaaagaaataaaataataataaaaacaatggtggtgtgggggaggcttgggccactgaggagaggagtttgtagtaaacatataacgagtgggaggggagggggtcctagtttgggcgaattctgggaagaggtggggccacatatggtggtactgtgaagagaaaactcggtggcaaggtgacaataagggtggtggggggtctttccgccacctattatgaggaaaaaatccgcggggggtgatcaacagagggggggctgctgtgaaaaaactgttccgcgagaagtgggcttacacgcgagggggccacaaaaacgcgggggtgaacaatacacaagagagaggaggtccccctggaggggaagagacgatcaaaaaatgcgagaatctaaagggccgcggcaagacggggaaaaggtggtcagctaaactaggtaggcgataccacaccaaggggtactgggaagccagccctgaccaaagggccagggggagacagaaaccccgtgcaccccccaagggcacaacccagcagtactcgacaacccaagggtataatacatgcggggcaatagccggcaatgagtaggtaagcagccccaaaggacctaaccagccgtaggccagggaaggagggagcccatcgcagcaccaacacgcatggtgaagcccacacagagaacaccatggggcaccagaccggcgccggaacagccaggcgcgacaccaactcgccaacgagactgaggagccacag

SEQ ID NO: 627924 - DNA, 101 bp, Homo sapiens
atgatgtgatacaagtcaaactttgtcagcctaacttcgtatttatagatacgcactttgcaggatgaccatcagggactatgtggattgagtaatgtgga

SEQ ID NO: 627925 - DNA, 130 bp, Homo sapiens
aggatgtgtcccccccttatcaaccgggctgaggaaggaattccctttttggtcggaaccctttatttatttggcccgtctaattatttctgatcttcttgtaatatctttaaacagcatttgggaaaaa

SEQ ID NO: 627926 - DNA, 120 bp, Homo sapiens
  misc_feature (98)..(98): n is a, c, g, or t
agccatccatggctgtacattcccagattttagtgaaaagcctttccccaccaattttggaatgtaactgatccattgttaacccagcttttgtatgnaaacactttgttttcgggatcc

SEQ ID NO: 627927 - DNA, 161 bp, Homo sapiens
ccccaacggcaaggttccgtgagaagcaccaccagctccttaggagcaatggcactgctctggctcctctgacacctggggctggcactagcgggtccaaccaggtgagcctctgtaacccatctaacgggcccaaacgcctcctatcatgacctaggtgg

SEQ ID NO: 627928 - DNA, 133 bp, Homo sapiens
ggtcccaagaagcatcttaagcgggtggcagctccaaagcattggatgctggataaattgacccgtgtgtttgctcctcgtccatccaccgtgacccacaagtggagagagtgtgtcacacctaatcatttcc

SEQ ID NO: 627929 - DNA, 160 bp, Homo sapiens
aaggaaaaccccccccggggcccccccctggcttggtttgttaatggccaaatttttttttttggctacccggccaccctggggggagtgtggcaggtgccccttggcccccgctaaaagtttttggcagagctttccaaataaaaaaaaaaactggcca

SEQ ID NO: 627930 - DNA, 172 bp, Homo sapiens
ctccggggtagctgaacagtgtcacattttgggctctgagatggtccataacaatcatcagatgcagtattacatcacatttgaggtgcttgaatagtacttggaatgagctatagaaacaaagtccagcaggcccaggataaggatcacatcattgcaacacggtctctca

SEQ ID NO: 627931 - DNA, 309 bp, Homo sapiens
ctcacaaatcgaggacttcgaggctcgcatcggctggttgccactgttacaggcagaaaccgaccggagaggcaccgcagggcaaaggttgggaggtcactggccggacgcaggctgcaaggctgacctgcatccccgaggtggccagaatgcacgtgggggccatcgctgtgccgtcagctgcatcctcaggcgtggagacttagtggagacccaaggggcgagaccggaagcttcctggaggaggaggcagcactgggtttggggcaagagaaaagctaggagttcgctcgcgcgaaaggagacagg

SEQ ID NO: 627932 - DNA, 223 bp, Homo sapiens
tgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagt

SEQ ID NO: 627933 - DNA, 365 bp, Homo sapiens
tttgggctcatgcagaggggtagtaagcctgggggactggggggccaccatggacggctttgtgcatggcccagattatttcaaaaggggtgggccaggtgtggtggctcatgcctgtaatcccagtgcttcaggaagccaaggcaggaagatcgcttgaggccaggagtttgaagccagcctgggcaacataccaagatccccatctctataaaaggttaaaaaaaaattagcccagcccaggcgtggtgactcagggctgtaatcctagcacttggggaggctgaggcaggaggatcacttgagttcaggatgtcaagaccagccggggcaacatagtgagaccttgtctctattattatttt

SEQ ID NO: 627934 - DNA, 425 bp, Homo sapiens
tttttgttataaaatccggtaaccttaaaaaaatattttgagttatcccgtttttccccccctttgaaaaacctcacaaggggggttccaattagtgccgcgccctcccaaaagttttagggaggacccagaggggtttttcgggtcttggattatttttaaaaagccgttgggtatccctttcaaagtttggccacccccccccccccctttaaaattttacctaaccccctcggggagcttctttaagtcgtttattttttttagacccctgggggacaaggggcacccccaggtttccttttccggaatttttttcaaagggtgaacggccccttttattattcaaagggagggaaaccttcgagggaaaatttcaaaaacattaaatggttaattttcccaaaaaaaaggaattttgggtt

SEQ ID NO: 627935 - DNA, 335 bp, Homo sapiens
ccaagacaaaaagcttctggcatatgtataaactagaggtgataatctcaaaaaacggtccaaaattataataactttccagtttaaaaactttattcctaaattaaaaaaaaaattctatacacaaaccatggattggcccagaccaaagaaaggaaagaaaaggaaagaaagaaagaaagaaagaaagaaagaaagaaagaaaaaagaattcaggggtaagggtaggcagggacccagaggagcggatatccacagtccttacattggacaactctttcagggatttatccataaggtacttaatttaacaaccgggctttcctaataaaaca

SEQ ID NO: 627936 - DNA, 388 bp, Homo sapiens
ccataaccttatgaatagctgggactacagaaaggcatacgccaccctgcctggcttaattttggactttcaatagaaaccgggtttcaccatgttggccaagctggtctcgaactcctgacttcaagtgatctgcccacctcaacctcccaaagtgctgagattacaggtgtgacccactgtgcccagccaatttttgtattttttgtagagacagggtttcaccaagttgcccaggcttgtctcgaactcctaggttcaagccatctgtccacctcagcctcataaagtgccatcatggccagcctcatatgttcttttttgttttgttttgttttttgagacacagtctggctctgtcggccaggcccgtgttggcacgatctca

SEQ ID NO: 627937 - DNA, 942 bp, Homo sapiens
tcaaacaggaacacacgaggacgatcgccccctcggacactacctcattactctccaaaaattgatgtgatacctaagaacatccccgtgcatgtagaggattcaatgcagtccaacgacaacgaagtggagcggaggcggatgtaccagatcattagcgaagctgaggatcgtccagactttcgaaattcattccagcactgtaacgcaactgatccagcaagaggggagcgagataagaggagggatccttgttctctaaggtccatgcagattaccatcctgtggagattggactcctagtccaacctagcgcatgctcgcggagacctgtccacacaagagcgcccgcagcggctgcaagatggacaacgagctcctgaggcagccagatctgaggagctgaaaaatgagaaccgcctcatgcttctagccccatgcatgcagcaagcaccaaccatgggagtatggtgggcggagggcaaccccgggtcagttgacgccccgccagccaccgcagcttagcctgccccgcgtcgcatgctggcctctgtatgggcccccttctcccagtcctcttacgcctaagagacggggacacttgtccctcctcctcagttgcgtattttcatacgtgcgatttttgagctcaaacattggggagtaaactcactgggctttctgcgggacttccgctgtcctaccgtggcttctccttttgcgtcaatggtttcctccctgcgccatccgattgtttctgccggtaccttctcccggtcctctcgtaagtcccggcccttcttctggtctcgcctgttggcacgtgggggtggaccatagccgcttgctcctgtagccctgggctcctggaaggcctgaacccggtgctgatggcgggcggcctttggggccacccgggcggactttcgggcgtcccccgcc

SEQ ID NO: 627938 - DNA, 141 bp, Homo sapiens
aaaggcccaaaaaaaaagggtttttttttttccctttttggctaagaaggggcgggtttttttttttgggccggtttgggggtggggggaaccatgttggccccccaaaaaccgggatttttttttgtggggttgttccca

SEQ ID NO: 627939 - DNA, 517 bp, Homo sapiens
gcgactgctgcgggcctgagcgctggtctcacgcgcctcgggagccaggttggcggcgcgatgaggcgcaacaaggctgacgtggagcggtacatcgcctcggtgcagggctccaccccgtcgcctcgacaggtgagtgggtctcgaagagaccgacggcctcgacctggccgggcggcggcctcgcgctgctcaggcgtcatggctcccgacgggcgctgctccctggcgcgctctgttgaggcgccggccggctggcgcagtcctgtgggcggcgtggcgcttgcaagcgcatgaagagtcctggggggacagcggtgggcgggagacctttggcgccggcgcttcctctttctcccggcttgttcccgacgcttgttcccgacggtgctcgctcctggggccgccctggcccgggctttttggccgatcgcgcaccccgtagtaacccgcgcggcctatttttcgggagcttgggcacacgggtgctgtattggcgggttttttccatcctcgg

SEQ ID NO: 627940 - DNA, 171 bp, Homo sapiens
gcgaaaacccgtccccacaaaaaatatttaaaaattagccaggcatgatagcgcgcgcccgcagtcccatatattattacttggggggctaaggtgggaggattgcttcagtacaggaagcggaggctgcagtgagccaagatcatgccactgcactccagcctgggcaac

SEQ ID NO: 627941 - DNA, 1361 bp, Homo sapiens
  misc_feature (1)..(1): n is a, c, g, or t
  misc_feature (815)..(815): n is a, c, g, or t
  misc_feature (850)..(850): n is a, c, g, or t
  misc_feature (1084)..(1084): n is a, c, g, or t
ngtccacaagttttgtcccccccatgtgcccacatgcacaccgtgtgataaacacaaatgtggtggggccgcctgtgttttctttttggaaacgttttaaggtgggccctttgtaaaagaaccacaacgagtgttgtcgcccaaaaagattgtcgtgtgaaccaccgtccacaagctgtgggtatatgtaggaagaaaaatggtgtccgaagtccacaggaagattggtgattggcccccccgccctgttatgatagaccctcttggcggcccgtattgatttagcgccactgggcagcgtgtttgccgcccgcccccccccggcggccacagattgggttttaatttggttgaacgtgggacgctttctttccccctgtcccacacattgtttgggtttgttttgttgcccccctcggggttgccacccaccggttgattgttcccccgtcgggtgtcttcttcccggcggaggttgtttccccaccgcccccacgtcgtattaccggctcgcccccctcgtggtagttacctcgtttgagagtatttgttccccccgccccacgccgctgcttgttttttcgtgtagcacaccttggaagcccgccttcgtgagcaccacacaagtgttatgcccctctcccccaccgcgggagaaagagcgctttttctcctataggagagaggtccttttccccacacataaaaggggcgcctggggagaaacaatatggtgcctggatgaaaattggataacggcgcggcttctcacagcatctcgttccgcagagaaaggcgcgtggagtaacacacancacgcacactcgtccggcgagaaatcacacagctntggtgagaggcttatagacacacacccacgcggggtgccctctttatgcgagcacacgagcacctcttataccccaccacacacccctctctctctctacacacacacctcggagaaagtgagtatacacccccttcccccactatatgtccccctatggcacgctcacgccacgcacacaacgcacacagttcacacagtgaattccctcggcaccgagacaccacactctgnggctgagactctaatgttttctgtggcgcactcttctggccacggagatttctgttcttctttcacgagaactcactcctccacacaaccagaacttgagcacctgtgtccttgccccacgtcctatggagaactgtggcaccaccacgagatgttcactttttaaaacggagtttcactggaacacctctttgtaacttaatgtttataaagaggagagccctgggtaacccagtgatcttccccatcacagagttagtaaacctctgtactacca

SEQ ID NO: 627942 - DNA, 410 bp, Homo sapiens
  misc_feature (248)..(248): n is a, c, g, or t
  misc_feature (406)..(406): n is a, c, g, or t
ccagggttcaagtgattctcccacctcagcctccagagtagatggaattacaggtgcctgctaccatgcccacctaattttaaaaaatttttgtagagatagggtcttgctatgttgcccaggctggtctcaaactcctggcctcaagtgatcctacctcctttgcctcccaaagcactgggattataggcttgagccccctcgcccaacctgacacctttcttgaggcttgcagaagcaccaaggtnctggcctgtgactgggccgaaaacattttaggcattttgatatggggcagggcatgcttaactgaggagtccagtttttccagtttagttcttgctttttggattgggaatgtttcctggcccattggctgttggggaatggcttcaggaaaggggcnttgc

SEQ ID NO: 627943 - DNA, 687 bp, Homo sapiens
  misc_feature (687)..(687): n is a, c, g, or t
cccccctgctggaattatgcacgagaagagaattttgtttgcccacttgatctaatgaacattgtcctttatgcccgtaacgccgaatataatcccaagcggcttgctgcgggaatcatgaggataagagagccacgaaccacggcactgattttcaggtctgggaaaaaggtgtgcacaggagccaagagtgaagaacagtccagactggcagcaagaaaatatgctagaggtgtacagaagttgggtttttcagctaaggtcttggacttcaagattcagaatatggtggggagctgtgatgtgaaggttcctataaggttagaaggccttgtgctcacccaccaacaatttagtaggtaagtctgaaatgtattgtgattgttattggcaacaggtcatttataatctaaacattgttcagaataaaacacatgcacaatattcagtatatgagaacaggtgacatgggtataggtggatgtattcttgcaatggctttctgatggtctcagacatatttattaccctcaccagcctttgttttccttataaatttgcggaaccaataacttcccttactgggaagaaattgattctacttctggatgttttaacggtcaattgcgtgaactcggaaaggcatggaatggacccctccttgtatcttttttttccacgctttgn

SEQ ID NO: 627944 - DNA, 783 bp, Homo sapiens
tttcttttgtttcggtgaggggttcaaagacaggatctcggcgtcgtggcgtccggtactggcagtgcaggtggtgtggattgagggatcattgcagagtctgcctctcaggctcaggggatcctcccaatttcagcctggcctccgaggtagctgggactacatggtgtgagtcacgccagctgtattgttgggcagagcagggatctccctgttttccctagagttggtcatcgaactcctgggcattaaatgactcattgctggctctcagacgtgcagccaagagtgtgggtgattactggtgtgagcccccacgcctagtggctcgagccaggcgggtatcatcagactcgccaatgtttgacgaagctgccctgcctcctagtggagctcacgccaggcaggccagtgggcctaaagcgcatcaacacatgacaacgacagcaggtggtccatgtgtggagtagcttcctcataggctgtgctcggagttaattcagccagctctacgagaagggactgttaattaaggtctaggggctgagagccaagtttataactagagtctcagatccctaagaaacctgatgtgtgctaaggaatcttcccaggtaagaagaaactagttcctctagtagtagtactgaaaggccataagcatgcatatcgctgctggattgagctgtgtggggtcagctgaggtggcaggcaccgtgtacgtagctcattacatctggcgacgggtcgcaggggccagtaatgaggaatcgtgggaagacg

SEQ ID NO: 627945 - DNA, 586 bp, Homo sapiens
  misc_feature (7)..(7): n is a, c, g, or t
  misc_feature (55)..(55): n is a, c, g, or t
  misc_feature (108)..(108): n is a, c, g, or t
  misc_feature (110)..(110): n is a, c, g, or t
  misc_feature (123)..(123): n is a, c, g, or t
  misc_feature (133)..(133): n is a, c, g, or t
  misc_feature (135)..(135): n is a, c, g, or t
aacaggnagaatacgcggagggcccctccatcaaggcggtgctcctggggtgccnggaccggggcagtgtcacaccctgctgctcaagtcctgagtccgagatgctangnacgcgagtaatgnaatagttgtnangtgcaggcctgaaaggctgtagtcagacctccgccctcagccagagcaagcttggggcaccatgcccagaatgatagaagccatccacagccttccctgtcaccggctcctctgtcctgcctaccctggtcctggcgggacttcactatttgacttggtttcctttcagatattcttgcctccagtttgctggctggcttttccgtctacccccagtgacctcacaaaaaggccctcctgccacccatggtcatgtggtgtcccccccgcccacttgtttgatgtccctgactgtctacatgtatttatattcttgatattttctaccctccctagaatgtaaactccatgaaggcccagacttttcttgtttttttctgtatccctaaagtaagaccaacttgaacctggcatatagtagctgcttaataaaaactcgtctgtcaatgga

SEQ ID NO: 627946 - DNA, 903 bp, Homo sapiens
agcggggaattgcccgagggcggccgcagaacggtcaatttgagccgcgtcgaggtcgggcttgggaagggtcagcgggaggcctgagggcgccgggcgctgctggcaggcgggcccggggtccagccgagacgggtccgggcgccaggcaacgcgattcgcgccgggggtgaacccggggatggtggtgccggcctccccgttctgggacctttcagctcccctgggatccttgtggcctgccgtccaacacgaccagtgctcctggggcgcctgacttcccagctgttgatgggccgttccttgggcaggcggccgtccgccttggcccgtctctggaggtgctgggcatccgtgcgtctgcggagccccatttagcgagtcatcgatcagctctggccggccctagtgtagggcggactctctccactcgcaagggggcctctagctggagctggaggagattgctggtccccaggaagatgtccgtcagctcacctggagagctggctcacggcgccgttgcttcctgcccagacctggatacctggtacctcagggactgtggctacaccggaaatcctaccagtgtccggccagccagataggggaaggggccgagcatggggatgaaggcgtcgcgatgcgcctcaaattcagtgcacaaaacgtgctgaggatccgcggcggaagatgaagcacaaaagcaccggaagctgggtgaagaacgacgcggttcctgcgggagcgaaagtccacgacggaccgccttgagacgcaaggcagatcaagttcgagaaagacctgaggcgcatctggctgaaggcggggctaagggaagccccgaaggctgggagaaccccaaagatctaacctgcggggcaaatgagtctggcgcggcgt

SEQ ID NO: 627947 - DNA, 333 bp, Homo sapiens
tggaaaagtgtagttggcaattacacagtaaaacttaacagtgttgactatcagagtctcacctctgtctgttatttgagtacatcccctatacatctgtgaataaatgataatcgtctcttagagtttgtactttatgtgaacatgccagagttaagtaaattgtcaaaggatccagtttgacaatgtgttatttgtcaatatcaataatgaataacagatcttagaaaaatgaactcttgtgcatttcactgtagagacatgagatagtacatgccagagtgattcagacattcaaaaaggtgcctcaatgaaataaaacatttgcggccg

SEQ ID NO: 627948 - DNA, 112 bp, Homo sapiens
  misc_feature (108)..(108): n is a, c, g, or t
tgcctgtgagctgcagaaagtgcaggagctacagcagcagagctgcccgcgaagttgtgggagctccagtgtcctgagtggcacagctggaagaggagtcgcccttgntcgt

SEQ ID NO: 627949 - DNA, 933 bp, Homo sapiens
tgcagcgcttgcccaaggtcatcgggaaccagagcctgtcaagagctggccttcaccgcccgaagatgatggctgacgaggccctggcgcaagttgggctgtccagcggtgtgttcccagacaaagaggtcatgctgatgctgccttagcgcttggcggcgagatttccagcaagagcccctgttggcggttgccgacagccccaatgggtcaaccttgggtgtattccccgcgaccatttcggcgtgccggagacgctctcaaaataggtggccgtcctgggaaactttgcagctttgttggaaggacccaaaaagaacctcctgtagaacgccggcccaaggggcccaggcttgggcacacacaatggggattttggaaaaacgcggtcaatcttttcctcccaaatgttttttggagaaagccttcgggttgtcccagagggccccccaaagcgaggggcgccggtgcttttgccccgggccttcaatcccaaagagaaactgggggacgcatcgggccagaacagaccggttgggtacatactgggcctttttcggggacgaccgggtttcccccagggtttcaatcaaccttttacgtgcaccgatgtcatgcttttcctttaaagggccccaaaggggcttttatttttttcacccccccacaaaaagtgtatagtgatctacaacgcttacatcaccatcatcacagcagtaaccaaatagcctgtttgttggccgcgcgcgtgcgcccctcgagagagcaggtttacaaacaaacaacttggtggtggggggcaccgacccgacgtgagtgtcaacggacaacctgtgcctatcgcgtgtttcccaagacgacatctcgtgtgcacacagctacgtggtgtggggttccaccaaaataaaacacccgcggggcaccccgatgtta

SEQ ID NO: 627950 - DNA, 328 bp, Homo sapiens
  misc_feature (23)..(23): n is a, c, g, or t
  misc_feature (319)..(319): n is a, c, g, or t
ttgagcgataccgccatgggcgnattgtgctgtccgacagcaagctggcggcgatggaggtgagcggggtatttgatctggatgagcctgaggccctgttgcggacgcttgagcagcgatatggcctgaaggttacctacctgccgtggttggccgtggtgtattgatcggcctgcagcgatctcgtcgcagtacagaaataaaaatattttccatttggcactgcaagttcgtgcaagccagaccgtcgtagtgggactgatcagcaacccattctcatttacgacttgtcaggaagctcatacgtgcctctgatgcnctgcccttg

SEQ ID NO: 627951 - DNA, 138 bp, Homo sapiens
gagcatgagccagcattcattgatgcttggaggtcgacttgtattcacctaggtgcatgtgctagtgcctctcgctgtacaagttccgtcgacacgtgagcaccgtgctgacctccaaatatcgttaagctggaacct

SEQ ID NO: 627952 - DNA, 879 bp, Homo sapiens
  misc_feature (162)..(163): n is a, c, g, or t
  misc_feature (496)..(496): n is a, c, g, or t
  misc_feature (510)..(510): n is a, c, g, or t
  misc_feature (520)..(520): n is a, c, g, or t
  misc_feature (559)..(559): n is a, c, g, or t
  misc_feature (575)..(575): n is a, c, g, or t
  misc_feature (579)..(579): n is a, c, g, or t
  misc_feature (583)..(583): n is a, c, g, or t
  misc_feature (600)..(600): n is a, c, g, or t
  misc_feature (603)..(603): n is a, c, g, or t
  misc_feature (608)..(608): n is a, c, g, or t
  misc_feature (612)..(612): n is a, c, g, or t
  misc_feature (617)..(617): n is a, c, g, or t
  misc_feature (619)..(619): n is a, c, g, or t
  misc_feature (631)..(631): n is a, c, g, or t
  misc_feature (639)..(639): n is a, c, g, or t
  misc_feature (667)..(667): n is a, c, g, or t
  misc_feature (669)..(669): n is a, c, g, or t
  misc_feature (671)..(671): n is a, c, g, or t
  misc_feature (754)..(754): n is a, c, g, or t
  misc_feature (759)..(760): n is a, c, g, or t
  misc_feature (803)..(803): n is a, c, g, or t
  misc_feature (877)..(877): n is a, c, g, or t
aagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgannaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgacggagggtcgctcttgttgccgtggctggagtgcgatggtgcgatctcggctcactgcaacctttgcctcgtgggttcaagtgattctcctgcctcagcctcccgnagatagcctggganttgcaggcgnccaccaccaccgcccacgctaaatttttgtaattttagntggagagaggggtttnaccngtgnttggccacgcctggtcnggnaacancctnacctnanggcctcttcttnagcttctngagacctcactatcctattatgtctttntntnaagacatgctgctttgtaattatcgaaagtgtcgcatcaaactctctggctatgcatgggtcactgcctgctctcacatcttngttgnncagcagggcatggtgtagtttagtcgctcaccagctatctgtnctgcctgcaacagtaccctttcgtggaaagctagataattgtccgcacagaactcagttcatcagaggaatatnaa

SEQ ID NO: 627953 - DNA, 315 bp, Homo sapiens
  misc_feature (102)..(102): n is a, c, g, or t
  misc_feature (169)..(169): n is a, c, g, or t
  misc_feature (250)..(250): n is a, c, g, or t
  misc_feature (282)..(282): n is a, c, g, or t
caacgacaactttgtctagctcatttcctggtatgacaacgaaggtgcctacagcaaccctggtggtggacctctatgtcaccacatgtcctccaaggagtnagacccctggaccaccagccccagcaagagcactaagaggaagagagagaccctcgcttctggagantccctgccacactcagtcccccaccacactgaatctcccctcctcacagtttccatgtagaccccttgaagaggggagggncctagggagccgcaccttttcatgtaccatcnataaagtaccctgttctctacataaaaaaaaaa

SEQ ID NO: 627954 - DNA, 211 bp, Homo sapiens
  misc_feature (16)..(16): n is a, c, g, or t
  misc_feature (25)..(25): n is a, c, g, or t
aagcccataatttctnccttccccntggggggtctcctcccccccccccccccccccattttatggcttccctttggccattggtgaattataactgcggctgaaaccaaccgggtcataaagatggatttttttagaaacaaaaatttacctggtggataattgggttttttttccctggaagggaacataaaaacctcttttccgggga

SEQ ID NO: 627955 - DNA, 642 bp, Homo sapiens
  misc_feature (162)..(163): n is a, c, g, or t
  misc_feature (394)..(394): n is a, c, g, or t
  misc_feature (402)..(402): n is a, c, g, or t
  misc_feature (430)..(430): n is a, c, g, or t
  misc_feature (432)..(432): n is a, c, g, or t
  misc_feature (434)..(434): n is a, c, g, or t
  misc_feature (517)..(517): n is a, c, g, or t
  misc_feature (522)..(523): n is a, c, g, or t
  misc_feature (566)..(566): n is a, c, g, or t
  misc_feature (640)..(640): n is a, c, g, or t
aagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgannaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgtcttnagcttctngagacctcactatcctattatgtctttntntnaagacatgctgctttgtaattatcgaaagtgtcgcatcaaactctctggctatgcatgggtcactgcctgctctcacatcttngttgnncagcagggcatggtgtagtttagtcgctcaccagctatctgtnctgcctgcaacagtaccctttcgtggaaagctagataattgtccgcacagaactcagttcatcagaggaatatnaa

SEQ ID NO: 627956 - DNA, 158 bp, Homo sapiens
cttgctgatgtcagctctatgaggatccccgaagcttaatagtgaatgatacctctttacggactcacttatttactcccgtagagagcccatgatcgaagtccccatctgctggcgtcatacgtactatgccgcatgtactcttaataactaagcgc

SEQ ID NO: 627957 - DNA, 159 bp, Homo sapiens
taaggatcccctctggatagcaagtgtctatggatagtctcaccatgaaggtaggcaaataaaatgactctcaagagggcactagctagcccatggcttcacaggtccagccagcccagcacgcagccgtgctggtgtctttaacccaggtttcttaaa

SEQ ID NO: 627958 - DNA, 104 bp, Homo sapiens
taccgagtcagatcgagacgccggcacatgctgaacccatcttacaaaacacaaattagcggagtgcggcagcactgtatccagcactgcgagttaggacggga

SEQ ID NO: 627959 - DNA, 615 bp, Homo sapiens
tcacgccctgctcgagcaccgctcgagttcggcgactctaggtctgcccacgagtaatcggtggcgatggagaagccgggcctatcatgcccaccgtggaccccgcatgtccgggacgaccttctatggaccaagtacgactcgtagggtacttcccacagctccgcgggtaccccctactactgtacgagcttcgaggtcttcgggacgcggccctcctgtccgtaccccatggtcccgacgcaccacgcgtacctcgggtaccctctgggtacaagcggcgtaccaggttccggggtacctcccccatatgatcggcgctggctatctggagagcaggtctgttgtaggtaagaaagggcgtcggacggagaaggtaggagtaccccaacaaggaggacggaggaagaggcctactacccgccgcgcgccgcccccgtacttcggagaccgatctcgcaggcgtcccgagagcgcaggctcaagaagaacttggcctgagtcgggaaagtttagtcgtctgatctgacgttttctacagtagctttcgtattttttatcctaatttgaaggcacactgatgaagcataccgtacccctccgagttataacgtc

SEQ ID NO: 627960 - DNA, 327 bp, Homo sapiens
aaaaagtttaagcttcccttgtagacagatccctggctgcccttaaagtgtgtttgcatggccccacagggttggaaaacccttaaaggcaggaattcaaggaaatgtttgatgatttttggcattgccatcaaaagcaaaacaggcatggaaaatttgggtgagtgggcgagccaacctcctccccccagcaaagttccatccatgcttggataataagggagggttttgtgtcccctccagtggggaaccataaaggacccatcaagggtgtggttggcctttggtgttttttggaggaatgaataaaaattaataaaattccta

SEQ ID NO: 627961 - DNA, 862 bp, Homo sapiens
  misc_feature (839)..(839): n is a, c, g, or t
gtggaaactgggggaaatatggggcattccctattttcgtaacacctttttggcggtaacgggaactgggtttaaagttacaacctcaggggtgtaactccaacatagtgcgcacaatggcacattttaccaagttggtttgcctttggggtcctccctctttatatggtaacggggttccgggaccttaaaaagtagttgtcggctgacaggccataatatgttatgtcataggtaaactaggtacaacccgccctccgtttgttttcctctattttgtttccgcaaaacggttaataatttgaaaaaggacttttaagttaaagaaataattccaaaggaattttggttctcaaagtcgcaaaagcccctatcgtggtcttgcaagcgctgcatctaggggaaagtatggatacgaggggatgggtaagaggtaggtaagaccagtagggaaagatcaagggccacatgctctatagctggggaaaactgctctggagccgtttactttgagcatttgaacactagaaaccatttgatgtggcagggattcacgtcactcgatcagcacaagttctacactgaacttgagtctaagagtttagtgagtttcaaaagccttggtctcaggagaagagtaaactttcatattgggcagtggttcactcttaaaacacacacatacacacacacaaacaattttttaagaaatcctaataagtgaacatacccggaaatgctctgtcttgagtcatgagaaccatcagttcttgatagtgtcctagactagcatctagagcatacgttgtaaaattcttttaggcactgtgttagatttntaactcccacgggttaaatgaaa

SEQ ID NO: 627962 - DNA, 237 bp, Homo sapiens
tatagttagtgtaaatactttaaaatagtagtatttgggggatgttttccatccttcggtatatatacccacatacttattcattgtaaatcaagttgtattcctgtgtataatttgtagaactgatttctgcttctagagaagttgcacctttaattttttaaaggtcccttccacctgtaacctctattaatgtctgtaaatcagacacttgtatttttaataaggattccctat

SEQ ID NO: 627963 - DNA, 263 bp, Homo sapiens
  misc_feature (27)..(27): n is a, c, g, or t
  misc_feature (39)..(39): n is a, c, g, or t
  misc_feature (74)..(74): n is a, c, g, or t
  misc_feature (81)..(81): n is a, c, g, or t
  misc_feature (90)..(90): n is a, c, g, or t
  misc_feature (93)..(93): n is a, c, g, or t
  misc_feature (95)..(96): n is a, c, g, or t
gcacgagaacatgaaaacgaatggatnccttatgagatnccattggatctcactgttgagccagcacatgctcntaagcanccggtatanatncnngcttcaaatatgtttcatatccgttcttaaaaaagagcttttggaaagaagctgttgacacatcagtcaacttagagagactcgacattattcaagtaatgctctatcttgaacgtcttggttcattcacgatggccgattctttctcgtgccgaattcggcacgag

SEQ ID NO: 627964 - DNA, 332 bp, Homo sapiens
ataagctgcaccagcaagagcacccgctcaggtccccttccacactgtggacgcttgttctttcgactcttcataataaatcttgctgctgctcactctttgggtctgcatcacctttaagagctgttaacactcaccgtgaaggtccgcggcttcattcttgaagtcagcaggaccacgaacccaccagaaggaagaaactctggacacatctgaaggaagaaactccggacacaccatctttaagagctgtaacagtcaccgcaaaggtccgtggcttcattcttgaagtcagcaagaccaagaacccactgcttcccagcttgctcaga

SEQ ID NO: 627965 - DNA, 144 bp, Homo sapiens
agagatagctctgttacatctagggctctgtttgctctctatcgaatcctatcctccagacctctttaaatcagaccccaggtttgatccttcccacagtcagtataaatcatttttcagaactttcatgctttccatcgaagt

SEQ ID NO: 627966 - DNA, 174 bp, Homo sapiens
cagacacagaacggtggggtggggcgtgggggcatcaatgggtgaccagagtgggacagcaggaaagggcgactgtgatggaggagcagtgctggggctgggcctcagccattcatggccagccctgtggcccatcccagatgctgtttgttgccaatatgaagtatccactga

SEQ ID NO: 627967 - DNA, 766 bp, Homo sapiens
gccctgagagattcttcctatcggtggctcacatggggacgctaagaattgctacctgtgacttctcgttgaccatgctgtcccgggtggtactttaccagcggcgcgcacagtgtgcccctctctgaagaatgcagccttcctagtgtccaggggtattgcaggcaacaaggacctttcatacagggcagcacaccttgtccctgtaaccactcttcctgaatacggaggacaagttcgctatggactgatccctgaggaattcttccagttctttatcctaaaactggtgtacacaggaccctatgtaactcggaactgggcttactcttgttacgctttatcccaagaaatatatgtgattagctgcagagaccttcactgccttatacagaactaggtgtaaaggtctatggaatcacccaaatatggtccctttgttgccgacttctgcttgctaaactccaatcgaggcaaaaaacagccccaactagaaagaggacgacgcccggtaccaatccaaacacaatcccaggaactgcaactggcaaacgcgcgaacgtccacaccccggcacccgcgttcagacagccgccattcaactctccgaagcgcaacggcacaacaatgacaatggctcacgcaaacaccacaccagcggcacgacccgttagcagcacacaccggcgccacacacaccgctcggaccccaaaaatcgggcagcactgatgcgcccacaggcacacgaaccacacacctgcctcc

SEQ ID NO: 627968 - DNA, 357 bp, Homo sapiens
  misc_feature (101)..(101): n is a, c, g, or t
  misc_feature (241)..(241): n is a, c, g, or t
actctagcaggatctttgttcgttcttcaactgcggtagcataaaaaaggctggtccttgaatagtcctgcatggtacctaaggcaggcccactgctctgntttgatcaacgggaattctgggaaaagctgccttggaggccttgaaataacatagggagcagaaatgagtgctcgagtcgtggctgacacagtctagctcacactgccatcacagaggctgagtgagcagtcacccaggnagggggctcccagctcattccattcccatggggcaagtgactagaaggtaagagcacccgagtaagccggtgccttcctgtatccacacccaggaataccttccagttgtccaagc

SEQ ID NO: 627969 - DNA, 896 bp, Homo sapiens
ggttttctgacatagaccccaggatctgtaattatcttagagaaactgcgggggcttagatggtacttgtagttcattggtttttgtgggttgtttttgcctttctctcttgggggctgaagagctggtgtgtctgtgtgtgtgttcctctagagtgccaaaaaagaaacaaaaaaggtgctgaagagtcctagggagatgaggctattttggttggaagctgatacttctagctgagccacaagtgctgttggaaaggggctaggtggtttccaggggagaactctgcagaggagaggcaaagttcaccaggacaacaaagaagcagcagaaacaagccaggaaaaggaagagcccccaggtttgtgacacaagaaccctccaccagagttctcaaatcccaaaatactctgaaaggtgcaactgtgaggggaacttttcaatgactttttattttgtgaggaccacatgatgagatcactgttgaggaaatgttttaaacacaatgtgatagacagcaaacatgggtctgtggccaaatcccctggaaaaagtggtgaagaggacgtcacaggacgacctagtggcgacgttcagtcccttgagcgtgatttgtggtcatgcctgattatcacgtgtcaggtgtgcatcgtatgttcgcttagtggttacccacaacttgaagaggtcatttgcgagatggtcagatcttaaatggcgtgttgttggggaccaggggggtatggggttttgggattgacacacttgagaggaaaagtgggggcgactgtagaaagtatctgtgaaaaaaaatattagagacggggagagttgaaaaaaaaggggcgggaagggggggggttctgtatcgcggtgtacttcttgtcgtttctaca

SEQ ID NO: 627970 - DNA, 280 bp, Homo sapiens
ccccccccccccttttgggggttccgtttttggggttgggaaccccccccgggggggaaacccccccccctttgggggagccaaaccttccttttataaacccgttacccttttggggggggggggggggggccccttaaaccccccccctttggggaaacaccccggggggggtttttttggcccctttttttttttttaaaaggggccccccgggaggctggaaggaaaccctttttttttggggtttttcccaaaaaaggggggttttttttgggga

SEQ ID NO: 627971 - DNA, 324 bp, Homo sapiens
tttgggccgggtttggaacctttccaactggcccgggccctggcctggttttcaagggtttcctaaacaaaagggcccctggggccggttttgtttttttttccaggggggaaaaaatctagggaaggttttttccccttttgatttttttgggtttgtttaaaaaaggttttgtccaaatcccaaaatttaaaaaaatgccttaaggttgttgcccgggttttttaaaaataattttttttattgtttttgtttgtttgtttttcccctgttaaccggggcccggggattgccgcaaattaaccccccctttgcccccgccca

SEQ ID NO: 627972 - DNA, 302 bp, Homo sapiens
gcacgaggtgaaactatagaacatcaaagataaagagaaaatcttgggttgggtccagtggctgatgcctgtaatcccagcactttgggagactgaggcaggtggattgcttgaggtcgggagttcgagaccagcctggccaacatggtgaagccccatctctgctgaaggatacaaagattagcgaggcatggtggtgggagcctgtaatcccagctactcaggagactgagacacgagaattgcttgaacctgggaggcagaggttgcagggagctgagttcatgccactgtactccaga

SEQ ID NO: 627973 - DNA, 430 bp, Homo sapiens
cacattataagccaatggaattctcctaatactgtactatcaagttgaacaaatgacttagtcttagaaaaaagatgcacttgaaaatacttagatgttgttccgtaatgatccctaagattacaatataaaactaaggaactccatgaaagtagggtggctaggcacagtgactcacacctgtaatcctagcactttgggaggccgaggcgggtggatcacttgaggtcaggagttcgagaccagcctggccaacatggtgaaaccctgtctctactaaaaatacggcatggtggtgcatgcctgtgatcccagctactcgggaggctgaggcaggagaatcacttgaccccgggaggcagaggttgcagtgggcaagatcgcatcattgcactccagcctgggcaacagagtgagattccacctaaag

SEQ ID NO: 627974 - DNA, 333 bp, Homo sapiens
gggtatctgccttgacagtgagatacgcggaggccccggttctctcttccaatcaagagtggcctgggattccttatctggagctcatcattaaaccttttatgttgcaggtaagtaatgcacactgattttaatgaatctctcaaacacctgtgcctattataagctgaaaggaagtttctatagacagacaactgtgagcacgccttcctggagacacggaacactggtattgatcaccacaactaaatgatgccaacgaatgtagtggggacggacggtgacatgctccccggtgaacaagctcccctcgggatacaaggggtacccgca

SEQ ID NO: 627975 - DNA, 1523 bp, Homo sapiens
  misc_feature (195)..(195): n is a, c, g, or t
ggacgcgtgggtcgacccacgcgtgccgaggcgagtccgggacagggggtctcgggcgtcggcgttactgggtttcgctgcgatgcagcgtcccgaccgtgaggagtccatgcatggactcagacgtccttggacgggtcaagtgagacgagtgatgaccgcgggtagccggggcggctgacggaatgcttccgnggaaactagattcgatcgctcaggggactcagactggcgcgctgcaatggcggtgctttgtacagcagcagaatgagggctcgttgaacagggtgtggacaactggacactgtttatattatgcactgatggagtgcataggaacaatgccagctacctgcagggcacagaaattccacggtaaagtgacctcttctttctccacgtactccgatatccacttggcatttatacaggtagcacatcggcatgggtccggcaggccatcgcgtgatgccccctgtgcgagggaccctgtacttggggcaggaaacccaattggagtattctggctgggatgtctgcgaatcgggtgaggccaaattttggatccggaggggccttagtccgggcccctgtggtgaattccataacattcttctaagccgattgggcttccaactggactgggtattcgggttgccctcggcaatccgaatggtccccatttggggacggggatgtccatcggacaacgcaagtggccaaagcgggttctggggatgcgcctgcacacaatggagacctcgaacttccagaatgaggggggccattggcataaaagagaggcaatgggcctaggaggtgatccctgggcatgaatttccgtggcaatggccccctaatgcacaaggcgccaaggggagtcccctctaaaaactgggcctggtttggcataggaaggggcgcaaccattgtgcaatgtccaggaaaggaactaccttatcacccctgggtcacggtgacggcaatggagacgcccaaaaaatcgattggtgggcttgtcgcactggacggcgaaggcccctcaaaacacgcgggccgagcgcaaacccgaagaagagccccctggatagcggatcccaaggtccgaggaacccaccagtagacccggggacaagggaaaacttctagcgacttgcccgccggggcacaaccaataccagggaattgtccccctatcggaggggagaaaaagggaaagaccaagaacgcagtcaaactgggtcccgaagagcggagacacccccctttcggggagcaagcacaccggaaaaattgcgcacagagacagaccacacgcaggtagacaaccccgagcactggggcgccacacaagcgacggacacgaaacccccatccttctggggcaacacgctagtagaacagtgggcgacggcagccacctatcagaggcactgtcaacccaggcaacgacgaagaggtcgagcccctctcagcagccacacataagtcccagcgccagagcaggctaggactactgaagg

SEQ ID NO: 627976 - DNA, 465 bp, Homo sapiens
  misc_feature (451)..(451): n is a, c, g, or t
aaaattatgataaggatgataaaagcccctactttgtgtccggcttttttgggggcccctcttcacatgcattactgcatgcacttcttacaataattctatgagataggtactattatccccatttcttttttaaatgaagaaagtgaagtaggccgggcacggtggctcgcgcctgtggtcccggcactttggggggccggggcgggtggatcgcgaggtcaggagatcggggccgtcctggctaacatggtgaaaccccgtctctgataaggatacgaaagattggctgggcgtggtggcgggcgcctgtggtcccggctactcgggaggctggggcaggagagtggcgtggacccggggggcggagcttgcagtgggctgagtttgcgccgctgcactccagcctgggtgacggagtgagactccatctcaaaaaaataaaaataanaataaaaaaaaatg

SEQ ID NO: 627977 - DNA, 584 bp, Homo sapiens
  misc_feature (43)..(43): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (91)..(91): n is a, c, g, or t
  misc_feature (102)..(102): n is a, c, g, or t
  misc_feature (107)..(107): n is a, c, g, or t
  misc_feature (112)..(112): n is a, c, g, or t
  misc_feature (119)..(119): n is a, c, g, or t
  misc_feature (122)..(122): n is a, c, g, or t
  misc_feature (129)..(129): n is a, c, g, or t
  misc_feature (131)..(131): n is a, c, g, or t
  misc_feature (138)..(141): n is a, c, g, or t
  misc_feature (145)..(147): n is a, c, g, or t
  misc_feature (152)..(152): n is a, c, g, or t
  misc_feature (159)..(159): n is a, c, g, or t
  misc_feature (195)..(196): n is a, c, g, or t
  misc_feature (205)..(206): n is a, c, g, or t
  misc_feature (211)..(215): n is a, c, g, or t
  misc_feature (217)..(217): n is a, c, g, or t
  misc_feature (219)..(219): n is a, c, g, or t
  misc_feature (225)..(225): n is a, c, g, or t
  misc_feature (230)..(230): n is a, c, g, or t
  misc_feature (243)..(244): n is a, c, g, or t
  misc_feature (251)..(251): n is a, c, g, or t
  misc_feature (263)..(263): n is a, c, g, or t
  misc_feature (283)..(284): n is a, c, g, or t
  misc_feature (286)..(286): n is a, c, g, or t
  misc_feature (318)..(318): n is a, c, g, or t
  misc_feature (320)..(320): n is a, c, g, or t
  misc_feature (342)..(342): n is a, c, g, or t
  misc_feature (348)..(348): n is a, c, g, or t
  misc_feature (367)..(367): n is a, c, g, or t
  misc_feature (405)..(405): n is a, c, g, or t
  misc_feature (438)..(438): n is a, c, g, or t
  misc_feature (484)..(484): n is a, c, g, or t
  misc_feature (503)..(503): n is a, c, g, or t
  misc_feature (505)..(505): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (532)..(532): n is a, c, g, or t
agggtacccctctcctctggggactgactcaaacactgatgtngcagtatacaccacatacacagaaaanananaaaaaacattctttttngggagtaaganaaggnggggnttaagangangtttctngnggcttannnnccannnctggnctctttnccccctcccaacccccttgatccctttctctgatcnngggaaaggnnctgcnnnnngncngttgtnttggnctgggaagggttnnaattganagagtgggacgnactcctcaagagtagagctnngngggagattgaaagtggagataatactgctgananctcccttgaagctgagatgggnaatggncatacttagaaatttagtnactttaatagcctggttttccctctccaaaacttttantatggaaaatcccatccccttccttatatagtnacttctacccactaccttctaccattttctactttgggcttaggangatggccattatctacatntnttttcancacctngttngttctaaatnggatctggagacccagcttcttggagattttttaagcaggaagtattaactg

SEQ ID NO: 627978 - DNA, 853 bp, Homo sapiens
gagtaggttccagaaggcggcgcgtgcggtgggaacgcggagcggacggaatcgatccaagggggttccggaccgcgctgtcacatttggagcatggtctacatgagctgaaggagattcggcaagcgagggtccctgagtcgttgggtgaacatcgagtgatgcctgtacagtggctagatccgaaggcttataacgctgtgatcccccacaacacaaggtgctgtaacagtaatcccggtccgtgcattggcgatagtgtccatagaacggggagaataaccagaggaaggccttattgatggatgggcttggcaatgacgtgtcggacctaagaggccctggacgtgggtgcaaattggggcttgattcaccggaaagggcgtgggcatgcttcgtagaagttgctttagaaccctggcttttagagagaaacgcccaaggcgagagcctaatggaggaggggctgaaaaacctagtgggtgtcaaaatttagtccttcgagcttgaaaagaagaggtttgacctagagaactagtggggacgggcccagtgtgcttggagcacgaatggtgaaaattattcaatgtggaaacctcctttttcaaccgattttgccccttaaagtgtgtggtagttcacgaaagtggtgtggtgcagagtgttggattcccacagagtggacctaggtggtactcactaacttcaggtgtgatatcctaaccctaagacggggagaggcatggaagtacagacgcaggctatactgaaagaagaaggctcttttcttggagcccgtgaggacatacagagaaatttaacataaattcccccgggggagctatgaccgacc

SEQ ID NO: 627979 - DNA, 263 bp, Homo sapiens
ggtgtctagaggatcccgaaaacgacatagaggcggaggtgatgagcgagatgggccacgcactccagcatgggtgacagcaagactcagtctcaaaaacaaaaaacaaaacaaaacaaaaaaccctcaagagatcttcatatgaagaccttagcatggccacgcacagtggctcacgcctgtaatcccagcacttggggaggcgaaggcaggtggatcacaaggtcaagagatagagaccatcctggccaacatggcgaaac

SEQ ID NO: 627980 - DNA, 1137 bp, Homo sapiens
tattttatatcttcttcgaaagcacacttatccccaccttggactatcatcacccgatgaggcaaccagccagaacgcctgaacgcaggcacatactatcctattctacacccatagtaggctcccttccccatactcatcgacacataaattatacactcacaacaccactagagactcactaaacattacatactactcactctcattgaccaagcaactatcaaactcctgagccaacaaactataatatgactagacttacacaatagcttttaatagtaaagatacctcttaaacggactaccacattatgactccctaaagacccatgtcagaagccccacatcgctagggtcaactagtacattgaccgaagtactcttaaaacataggcaggctataggtataatacgccatcacacatcatactcaaacccctgacaaaacacataaacctacacccataaccttgaactatacctatgagagccataaattataacaagatccatatgacctacagacaacaggacctacaaatcgctcattgcatactcttccatcagacacatagcccatcgtagataacaaacattctcatccaaaacacctgaagacttcaccggagacaatcatactcatactcgcccacggactataaatcctcattactattctgacctaacacaatcaaaaatagaacgcactcacagagacatcatcatcatctctccaggccttcaaatctaatcccactaataacaaaagacaacatactaaaagacttataaactgcgcatcgaccccaactaatgacctactgggagaacacaccggggcaataccacgaacacacgacaagtatcacagtacaaaggacacacaacaaaccagccattaagatcatataaattttacacacacaaggaagctaacacccccattaacaattatacactaagaaaaaccacatacgttaacattcccatattcaactacacacaaaatcagatctcaaaaaaaaaaatctagcaaaaaacgaacactgacaccatacatctcatagccgcagcatctactacaatacactcccatcatacatcatcaactaacacaactactaaaatacataaa

SEQ ID NO: 627981 - DNA, 449 bp, Homo sapiens
cccccgttccactacgatgaccagccttcatctatttctacttgggtcacgttgcaactcctcctcttcaagatcaggctaggttggccattgtgataggtgtctgctggcggcggctgtcgtatgtgctacgcaggcgcgcgtttctggcgactgttttgcactggagccagcatcaggatttcctctccaatggctgtgctactgcgtggactgtatactcgatttcatgtggtctgtcgacagtaaaacaataatccaaacctcttttctgtatatttgcctgggggaagaacgctgctttagtgtttatttttcaagaacgtttaagaaatatttttacggttgatatgcactaagaaatctctcccagctctcccttttctctttctttccctatacaaattaaaatgcccaccatagagactaagcggccgaaagactaggag

SEQ ID NO: 627982 - DNA, 130 bp, Homo sapiens
tagggtctcaaacacatctttatatacccatgttcataacagtattattcacagtagccaaaaggtgggaacaacccaaatgtccaccaatgggatgaacagaaaatgtgttatatacatacaataaaaa

SEQ ID NO: 627983 - DNA, 1209 bp, Homo sapiens
gcgctaaccggatctgtagtgtgctggctgtacatccaagagaacgatgcatctgatggaggactacgagaatgctggcacagtgagctcgtggagtgagattcggcgtcaccatcccctggttggagggaacggtgatgccccaaaagagtatccagtgagatgcagcagaatgcgtggaggacttccgcgactaccgggcgaggtgcactaatgccgacctaggggtgctgagatagagtgccagtgtggagagtcaagattctaacgcgtctgcagaaccgaagtctgcgcctcagactaactctgtgtcgcgcccgtttcatgaccgctcacgtacggggcaaagacttgtggtcatcgagaatcacttcagagctagagtaggactttgcggcatgttcaccctatgaggaagccaggcgactcgcacgcaaagagggccctcacagatggagtttggcttggtgtagcagagtcgaagtactcccaggaaggagactggtggaagacgggacatcgcaatccagaccttgaggaatgcacggtacagattcccgggccaggaaaggagctcattccctaatgccctagcagaaggtggcgcttgtgaacattgtaggcgggggcaaccggacaagcgcaattgaccttgtagaaggcaaccccgggggaagctaacaagaggaaaacgggggccaccaaacgtgaattccgcgtaatccactccaaaagagggctcctcctgctagtttcgggcggggaaggaccaagccgcacaggcctccggttaccgccaaggaacagccggaacgccttgggggtgtttggaagacagagccctaagctgtaagcacccggacttggtttgggcaaggcccaaggcattcagggcacaggaacaccaatttggcccgacgcccaatgagtgagggcgttggccataacgaggagctcgtggaggtactcctcaaacttgaacggcaacttttcccccttttggagaagtggtttccacaaacacaaaccgctgaggatgggtcgcgcactgcaaacagcaactaccgtggaatggaagccacaaagcgctggtgggcggttaaccccgagcccctcttcgcgggtgggtgaactccccttggggaacgaccaaattaaaggtttaccggccaaggaggtgggacaggctcgctttgtgcgaaagaacaa

SEQ ID NO: 627984 - DNA, 356 bp, Homo sapiens
  misc_feature (9)..(9): n is a, c, g, or t
  misc_feature (212)..(212): n is a, c, g, or t
tttgaactncctgacctcaaatgatccgcccacttcagcctcccaaaagtgctgggattacaggcgtgatccaccgacccagctaatttttgtatttttagtagagacagggtttcactatgttggccaggctggtttcaaactcctgacatccggtgatctgcccgcctcggcctcccaaagtgctgggatgtcagtgtgcgcccccggcncagccagctgctcttagtttacattccccactacggtgcgttaagagtttccctttttcttccattattccttcggccaggcacttgtttatttttttgttctttcttcactgtgggtttttgatttggcattttctctttatt

SEQ ID NO: 627985 - DNA, 632 bp, Homo sapiens
  misc_feature (469)..(469): n is a, c, g, or t
  misc_feature (569)..(569): n is a, c, g, or t
  misc_feature (582)..(582): n is a, c, g, or t
  misc_feature (591)..(591): n is a, c, g, or t
cgttactagcagtcacttatctccgtggctttggtttaaagaccacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggaagatggggacagaggctggaagtcaaaacactctgtaattttgtattcttgaatgttctttggttaagagctgcgtgaaagaaattatttttttttcctttttataaataagggaataaaacccccaccttttattcccttcattttcatctacccattttcttggttctttgtgttggnctgtggcagagccaagctgtggtgtttcttttgcccactgacaacttcttaaattgccacatgtacagtgatgttcaaaagtcaaaataactcctccatntgtaaacaaactngtgtaactngcccaaaagcagcaccttataaatcacgcctaacactaaga

SEQ ID NO: 627986 - DNA, 253 bp, Homo sapiens
  misc_feature (5)..(5): n is a, c, g, or t
ctggngctgaaaaaagagggagcagtagcttgagatagatacaggtcaaatggaggtttattccttagtttcttctattctatcctatccttcctatcacatggaagatgaggtgcaaacacgacaacagggaatacggttaaagggtaacaagacgaggtactacatcgatagaccaaggtcccagatgaattgcctggagtaggggcaggagacgatgggctcaataggtagagtgagtcaacgagtgtaa

SEQ ID NO: 627987 - DNA, 313 bp, Homo sapiens
  misc_feature (274)..(274): n is a, c, g, or t
ttttgctctgtagcagtgcagtggcccgatctcggctcactgcaacctctacctcccgggttcaagtgattctcccacctcagcctcccgagtagctgagattacaggcacacccagctaattctttttgaatttttagtagagacagggttttaccatgttggccaggctggttttgaactcctgacctcaagtgatctgcctgcctcggcctcccaaactgctaggattacaggtgtgagccactgagtccagccataagattacttttttngtttgttttagagtaattatccctacttaaagacagatt

SEQ ID NO: 627988 - DNA, 1190 bp, Homo sapiens
gtatatatttgtgaaactttcttatttaaattcttgatttggggttttttttatgtcaaagttgctggatgtacatcttttgtcgtggatgctattagttgtatgaaaattgtgtctcttaaatgatgtgttgttctttaatgtgtgacgataatctttattattgtgggggtaagtgataatattgtacaaaacttgttgtttacattgggggtaatgtgtaagaatttaggttttttaagtcatcaattgcgctgaaaatgtttgtgggttatactttttgtgtggccgattataattgcggtgttttacctctagggttgttatttccctgtaagtgaccgatttggaagcgaaataattgtctgtataatgggttgtccaagtgtacgttatgaatacccttttggggtatccgtggcctgaacaacctcgcatcgttgtcaagtgataatgttactttagacgttgccattcaggaagttaaagaggcaacattggagacctacagggcaccatgcgagtcctcaatgtctctgtatctcaacagtgttctgctgagtatagggtctacattctcagattcacatccattgatcttcgttatcgaagcaagaggatatcatattaatatagtcgttcctgtgcctgagaatctctccacgttattcgtttcttgtatcgagttctgcatccagttcactgggtttattctactgagttccatagttattctcttttaacaagaagtcatatttataatatgaactttacgaatgtcttgaatgtgttccgtggccttgagtcacagaagtaatatgtgttcagatggctgcccaatatgtagttatcatgtaatacatatgctgtgtccttttctgggatgaggaaggcttcaacttctggcacgtgagaactttgtattacacgatcacaggtttagtttctagcctagtcatgcctttagagttttaaatagcacaaactccatgcaacccaacagaatatcagtggtgagggcatagtatgtagaatgttgaaagtagttcaaattgtgaattagaagaatgaagataggacttaatttggaaaaggagatagaaatgagaatgatcagaaactgtggggccttagttacctatgcagtaagtaatcttcttcatgatatatagacttgaggtatgtgcaga

SEQ ID NO: 627989 - DNA, 149 bp, Homo sapiens
agatactggtgatgtctaagctcctaactccagctttttcctctccttctgagctccactagcacgcacccaagtgcctcaaagatacctcaagggctgggtgcaggggctgacacctgtaatcccagcactttgggaggacaagggga

SEQ ID NO: 627990 - DNA, 688 bp, Homo sapiens
  misc_feature (453)..(453): n is a, c, g, or t
  misc_feature (500)..(500): n is a, c, g, or t
cttatgactgcacgagctcacatctagcgactgttcttatttgctgtgccaggtaccaattatagcccctacgggccagggcgagactctattcaagatttatggtatggcacagcgtcagttgagggcctggaccaatacttgacgcgtgagctataaatgtctctggatctacatggggcccactgagagcaccgtgaagaccgctgctgagaaggcaaagtactccttcacggatgccgtggccgtggataaactgagagctgcgcgagatcgacggatcaccattgatatctccttgtggaaatctgatatcagccagtactatctgactattattgatgccccaggacacagagactttatcaaaaacacgactacagggacatcacaggctgactgtgctgacctgattgctgctgccggtagcggagcaattgaagttggtatctncaagaatgggcagacccgagagcatgcccttctggcttacacactgngtgtgaaacaactaattgtcggtgttaacaaaatggatttcactgagccaccctacagccagaagagatatgaggaaattgttaaggacgtcagcacttacattgttggctacaaccccgacacaggagcatttgtgcccaattctggtttgaatggtgacaacatgctggagcccagtgctctggct

SEQ ID NO: 627991 - DNA, 908 bp, Homo sapiens
gtaccttacgtcatggtgagggaagagagagcgcttctctttggcccgcccaggctcaggatgtgcagcctactgctggccatgcctaactatagtcacgtagagacctagcaatgttgactaacgtgacctaggaagagagattctatgcacccatgcgttgtccactgctgacaatcgcagatgtgactcagattcccagtgtaaaattctatgaacggtaggaagcaccaacggggtctggaggctggagtccctggtgcctctgcgcagattccggttgagaggaatctggtacattctagtgctaccataagccaacatcttccagcaggagtcaccaagcatagcactgtacagcgttctgacggtcctaagacgagcaggtcagtcacaatagctggacccagagtttaatgagcagtgactaatttcatgtttccaatgtgcctgatttgtcatgagccttacagacacacagagacccatacagcattgatcttagaatatttcgtcagtctctgatatgcaaaggagcacactgtctctggttcaggagtatctagaatatgttccaccaatgtactcgcagacctagagatgatgctgcgtgtttagggcggccgtcttagggagggctatgcaaacaactcctggattgaaactacgatgacattagagagttcaatcgcggctcctgaaaattaccgagtgaccgtgagtacctagttcatcagcgtcagtaaggcaaccaggaactggagggactctttggctaccgactaaccattaacattggggtctgttctggacattatggacccgggagtttacccctgggccggaattcgcgcgtcgacgcccctggcgaatctttaagaccccacacgcggcgttcacgcccacta

SEQ ID NO: 627992 - DNA, 420 bp, Homo sapiens
  misc_feature (10)..(10): n is a, c, g, or t
ggtgagtacngctttataatttttgtatcacagttttatttttttaagctagctggaaggtgacagtgattgaaatgagcagttttcaaagcttggatcagaaccttaagatgacagttactgcctgataattccctatgtttcctatttagattctttttttttccccttactttcctaaagtaccgtatgcacataaacattgaacacagattatttcctttggtgaggaaaaataattgttaataattattaaaattataaaaattgttagaaacgggagagatggcttcatagttaagaccatgtcatattccaggtgtggtagcacacactctggagacagaggcaagtggatctcttagttcccagtacaaccagggttgcgtgaaggagtcgtgtcccccccctacccccagc

SEQ ID NO: 627993 - DNA, 359 bp, Homo sapiens
ctctagaggatcttatgcgcggtctgaactggggataaaggagaactgggtccagcgggctggtcggacccaaaggagagtctggcagtcgaggggagctgggccccaaaggcacccagtgtcccaacgtgcaccagcggtggttcatgggtgtccccgtggccccccgtgtccttctgggcctgcaggggcgtcccggggtgttccctggcatcactggggaagccggggagttcccggggacaggaggccagctgagcagcgcatcacggcagctagtgtgcgggcggatgcatcagccgaacaaatttgcacatgttcacgaccgggggtaccggaagctcgacattcggtaatca

SEQ ID NO: 627994 - DNA, 494 bp, Homo sapiens
  misc_feature (264)..(264): n is a, c, g, or t
  misc_feature (425)..(425): n is a, c, g, or t
tgattaatagtatacttgtgctaagaagtatagcttgttgatggagctataatgattgttattcctaaagtaaagaagtcgattagatagttactttatatgaattttgttcttcattctaatgatgtcgtggattgggctggtaggatgctgggtctccatgtcagtgggagtctgagaggttaccttatcggctctagcattagtttttattccttcactcgccgttacgaatgccgcctgctgagtatgtgcgtttcccgnctgcgagttcagcatatagccggtatagctatgggaactggttctgaatccacgcgattgcgctgaatgggttcctcatgttggcccgcaattatccgctacagatttggagtctgtttgccttgtgccacatctccgatattccgctggttgaagaccangggtctgtagcccgttagtctatgcctaagaccgaggggcacagtgggcttactgtgtccggtacaggc

SEQ ID NO: 627995 - DNA, 356 bp, Homo sapiens
  misc_feature (153)..(153): n is a, c, g, or t
ttttgtagagacagagttttgccatgttgcccaggctagtaaaatatttctataggggtgatgtggggtgcaggagattgtggagaatagagggaagtaaacattagacaagcaccacgagagggaaatgtgcttgccagctggcgccgctanaaatcccatcttagaagtaatcagggagtaatcagatgttcagaccaagagtctgctgagtgtcttgtgactatatcaatgttttctcagaatcaaagggatctgcttctcttcacaagcctccgctcccctcagaggccaagcttgagaagttttgaaagtttggcatgattccccttattctgcttttccctgtcagtaac

SEQ ID NO: 627996 - DNA, 198 bp, Homo sapiens
gggtggtttgcagcggacacccagaggtgatatcaaggcctacccgacaacagaggagactgcacggcagacagcgtggggcaactgtaaatggggacagtggccaacaccgatgcaggcagcatccccaaagtccagggttcaagcccatcctggcccagcagcaagcccagctccccactcccaccaccacaccct

SEQ ID NO: 627997 - DNA, 170 bp, Homo sapiens
  misc_feature (17)..(17): n is a, c, g, or t
gcgtacgaagggcgcanccagtaggagcggtgcattcccgccttgcaggaggcttcggggctggtctggaaagaggactttactgtcggttactcgcctgagcgcatcaatcccggggatcgtactcacacgctttgcacaatcgtcaaagtcgtgtccggcgacggtcc

SEQ ID NO: 627998 - DNA, 403 bp, Homo sapiens
cgaaaacgctaggaagtgtttctaaaggcataaaacaatcttagagcgaaagcgtataatcactgcgcacgtcttcataaggggatagccatggctaggtttggagatagtaagggtggttggtgtaaatagagtgaggcaggagtccgaggaggtaagggcacagtttggactaccaaacagtgccccaggcagttgagcttaaagttaccgcgagctggatgcctaaagaaaggtaacatatagtataagatatataataaatatccctatattttgaaaccagaaataactagcacctcaaaagtaacccattatcagtaactcaaaggaaacacttcatcaggcaagtaatttcccttacttatataggatataacttccctaataaaacacctacgaa

SEQ ID NO: 627999 - DNA, 859 bp, Homo sapiens
agcgtgggggtccgctggcgagggagcgggggcggggaggcgcctgtctggctcagtgctggggcctggcgggagcgcgaacgagcgacggcgtgaacccgtgggcctgtgtgactgcagcctcggaggtcagcagatggcagtttacgctcttgtttgcccaggctggagtgtagtagcatgatctcggctcactgcaacctctgcctcctgagttcaagtgattctcctgcctcagtctcccgagtatctgggattacaggaagtttatctcgacaatgctagttgcagtctgtgtgacccttgagcaaggttatctataatgtctgtgctgcaggttttatcagtttccaagatggaatagtatatagtgcatatcttcctcatggttgtgagggagtgcatgacaccatagcgagtgctcagttgaacagtcattttctgagtgcttgtgcacttcaccgtattcattgctgaactcgtacaacgagacacttggatggtggattaaccagaacacttagcattctgtgaaaagtttcacaattggagaatattcgcattttcagccgtagtccagcagctccgcatgctcaactttacatacaagatgcgtgaagaccccattcggaaaagacatctggacagctggtccacgagcttgatgcagggccatgctggacagtattctggacgaacattgattgaacgaatgatggaacatgcccacaaagaaaacatcgggagccagtgtggggtccgaggacaaaccttgattacccaagctccgggcgggaacattcgcagagctgcacggatgccagcatggctggaaagaaggggactgggcctgttaccc

SEQ ID NO: 628000 - DNA, 172 bp, Homo sapiens
gcgaggggtgtagtagcccgtaggggctacaagtgggggccttgcgtagttgtatatagcctagaatttttcgttcggtaagcattaggaatgccatggcgattagaatgggtacaatgaggagtaggaggttggcatgagatgttagaaggaggtatgagatgttggaagg

SEQ ID NO: 628001 - DNA, 137 bp, Homo sapiens
  misc_feature (99)..(99): n is a, c, g, or t
agcttcggacccactgcaggtgtactgatcattctatttccccctctatgatccccacctccaaatattttattaaacaaccttgccgtggagtacaanctgccggtggagtacaacctgcctggtggggggatcct

SEQ ID NO: 628002 - DNA, 403 bp, Homo sapiens
ccgctttggactgtgagctgaggctgtcccaggggaggatggtggccacgtactaagatcttggctctccagcccgtgtttcctaaggactccgcagacaaggctttcacctgcgtgttcatctgtgggtcatcgaggctggagcagttcctgctgagtcaggctctgtcctagagtgggcagtcctgatgcagggctcagcaggagcctagtgcagggtgaacacgaagctgcttgagcagcaggaggtggctggaccatcgtacccacgtaacctgcccaggacgatgcctcgctggggctgagacttttttaatccttgtgtaaagaagcgagatcgaggcagagaaacgtaatttgtccatcacatggggtttggaaataaatatattatttgtacaat

SEQ ID NO: 628003 - DNA, 202 bp, Homo sapiens
gagaaatcccactgcataataaacccagagcatctcgaaggcacgcgctggctaaggactcgacttgatatctacccaatgctttcaatgtcaaactatagaaatgcgaagaagccccactaaatgggcggagcacctattgctctgcttgagctatgcaaatgcctaggcagctaattacagacgcgcatgagttgatgaa

SEQ ID NO: 628004 - DNA, 1042 bp, Homo sapiens
agcggaggtgcgaccgcggtggttcctgtactaacacgtgggcgctgcccagggaccgactgtggcgctaggaatactgcgggacgcccagggtcatgtctgaccagaggaggtggcaaggtaatccgactaacaaccagtgtccaagattcgtgtcgaggtcaaatccatgtgcggctgtccttcgtgggtagtagatgcctcagttatttctatttatttacagcagaaagtgaatgtgactagtatggcagtataagagctgaaacgtaggcttctagctgcgatggcatgttaaagtacctccagaagtggcgtggaagcgtgtgtattaagtggatgtcaagacaggaacaagtaataagatggttaacttggaggtcaggcccaatatgaatagagacaagtgttatgagcagatggccttcctttacgtggatcgtgagtggatttgggaagacagtcgcgtcttattacacacgaatggaaatattgagaagattccaaaagggagaagttaaatggacttatagtgctctgcgagaagttaacttctctttggaggatggtaagatcagggcgtgcaataatccacagatacagaagtggagaggaaagaatacaaaaaatggatctagattaatgctgaaaggcagtaagataatcgcaaaaaacttgtggaaagcgaagatgacctatgatctgaatgtttgcatgctggaagttaaacttgatgggaaatcggtgatcgaggatagccggggaactggaatcatacaggccgtatgcaaaattactttacaagatgatctaacctcccagggttacgcgaaagttgggaacttaatcgggaacattataatcccatccggcgtagagccgagctcattcaatagaaacacccgcagaaagaacaacaagtgtaacgcagagatgacggaggaatgaacggcaggagagaactacggcgagacaagcgaactagaagaacagagtgagagaacgagaagcagaggacgcgcaacaaacaaaacacgaacca

SEQ ID NO: 628005 - DNA, 377 bp, Homo sapiens
gaaccagctgcgacacattcgacgttgggtccagcatttgccatggaacaggcatgcccggacccgtatgctctataggatgaagttctcatcttcaaatttcaccccatagatggacttgcaaacagtgccattatggcgtgtgaagtcacccccctgcacacataaaccctggcaatattctgtgcaagcaggacacccttataaccaaatcctttctctcccgtgctcagcacacgaaaattttctgctgtcatttgggaccattgtctgcaaacagcgtcaaaggagacgcggcccaagggctcgccgtcgcacggcactgtcgaagcacacggtggcgttcgctctgacagaactaaccccatcgccctgta

SEQ ID NO: 628006 - DNA, 254 bp, Homo sapiens
  misc_feature (83)..(83): n is a, c, g, or t
ccaaaaaagggggtttatccccgggtttttttttttgggcccccccaaaattcccccccccctttccggtttttttttggggngggggttggggccccgggggctctaaaaggggcccccaaaatcccccccccccggttttttttttttgggggttgggcccctttttggaaaaaaattttttcccggggggcccggccttttctttgttttttggtttaatttttttaattttttttcccccggggggggga

SEQ ID NO: 628007 - DNA, 278 bp, Homo sapiens
gccctgtcaaggtgtgtgagatctttgcatacagggcagacgctgcaccacgtttgcatgtaagctgacgcttggggatataagatacagtacgttctcggaaaccctgatcgacttaaggatctatttgaatgaaagtgtagatataacatacgctaatattaagaatatgaggaaatatcaataagatactaaatacctgaaaccttgcatctatcaagccacagctcactgcacgagcatgaagagctatgtaatctaattgtaaatatttacaa

SEQ ID NO: 628008 - DNA, 365 bp, Homo sapiens
aaagcaagccctctctccagtggaagccttctcacatctcagatatggggtcagcatccctcaaccggggccaggaacacatggaagccttaattgcaacatagtcacgcaggaattatggaatggtccaatgttgaaagatgtttctcatcaacattctctccattcatcaccttggtggccacatcaatgaagtcaaccccaagatgtcttggaaccaaaggggaaggttcgagaagctctcaagttacactcattcaccaagacatcatttcctttgcacaagaaattgcacgttgaatggcaatggccccgtggctgatggtgtgtgtggacagcatcagagtggcatctccagagtgcac

SEQ ID NO: 628009 - DNA, 101 bp, Homo sapiens
tcgccgattcagacgggtgtagacgggtgctttcctaccacggtagagttcaactccaagactgaagtacacaaagaggggtgtgagtgggatgcttgggc

SEQ ID NO: 628010 - DNA, 243 bp, Homo sapiens
taaaatgaataggatactagtataagagatcaggtcgcccttagtgttgtgtatggtatcatttgttttgaggttaggtagattacgtcatatgttgtggtggtgattaggtcggttgttgatgagatatttggaggtggggatcaatcagagggggaaatagcaaactttggaactccagggtaacttgcgggccgggttagggcctagcatttgtgggggcaatgaatgaagcgaaacagt

SEQ ID NO: 628011 - DNA, 111 bp, Homo sapiens
gcctggcaaaggagtaccggtacatgggtgcccatgccggggctgcttgcagagaacacaggagaggccatgcagaatcagtgccagcactcggttcattagcaccaggaa

SEQ ID NO: 628012 - DNA, 530 bp, Homo sapiens
gaagacagggtcgagaactataccgggtgcctgacaatgagcaccttgatacaggttctacagcaccacaggctacggtggtgcatgctctgacatcacgcattttggtctgtgtaagatcctctccttatggcgtgacattgtctccgagggagaaaggtgtagcagatacgatgactaaggcagggcccctggaatctcctcccttagcctcctctgctgggaagctagcacacctgaatcagctggagatactgctggagtccagtgctttctttccgtcaccctggggatagtccttcttgggatcgtggtggcggaggagcctctggcttcccgtaaactgcagtctctctggactggtcttcactttcctcagttgatataaaactctgggtcttggccatgatgtccttggattccatcgctgaagggaccatctgctgcagttaccacagcaactgacctgagcggccccctggtctgtggagatggactcaggatccagtgacatgattctgaacttttgt

SEQ ID NO: 628013 - DNA, 123 bp, Homo sapiens
aggatgtggcagcggaaggactgtggtagcggaacagcggaaggactgtggccagtggaacagtaggcaagggagagaactgaggcaacggaggactgtgggcagcggaaggactgtggccag

SEQ ID NO: 628014 - DNA, 268 bp, Homo sapiens
gtaccctcgaagtctcgaggaggctgtgtcctgaaagggtggattcaataaactccgatagcccgaagtacttcttattttcatgatatgagtccactccattactgcaggaggcagtccagaggatctcgttgctgtgactgatgagggggtgctggctctgcagtgcatacggacagcaggtcacgtgaagcgtcacattgctggcttcctccttcacctgcctgcagtagagcaatcgacacaccaatctcaccgacggcacact

SEQ ID NO: 628015 - DNA, 882 bp, Homo sapiens
  misc_feature (369)..(369): n is a, c, g, or t
aagtgggtcttacagggttgactgctgatgtggaaattgtttgtggacttcaccgttactctgacaagcacaactgtccgtatgattacagaagcagaagctgcagcaaacatcagaaaagagaatccagttgttgtggctgaaaaagattcagagaatataaattacttctgtgtgaagagactgaaacttgtttttattttaatatatcgtaggaaaacattaaagagcagatgcatggccatttttctttgatgttctccgagagttttacattacacttgtctgtcttataattgatattttaggatgtcgggtgttgttacaaggcagaattggaatagaatagaggcctacaaatgtatatgngcactcgccctgaacaaaaattggatgagaacttctgtagcagcacgagtgaaacacacagataataggaacaaaatgtagttcccatgtggcaaacaaaataaatgagatctctgcatgtttgaagaatatctgcctttggggaatgtaatcaaggctataatctttggctagtgttaatgtgctggatttgtttaaacagtggtagcaacgagaagaggactggcagtctacttctaacatagttaaattcacctcttaatgttacaacatatgcttggaagcaggaagaaatggtccataaggaggtcagacctattttcgtgaaacagtattggggcattttaagctggtaactgggccattaaggtgaatagacttgtgaaggtacgttgcactggtactagtaacatatagcacaaaggtggaaaactggagttgatggggacaaatttagtcacggaagttacacagcagtatattaaaaaaccagtgttcacacgtcaaaccgac

SEQ ID NO: 628016 - DNA, 796 bp, Homo sapiens
catagaattgtgtaacagagtatcatgagcgattgtgctcacttagacctgaatatacaacattatgggtctatctcattaatactatatgggaccacgatcgctagagggttttatgtgagtggattctagtttgaacacctaacaagtaaaacatgaaagtactagcttgcaacattagtgcaaaatcaggtatagagtatctgcatcagcaagaatgattcggggggttcagtaggaaagtgttagtaaattatacttcggtagaaattgagatttgattgattctttttatttccaataagatcggtcttagaaggttataagtatagtaaataagtgggctctcttagggttatcaatgatgagagtacggtattaccgaagattagaagcgtaattgttacctaagacaaggcaaaattgaaaacgaaacaaacaaagatataacacatacatgaaagactgtgtgcgtgccagggacactatacggccctgtttgtacacaaggcaattatatgaaaataaactaacagaatgagtgcagcaagggggtctctgtcccgtcagacgagggccacaggggacacgccagctcatgcctccacacatccggagaagtcgcgggcgtgacgggatacgcacacccgcggaaatgcaccccacggccagtgtacctaccgggggggaacccctgcccgtgttgcgtgccaactgccgaagagatgctcgcggcgtgctacccgggcctgatacaaggtactcgcggcgactgtctctccaatagccccgccgg

SEQ ID NO: 628017 - DNA, 513 bp, Homo sapiens
tcctggtgtttccctctgctgttttgcgatgaggggaccatattcagtgacttctgcacttcagtgctgtctcaacgtttgagttaaaactgggatctgactaaagcttaagagaaaagggttggctgtttgccctccaaatggtcctttctcagaaggggcagctaacccggtgcagaaccagcacttaaggtggacagcagacaagagggcaggcctctagtgtcccaagtgcttcctacaaagacgcaaggtgtgctctgagccacagatggggcaaaaccctggtgctttccttcatctcccacgaactcaagggtttccaggtgtaagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcag

SEQ ID NO: 628018 - DNA, 520 bp, Homo sapiens
gctcttaccagctgcattctctgatgcctgttgtaccaccagttgcccagctactgatggaacggagacaatatatctggggcctgctggtactttatgcacgcctatcgctgattgattgactccacgcagatgatattcatagagggaacgactggcctatctgtctgactcatgcatttctataccagcctgcacatctacccatcgagtgaagctgcacgcatggacactgtccgtaagggtcatgaagttcaacgggaaaggctattgcaacgagaagtcaagcgaaagtttgatagtgcgccactataggggagaaagatagctatcggttgaaggctgtttccatgctgaacatgatttataatcgagctcacgagctgaacatcttttatctcttatttgagtgcctttagagatctctggtttccccctgtatatactgcatgtgtagtccaatttgtaagaagacttcttgttattctactttattaactatgtagcagagagtaaaaag

SEQ ID NO: 628019 - DNA, 354 bp, Homo sapiens
agacatgccgcacacataccccagacacatacacacaacacacacaggagaacccacagatattccacactagatacacaccagacaaaccctacacacaaacatcacacacaacacacccctcagaaaaaccacacaccatacacacacaaacacaaacatgacatactccacacacattacaacaaacacacgtacacactccccaggtaagggccctctcaagcaccctaaggacagtgcgttgatccccaggccagtcagcccagcgggaagagctgagaagggaccagaggccagtgagggaggaaagacccacagtcctgcagggcgcagagaacccctaagggctgg

SEQ ID NO: 628020 - DNA, 126 bp, Homo sapiens
tgattgcatgagactgcttccattatatgacctaaaatggtatatatcgggatcgcgattaatcttatcttagtggggctgttctatgaagtatctaattgcaatcagtctaaatgcgatcagggc

SEQ ID NO: 628021 - DNA, 754 bp, Homo sapiens
gcgaggcgggaccggcgcgcgctctcgtcggccccgctgtcccggcggcgccaaccgaagcgccgccgcctgctccgtgtccgaccatgctgcgccgggctcgtgctgtgcctggccgtggcgccctggtgcgcgcctgagcccccgaggaggaggaccgaggtcctggtgctgaggaaaagcaacttctcggaggcgctgggggcccacaagtacctgctggtggagttctatgccccttggtgtgggcactgcaaggctctggcccctgagtatgccaaagccgctgggaacgctgaaggcagcaaggttccgagatcacggttgggcgaaggtggactgccacggaggagtctgagctggacccagcaggtacggcgtggcgcggttatcccaacatcaggttcttcaggaatggagactcggcttagccccaaggaataatacaggtgtggagagaggctgatgacatcgtgaactggctgaacgaagcgcaacgggcccggttgcacatcgactctgctgagcggcgcagctgcacgagtccttggtggagtccatcggatgtgggtgtcatcggcttcttcaaggacgtggagtcggactctgcaagcagtttttgcaggcagcagaggccatcgatgacataccatttgggatcacttccaacagtgacgtgttctcaaaatacagctcggacaagaatggggttggcctcttaaaagttgatgaaggccggaaccacttttcacgg

SEQ ID NO: 628022 - DNA, 860 bp, Homo sapiens
agcggataggctttggagagcactctctgtcctgatcttttcagttgagagacttcagctgttcattgctcatttggacttagttcaacgaattttatgggtgtctaccagtgtaaagcgagagccctcagcatctgaatagaaactgaacaggaacacgaagatgattacactacatctgagatggatgacctttcctctgctgctgctcagcctggtgcctggttctatgcatgatagcagtcgagaaagcagcaagtgaacgatacattaagagaacgaactttagcagacgaacgagatgcaatagtgacatggcgaaaaatgtgtgcaagaaaaagcagagcagttgaagatattaagtgaaccgcgatcctgttagttaaaaataccagactcagcatgtccaaggatgatatgtcttccaaattactgacattcagaagtttacattaataatgaccccaagggaaacagatcgggtaactgacaaacgactgttgcaattgacatgacagtactggagaaaagtttcagaagcaaaacgggatcgtgacaagtgtgcgcaatacacttcatccgcgaggatccacggaatgtgactgcgcagcggctccaccaggggccccccaagctgccaagtctgtagcagaatcctgggcataaagctggctgtgaccacgcctaagaaactgtgaacaatacagttgtgccagttcagctaacagtgcaacaacagattgcgcactagtgttgccaataagcgatagtgttgcaccttcattaagagactgatattcggacagtggctggcagggtccatagctctgcattgagcttggtcagatgggggcgtctaa

SEQ ID NO: 628023 - DNA, 333 bp, Homo sapiens
cgtgtgggccacctaccaccgggtcttcgataaagtggagctgatgctgtccgagaaattgaggccgcggtgcacccattcagcaagtgccagaacaggtttcttctgggcttcaattatgaaatgggggttggtgtgtgctggattggctgatatggccagacctggagaaaaacttatacacagctcaatctggtgttttgatggctacagggtttatttggtcaagatactcacttgtgattattccctttttcggatttggagatattacccagaacttaaagcttaagcacacaaattgaggtcctgatcacctgaactctagtgtgg

SEQ ID NO: 628024 - DNA, 284 bp, Homo sapiens
cacgaggcgatggaccaatgcacgtatcccagtctcgtttgaataaatgcgaaaactatgaaaacttcatttctgattctgcatggaaaccgtgaagcttaacagaccactaactgccaaggcgtgtggcacagatgtcacagatccaaactggattacaagggagattgagatatatacctacaggcacacataaatactttgcgaccgcacatatggatcatgcagtactacagaaacatgacatccatgtaaaatctaaccttaagctttttcactcatga

SEQ ID NO: 628025 - DNA, 362 bp, Homo sapiens
tatcatatttcctatattaggaaaatcaaacacaccttcccttgacttgtaaacaaaaataacgtccagggccaggtgtggtggctcacacctgtaatcccagcactttgggaggctgaggtgggcagatcacctgaagtcaggagtttgagaccagcctggccaatatggtgaaaccccgtctctactaaaaatacaaaaattaggctgggtgtggtggtgcacgcctgttatcccaactactgtatgggaggctgaggcttgagaatcacttgaacccaggaggtggaggttacagttagctgagattatgtcactgcactccagcctgggtggcagagcaagactcttgtctcgaggaa

SEQ ID NO: 628026 - DNA, 199 bp, Homo sapiens
tagcaggatcccccccaatagtcgggactgccatctttcttctccaaatgtcacaatgtccacaaaaaatagtcttaagaaatgtccgcgccactgtccattggtgtggggtacgaaacctatgtctacatatcactggcatggaatccatgtgcacacgaaccctgtctgtggaagtatataaatcacacggactact

SEQ ID NO: 628027 - DNA, 822 bp, Homo sapiens
ttcacgactcacgcgtgggagactgggctgtggggtaccggcccggagagcacgcagtctccacagccgccttcctcagggaaatagcgtgaccttactgccctccgtctacagggccttgtacctctccaggccgatatatccacaatttaaatcccagttcagctggtatccagctccagcaagctttagagcgttcacgtacacgccgggcgccaggcgtcggcttgtataacctgaaaatcgcgtcctgtttttcctcatctgtgcagatgggttttgcttcccaccatgtgcatcacaccagtttcggttatcttaaatttggtacctgcctagacaaacagtatactcatacctaaagagattaatatgcacgatctggcaggaggacggaaattaagctggagaccaaataacttgccaacctacagtcgcgtctctcagtcagatgcctaagcagacagacgtgacagagtggacttacctgggatgaagatgcaacccaaccaggtcaaagatccgaccggagggcatgggcatgtgacaaaccacaacaaaacaactctggacaacaacggaaaccaggactacgtgataagggacattggacaccacactattaatgaaaaactccagcaaacactgaacatcaagaagaagaagaaccatggaactaaggcaatcccagatggggagcaaaggaatactcagctacgaatacgcaaactacacacagatcatgcctttaaaaccgcaagcaacacgacatcaagggacgaacatccctgcgacagaaacatcacaagccagtgacaacca

SEQ ID NO: 628028 - DNA, 743 bp, Homo sapiens
actttctggtaaacttacagtaccgccgtctctaccgaagcatgaactcccagtatctgaagctgtatagtcacagaaataccagatcctatgatataatggagatgtagacatgtgctgcaatttcatggcgggatgagtggttggtggattccctcaagcagaagatggcaggtgcagcgccggacctggtttagtgaacgtagggggcacccgcggggagcaggatctgccggctctcgtgaaaggagttctcccacatcgcctttctcacggatcaagggcgccggccacaataggtacccagccgagaaaagcacccttcagctgtcattcatgcatgttctcccgtcttcctgagacaaagcagcacaagtacgtgatgaccacatgcaacccagattccacgtggccgtgattgcagtccgcctgcccagtcctctcccgctagggagaagtcgctcttctaagcaaagtgcccctgaaggcccgggttctgccgccaggaactgcccccttcccagagccctgtacaatcccagactggcccagggtctccatagacagctgggggaaagttagcactttattcccgaagcagttccttgaatggggtggctggcccattcctctgcttaaagaatgccttatgatgactgatccatcccaggaaccaaagagtcaggacagccaagggagtggtgacggtggactgataaatgtatggaataatgggtaagtcc

SEQ ID NO: 628029 - DNA, 130 bp, Homo sapiens
tggctatcagtttgatatcttgctgtcaagtttgttttaccattaacatttattgatgggatggataaatacagattgagaaacatacttgacagcaagatatcaaactgtatttatccatcccatcaat

SEQ ID NO: 628030 - DNA, 132 bp, Homo sapiens
agacaaggagagtccctgaggactggtgaagcaacatgagcagagagtggagagtcaatcgagtgacagcggtgagtcaggtggtgactccctgggtgcctggacactgagctcccgctgaagtgtgggctt

SEQ ID NO: 628031 - DNA, 985 bp, Homo sapiens
tcggggcttgtcgaggatccagctgagctgatcgaactccgatagctatactctaatcgcgcggtgcctctttagggtgcaggagaaatcaagactttcacagcatgtgtttgcacccatggcaccgttatctcatattctgctcagagctaggactatttttactatgtagacctatctgatgagtgctcactaactatgtgcttccgtaccatgtcccactcgggtctaagtgggcaagtttagttcacatctcaacagtcacgatacacgtacacattggactctagcatagattctctttcacacgatttcctttgaggcacgactctgtcattctagctagataaactagcaaaggcttctctcaccaatgaggtggcatatactattcgcaaatccgcgtagggcgcacgtgcgaatgcttagacaagctaactgtgtatgtgaatacatagtgaggcctgttatagcccaaatgcgtgcgcaccgatgggtgaccaatcgttggcatgagacaactctagtctctgggcccaagcttctattctggccattggcatcgcctgcttacaaaacgataaagcatagttattaacgcgaggaacgtttaggtgcctaaaaactggcattgtggtccttttcgtaggttagtgaatatgaacccttctagtcgcaaggaaacgattcttctttcttttgacaccttcatcaactgaaattgcaacgagctcatgcttactgctttaacatcatatgcctggaccacgggtttaggaacttccttaaatcctcggcgttcccactaggaaagtcgcctcgtggggctggtaacacgagcatttctaatggtacaataccaacgggtaagggaagactctcacctttaaaaactttaccagggccatctagcaattaagcacagggggtctcagcctggtacaactggttgttaccgcaccgtcttaagggttttcaatggtac

SEQ ID NO: 628032 - DNA, 1398 bp, Homo sapiens
  misc_feature (814)..(814): n is a, c, g, or t
ggcgtgtttaccccctctcccatctgtgagatttttccccagtcatgcttgtgaggtattgaacctgtcacaacacgaggctcattattgccccgttgcgacccacctttcggacaacgacgccgttattaaatgctccttcacatgggagagatggcccagttcgaacttggtatctgttcggtctcttttaccagagggaattcccgtgctggaaaacgccatgaacagggccaaccctgaaaagtgtgcatgcacaccgctacagattggtgactttctaggacaagataccttctcgggaacctgtatgcctctaacaaagcctttatctatatgccgtcggtaattaccggaaccatagactttggagctcatgcctcaaaatcctattcaatcgaagttatccaatcactcataaaatgtaagtctttgggaagggcctttcctaaacctggttaacttttgaaaaaaaattcagttaacggggtgataaaaatttaaaagggggtcttcgtgaactacttggaaaagccaaaactttttaagagaataggaaaatgaacgaatataagccaaccaattgctattggtcccaaaggatatcttaatatcctagtactctaaaggggagacgtaggagcggaaaatttaaaaagtattgctctccacgggaaggatgtgcaatcctccggacattgaaggtaaagtttgcctctcaccgctggagtctttgacatggtattgttccttcctgtcccgtccaataccagctagtatctaactttgtccaccgataatagtgcgagcatcntcacctcgtagtcgtctgctctctgagttagtcttaaatatgtgcgagggaaggaatgcttccgttttcacagataacagcttagcacagttagaaacccggctcatccactgataactgctgtaaacactagttaacaaatgccctccgctaaagtagtgaggacttattgtaatatatcctcttggagacaacatgtggtcttcaatgctcctaccttcgccctccagtacaatctctcagtgacaatcctgaatctacttcccactgcgtgcatctttctattgactaatttgaccaaatgcacaggctctgatacacaatcaggaatgcagtattcgaaccatgacataaactcctattttctaaaggagtagctgggtcatgggtctatggcatgatggaacatagtaaatggatgcacacaaattcggcattttaaaagtgataaactggtatggatttcttcattagataacatctgcataatggactgtataagctcttctgagttcttcacttgtactgcataatgggtcagcataaaaatgaaggtttgattaggattaagggccatgacattt

SEQ ID NO: 628033 - DNA, 258 bp, Homo sapiens
ctttgtgccccttgtgtggactgtggtctgtactaatcgtgtgtaactgtggtgaggggcttgtcctgtagtgttagtctgtacccaggtggggtctgtgccctgcagaccgggtccctctgtatttatcgctgcctgaatgcaacagtaatttataatccaggacaaatacagtctgggcgtcactatcctagcatctcttcctcatctatagtgtcaacaaacttaggggaggggagggcctggattggcaccccc

SEQ ID NO: 628034 - DNA, 293 bp, Homo sapiens
gtgcttagaggatccccaaagcttagcaggagaggagagccagagatagttgacaggaagctacaggttacaacagatttgtgaactcagccaagcacagtggtggcagggcctagctgctacaaagaagacatgttttagacaatatactcatgtttgtatgggcaaaccaacttcgacggactgtattttgtgactaacttgtataaccaggttattttcagtttcttgttcttgtggacaagtgtaacagcattccaacacaagggttttacatgtagcaattttttttt

SEQ ID NO: 628035 - DNA, 155 bp, Homo sapiens
acacttatatcgggaggtggaggttgcagtgagctgagatcacgccactgcactccagcctgggcacagaacgagacacggtctcaaacaaaaaaagtaaaaaaagaaaagcaattagctgctaattatgtgctactataagtttgttccccgct

SEQ ID NO: 628036 - DNA, 482 bp, Homo sapiens
tatttttgaaatggcagaaactttggctgggcgcagtgactcacacctataatcccagcactttgggaggccaaggcgggcggattgcctgagttcaggagttcgagaccagcctggggccaacaaagtgaaaccttatctctgctaaaatacaaaaaatttagctgggtgtggcggcatgcgcctgtaatcccagctacttgggaggctgaggcaggctaatcacttgaacctgggaggtacaggttgcagtgagctgagattgtgccactgcactccagcctggtgatggagcgagactttgtctcaaaaaaaaaaaaatttacaaaacctttatttaaaacggtgtgtttggcacatgcctgtaatctcagcactctggaaagccaaggcaggaggactgttggaggccaggagttcaaaactggcctggtcaacataatgaaactccggtctctacacacacaacacataaaaacaca

SEQ ID NO: 628037 - DNA, 286 bp, Homo sapiens
cgtactcatccgtccagtaaaagcaaagaacatcgcgcgcttaatacacagaatccgcgtgaacagaaggcctccatctctactctcgattgcagcacccgattaaagccttccttggcgatgcttgtgatctcagtgattggcttgctgtgcagggagcagctggatctagaccgaacccctggtgtttcagtaccagttccagccgctggctgtattcaaacatggagtgacttttcactgggtaccatatgtgactcacgggagctgcatggccaagaaaggt

SEQ ID NO: 628038 - DNA, 140 bp, Homo sapiens
ttaaggcagctaagagtagtccttatcttgttctctgattaaccagacttgaacgctccagtgcgagcagagtgctgggggtggattccactgccgaaccacggcagctttgctttactcttcatcgtggggtaggaggt

SEQ ID NO: 628039 - DNA, 134 bp, Homo sapiens
gtcactcagggatctatacacaccataccccaaagtacaggcccaaactccaccggggccaagtctatctggctcaaagtcaccatgtcccccagagaagtctaaagaatcactacgttcacagttgccctgga

SEQ ID NO: 628040 - DNA, 94 bp, Homo sapiens
tggatgacccccccttcccatgcttccttgcattaggctttttaaacccggagccccttcaaacttccaataaagggatcattttttgctttta

SEQ ID NO: 628041 - DNA, 180 bp, Homo sapiens
agcggccggcccttttttggtagaagagggtcttgctatgtggctcaggctggtctcgaactcaaccgatcctcctgccttggtctcccaaagtgctgagattacaggcatgagcatcacaccgggcaacggtatgatctttggtgtctttggagtttggttcccatcagtgtttccatt

SEQ ID NO: 628042 - DNA, 246 bp, Homo sapiens
gcctacatagtgcggtcgataggctcggtggtcggcgagcgtatcgccctaggcgaggagaaggcgctggagcttggctagccccttacgtcagcttctaccgccagcgagggtgcgcgcatacaggaaagcctgttctcgctgatgcagatggccaagacctcgagcggcgctcggcaagctgcgcgccaggggcctgccgtacatctcggtgatgacccacccgaccagttggggccaacatgg

SEQ ID NO: 628043 - DNA, 253 bp, Homo sapiens
gtaacagatgatttagtttgtttggtgtatacacacagaccaagctcaagatgtaaagaagattgagagcttccacagtcaactaatgcgacttatggtagccaaggcagcccgccatgttaccatggcaactgagtgaatggtttgacatgagactttgtcgtgtacttaggagtgcatatctttgacttagagaagtgttggacagacgtactttatgtaactcggtggctgttcagcagcttagaggtca

SEQ ID NO: 628044 - DNA, 351 bp, Homo sapiens
acggcgcactatccttcccacaaacgatggtgttaaagctagggtcaggatgtggagcgctgcctgggcctcttcctattccgatggttataggagaatagagactacttcctgtgaccacaaatctttttcttctgttactcatttatgttggttttaaaaggagctttggggccagagcttacttgttggctcctacgagagcgcctccatttatgaactcggtacttccactactttcctctttgggaggccccctcggaaaaccacacctgagagttgcgtttaaaacccgcatgtaggtatttgtacagtgactttttccctccacgttgttcgccattaatcacg

SEQ ID NO: 628045 - DNA, 941 bp, Homo sapiens
acagagcagcagagtaagagcacaaaacgagcacctagtcttatctctattactctatgaacatgtctgtcactaatattggtccactccccgctgaatgtggttgactatagacgggtgctctttgcgcctttatatcaccggtgttcgccctctgtattcggaggcccccccgccatgtatccagctttgcctgtaccgtgtccaaatgcccgtttccggggaattaatcaggcttacaaattctgcggtatggcgccccgtggtgcttgatatccacccacataagggctaaatacattttcgcatccgggtgtaccacaacatgactggtgccggcccaatacagaggtcaccctcggacttttaaaaaacgtcgtgtttccccccaatattgtggcccacccgggtaggtatcctgtcctcaaagtacaaaaatcgtttcccgcccccgcaatggatgcgtgccacccccgactgtggcgcccacgcatgggatctatcctcccccactccttaacacgcctgctgaagaccgtttctcgcagaaatactccggtgaagacacttctaccacggcggcatgtcatgacgcgcacaatggtcccaagaggttaaaatttattacttccgtcctgtaacccaacgcgagagttgctaaattatgtttatgaaacaagaggctgcgaatatctggagatcttcatctctttaaacattgtgtggcaccgtgtgtcaattacctaaatgtgcgataattcctggtggaataatttctcttgggagggagagcttcatacattcattacaaacctctgtctcaggggcttaggagcccactcatatcgccagatacaagaaaactacacgtttcttataatatgatcaggccaattagctcccttgtttaaccgaaaaaaaaacctggaaaacccacaaaa

SEQ ID NO: 628046 - DNA, 1440 bp, Homo sapiens
  misc_feature (822)..(822): n is a, c, g, or t
caatgtggggtgtaggttcccggcgatgtttatccgcggggggagtgtatgcattcccccgattattagtttcgatggccccccgccattctctgtttcggtgattggatttatagaaaatcctttcatgggggccgattttgttgtcctcccttggtcttcgtgcgtggcgtcttctttggccacgttgtgggaggccccccgccgctgttttttgtgcgcacaaaaatattgggggggaaacaatttatatggggtatagggccgccaccaaacaccgttccccggggcgccctttgggtgatataaaacccttggtgcttggtcccaccacagaagttagagaaatctcttatagggtgcccacagagctttgttgataatatggttggctccccaccgcactggaggacccgccccctgttgttgagagacgcccccctgcgtgggtagaaagatgtgtagaaacatgtgtttgaagatgtcgccacgaaaggagaggggaaacccaggccttcctcttgtgggggaaacaaatttaagggggaagaagaacaccccttctggtttaggaaggaaggaaggttttagagaaaaagttgtttggaagcgacgcccccacttatgttatgggcgtcgtttaaaaggcgacacgccccccccccactttttataagaaaaagccgtgttcaaagcgtctaacagccccctctttcccttgagaaattctcccccgacaactattgagcctggaagcgtccgtcagccacccccaacttggggggcccccaaatcgtagtcaccccctattaggaagaggancgtaaaatggttatagataataaagtatacacactggaaaccactttttcctcccgccaactaaggcctcggcgtccacgaatttaaaccacctgagaactgaccacactttacaccgccccccaatattctaccacacttccaccccacccaggtcacttatttaaccccccctgtcacaaccccaacaccacgggcaacaggctcaataagggacagggttataaaaagagtataaaggagaactcggcccaaattcttaaccccgccccggtgttagccccagaacactcaccctttagcgcatccacccagttatttagaggccaccgcctgccccagtgacacacacatagtttaacaggcccccggtgtacccttaaccgtgcctaaggtgagcgcataaatccacattgttcccttaaatatagggacacctgtatgaatggctcccacgagggttctaactgtcttctttacattttaacccagtgaaattgacactgccccctgaagaggcgggccatgaccaccagccagacgagaagaccctatggagcgctttaatttattaaagccaaccgtaccttaccaaccccccggtccttaactacccca

SEQ ID NO: 628047 - DNA, 278 bp, Homo sapiens
cctcctgggttcaagcgattctcttgcgtcagcctcccgagtagctgagactacaggcgcccgccaccacgcccggctaatttttttatttttagtagagacggggtttcatcgtgttggccagaatggtctctatctctcggtgatccgcccgcctcagcctcccaaagtgctggggattacaggcatgaaccaccgtgcccggcaattctagactttaaaagagaatgggtttaagagcatttagagaaagaaatgtaaccatagataccaacatg

SEQ ID NO: 628048 - DNA, 533 bp, Homo sapiens
ctcacccgttgagattattcagcagccagatatacgggaacgataatcatgatcctaacaaagctttgtactccgtgctgtctatgtctcccaagatacataatactgtaaaactcaaaagctacttacccatggcaaataggacgaagctcagtatcggctcctcccaccataacccccacttcctccactgcctcctggaccatagtttcctatcattgtcggacacagcaagagaacacaaacttactctgctttcccatgatcaggctaacactacagctgattctattctatatccatccagtctttaaaacaagcagatcctaatccttagcagacagtcagcagaattactcaggagataaattcactcgggttcatagaccacttactactttcgcgactgaccctattcttttaaatacagggtcctttcaccctctcatcctcatttggactgagtcagggattcacttacaagtacatcacgcccaagacacagctagtttactcctagctgaataatctca

SEQ ID NO: 628049 - DNA, 261 bp, Homo sapiens
gccagacccgccacatgctagtgagggccagaagctgttgctacactatgagggtcgcggcaatccagtcccacagcagcacctatgggagtaaggcagggcagtgtgccaccccctgcaagatggacccaggcagagtgccctgatcttccctcctcctcaacaagagttcacagtggcacctacggctgcacaggcaccagcatcatgggcagctacaagagcctactagcaccctcaatcagtaatgaccccagttcc

SEQ ID NO: 628050 - DNA, 687 bp, Homo sapiens
tatgtaaaaaacaggctgactttaatttccctggcagagcatctccctcgggaagaagcacgggagccccaagtcatcgatttaaaagcaggagaatccccttgactaggttggggtctgagcccagaggcagggcctaaggaggtgcagagactaggtgccgtggagtggtgaggcaaggtgggggcctggagggacagctatgaccgttgaccttgcgagacccgtggctccaccttcttgcgagtggaacccagcggtgcacgaaggggcacccctgtgaggcgcaaaggcacagtaacagtcgccaggggatgtgtgtcagggcagatcctttccttctcaggaggctgttgacgggggagagtgtcatgcctctaaacagtgaacgggacatgattgacttccataccccaatcttccttgctggtgagaagtggaccttggagtccagggcgctgaaactcaaaattagggtatggagctggaccccagagaataaagtctcaagtagtagaaggggcatctccttcagtccatggattcgggcctctggcatgatgcagccagggccctggatgtaaggattccgaactcgcgggaaaggaacaacagggtttggtaacaagaatgaagctctcaatttgctccgcaatctgtgggccacaaaacaacgggacatacaag

SEQ ID NO: 628051 - DNA, 919 bp, Homo sapiens
aatgtgggtatctctctgtgggcctagtatccttgcgtggtgctcactgtgactgcctggtcccgcgtttgtacccctagcgcttcgccagaacgcgccctcttgggggaggccgaatttgtgcaaccataaggttcctcccggccgctaaatgcccgtttctccccacgccgggcattgttttgacacgcaggggtttgatgacgacaccgcctgccaaacactcgtggcgcctcttccttgggggaggttccccttggatcctcctggtggggaaaggacaagcagagaacagtggtggtgtgagaccccgtggccccagcgcctttgtggcaccacccctgcgagcccccaagggtgttttggcaacccccttgggggataaccccccaaccccctgagagcccgttgttggggacccccaacacgggacggcatcggcgcaacaaagagccctcgcgtgccctctatggagcggccctgcgtccccctcggcgaagaccccccatggcggccaccttgtcgccccccggagggtgagtcgacgccccggtgcacaaacaggtgccaccggcgcgagtctccttagagagactcagagccctggcggcaacatgaggggtgcactttaggcccccccatctgggcaacaggtcgtgccccgatcctgccaggagggacttcaatacaaaaagagggggcgctgagtggtgagaacacaagcccgcgccccccccacagggtaccttcaagcgagccgcagtttcattgcaccgcccccaacatttgcaaacaacaggtcccagttggtcgcccagaaatgccccacaggagacagggggaatcattttgaaaggcccgaggcatcttgggttctccctaaataaaaaaaacttatttccccaccccaaccaaaaca

SEQ ID NO: 628052 - DNA, 125 bp, Homo sapiens
tcgtgttcctttgtctgagtccggctatcgggaggtaagtcaggagaattgcttgaatccaggagcagagatggactccagcctaggcaacagagtgagaccctgtctcaaaacaaaacaaaaaa

SEQ ID NO: 628053 - DNA, 264 bp, Homo sapiens
tatggggtccaccatacatcacggtagatccaataaagcaaacatgccagtctggctacatgtcgcaccaataaagaactggtagtttttgacattagcaaggatgtgcctgatttgtactgcagcccctgtcataaaaggttatactctttctggtctctgttcttcaagtttaccctttgattgacttcatagtaatctttgatgtacttcttgtaggctactatcgtgaaccttgttactttcagggatggttctagatag

SEQ ID NO: 628054 - DNA, 965 bp, Homo sapiens
gctacaccagagttggtggctggacctcctgcgacttccgagttgcgatgctgtacttctcttatgtgtttgggcggctcggcctctgtcgagtagatgtgggcagctggtcgggatggccattcggggctcagcacagcaacgcagacccagactcagactggggaagcaagactagtgggactggacaggccaggagagccgtgtcggacagtgatcctgagatgtgggatgttgctgcagagggagaacggacaggcatgtgtcgtggcctggagctcattgcctctagtagaaacttctgcagccgagctgctgctgggaggccctggggtcctgtctgaacaacaagtactcggagggttatcctggcaagagatactattgggggagcagatggtggtggatgaaattgatctgctgtgccagcgccggcgtcccttggaagcctttgagctcgtgaatcctcgcaccagtggggagtcatgtgtctcagtcctattccgggtcccccagcctggccgtggccgtctacacagcccttctgcaaggctcacgacggatcatggggctggagctggccgatggggggcatctcacccacggtgctgtctgacgtcaagcggatatcagccacgtccatcttcttcgagtctatgcccctagtcaggctcaacccccaggactggctcattgactacaccaggtgggactgactggtcgactttttccggccacgggtcattattagggtgggaccaggctatgtcgctcattgataagcccggtgagagagtggctgtgcgtcccagcccctggcggcgcatggccccccctggcctggcgccagggtcctcccttaacgggtctccacaccacaaatcgggcggggctcacgcaggggggccccgcggccactgcgcgtttcccgggccacactttgggcccccgtaggggcagcagcc

SEQ ID NO: 628055 - DNA, 1197 bp, Homo sapiens
gggatatcgggcacttgccaccatgcctggctaattgtcgtataattgcatctctctttcttatcttgttcttattttattatttttgagacggagtctacactctagttgcccaggctggacaccaagggcgcgatctcggctcacgtgcaacctccacctcccggattcaagcgattctccgtgcctaccagcctcctgagatagctggaatctacatgcgcgtgtccaccacgcacagctaattttatataattttagtagagatcggggtttcactgcgttggccaggatgatctcgatctcttgacctggggatccacccgcctgggcctcccaaagtgctgggacttacaggtgtgagccatccatgtcctggccctaatctcggggttcttcattagaacacacgagtttcaccatgtgggccaggtctggagaattgctgtaactcgttttccaaccgggcccctgtccttcctctctctggcctctccctcccatacgtcatcgtgccacctagcagccagaggtgatcctgatactctgcggccttatactttccgccgtccctacaggagcagtacgcctgttctcaaactcccgacgatcttacaaccaacacttttcggtcataccagcgtcatcccaatatcacgcgttccattcgcgccaacttcttacaacactccaggccacccagcactcactggaccatcacgcgaacccacgatcccacctcccatttcacacactaccacgcagcaagttgcctcgcatcatgacgctcggtgctcagcaacagcacgcgtcacgctcttccactaacacccccgcagccccgcgcgcctgccacaaccggacaccaacaccacagcctctgacacaccactaccaacacaccaacttcaagcactcacacctacgcctcgagcaacccccgcggcaccccccccaccgcgtcacttctcagcatctacatcatcccattcctcccaccaacccctgctcctcaccacgtccccccccccacccccccacacaccccccaccacctaaacctcctacctccatatatactccctcacactacaacccccacccgcaccaacccccacaaccccaccaaccaccccacaccaccagcaaacacacacccacatcacccccccgtaccaccacctcgacctccacctc

SEQ ID NO: 628056 - DNA, 266 bp, Homo sapiens
gtgtggtattaagatcgggatgatgtcgggtcggtttggccgggtactgtcatggcaggcatgcagtggcatgtggactaacatgcatggaggctcggcaggcctgaagtggctgacggagcaagagtgatggaacagctgggaacactgtgaagctggccccggcgggctccttcaaattccccttcaatgggggccttgtctccccaaggcccctttcaacccccggcaatcttccccttcaacccaaggcccttcccaaattg

SEQ ID NO: 628057 - DNA, 685 bp, Homo sapiens
gagcggggtcttcccctgaggccgcgcggagctgggcgactggggcgaggactcgcgcacaggtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggacatgcttccatcaggtagaggcattttaggtcgaggcttgtctgctaatctggtacgcaaggacagggaggaactctctcccacttatgggatccaaaagtgttggcggctggggacagcaagatggcagagacctccgttggtaggagtaggacgcttggacagacgggagttcagatgcgtctttattaccactgggaacgagcagcaggtggtatcagcagagaagtggacaagcctccctgtaccttcagcacaccgtccaggggtcccccgcagctgtccatcacaccagctctgcccca

SEQ ID NO: 628058 - DNA, 413 bp, Homo sapiens
gtagagagagagagagagagagagcgagagcgagagtgagagttagacagagagagagagagacctagcgcgcgagatatagttccgagagagactgattccaccttctaccccctccttctattcctcctcctaccccctcttccctctgcccactgacttctctcactcttctcttttccctgtcacccgtgtcttccacccccggttccggacttgctgcctgtctccacctcttcgacccctcccctctctgtatcatcgttctcctcgttatcttcccgtgcttgcgtctcgcctcccctgcccctctatatcttcatttccttccttgactcttctctccctttctactttccccctcctccctctagctccgcttgttcctttctcctttcgtccactctgctccc

SEQ ID NO: 628059 - DNA, 405 bp, Homo sapiens
  misc_feature (208)..(208): n is a, c, g, or t
  misc_feature (337)..(337): n is a, c, g, or t
gaggagagtttccgggttagtgcattcagcggaccgatgataattttcccggctgccttcatcttcaggttcgaccctttagtcacagcatggctgccactgcaccgagtatcacgtctccatgtaactgtagccagagtaaaacagaaacattaagtctgagagtctgtggcaccagctagttgatgggagagagcagacccctttnctggtggccatggcactgggagacgaggagggtacctatgtcctgcagaggtcatccttttgtccatgctggttatccctggcctcaggtggtacgggctacaggaagatggcagagtacatgcctttnttcctcacaaaccactgtcctcttggtggacatatatacaggtgtgcagatggttcaggccgtgggga

SEQ ID NO: 628060 - DNA, 308 bp, Homo sapiens
gattacagacatgtcaccactgtcgcctatcccagagtgactttctcctaatcattgtctttgtttccattcccatttgctcttcatattctattctttattcttttactgtgtttgcatttaaagtgaccacagatggtcaacgattccatgacttgggagttttagggagtggtgaaatatttgctttgctagataagctaatatccttattgataagtctgaatttcagggtgaaaagttatgatggtggtgtttaggggattggcatttgtgtatgctgacattagtagtgatttgccgaggtg

SEQ ID NO: 628061 - DNA, 353 bp, Homo sapiens
taaattgtggcaagctttccaatgtatctcatcaggtgcacccagagagccaaggccaatttcctgggaaatctgggcaaagctgcgttctgaaaccaagggcacatgtcccaacagctcatggcagatgtcaggttcgggggtatccatgggcttggatccatgtctaatgtactgtgtacagtggaagcctcgaaaggccaggccacccaagaattcccgagaggaaacgcaggccagctacaggtcgaaggcggaaaccagtgcaagtctgcaggacttgcaagaagtggaaatatgtgagtgtactcatagcgagcatgggttttacacaagcacttcagagtcttgct

SEQ ID NO: 628062 - DNA, 1151 bp, Homo sapiens
  misc_feature (30)..(30): n is a, c, g, or t
  misc_feature (232)..(232): n is a, c, g, or t
  misc_feature (248)..(248): n is a, c, g, or t
  misc_feature (262)..(262): n is a, c, g, or t
  misc_feature (271)..(271): n is a, c, g, or t
  misc_feature (279)..(279): n is a, c, g, or t
  misc_feature (327)..(327): n is a, c, g, or t
  misc_feature (359)..(359): n is a, c, g, or t
  misc_feature (370)..(370): n is a, c, g, or t
  misc_feature (378)..(378): n is a, c, g, or t
  misc_feature (402)..(402): n is a, c, g, or t
  misc_feature (504)..(504): n is a, c, g, or t
agttgttgcgtagtggtagtggttgtgtcntgtctgtagctggttctcgttgcgctgatgtgttgtgctgttcgttggtagtacgctgtgtctgtcgtgggggtggtgtgtggtgtagttggctatgttgttgttgtgggtgcgtgtgcgggtagctgatgttgggtagtgcgctgagttgttgcctggtgtgctcgtctagggaagttgtcgcgtggttggtccggtgtcnggtggccttttctccncggcgcgggtaatnccccccccnagttcgtnggggggggaggaaacgcgccccagattgtccgccgccgcacgtacttnggcctcggggtgttttaaagcgcccgcgcctncgtcccgcgtnatggagtnttcttggtttaatatccgcgcctntctcactcttatattgggggcccgctatcttttctcccgcccacgccgggaatcgttcctgccggctcgcccgctgagagtctctctgctgccggagggtancacgtcccccgccaataccttctggttttgcgacagctcactactatctgatgttattccatttcgccggggtcccaggacacatatttcccgccgcggattttctcggccccactttctcgcgccccggggggaccaccacaatccaatgctgcgctggaggtctctccttcgaggaaaggaccttattatctctggccggagaacctcctttgtgcagccacgagatgagtctctgcggcccccataaacgctggtggtgatccaaggcaccttctcctcggggagaagtgggtctcacaactcacaggggcgccacagaaccacttgtgacacttgcctgtctacatgagggccgaagagtccactctccctccagtagtttgttaactctcctgaaaagaattgtacgaaagtaatgtctggctggaaattggtaaaagaaaatggaggtacaccgtcaatgagagagcacccacagaagccctcacctgactggatataaaaagctgctttgcgttgtaaatcttttaaacatcaatactccaatcctgcgagtgggagtctctcttcgaatgctgtaggcccttcccctccccttattcccccggggggtccccccaaaaaattcccttttttgccaaaaa

SEQ ID NO: 628063 - DNA, 136 bp, Homo sapiens
ttgcaggagagagaactgaagaatacaatgaataaaatgaaaatgcaagctgggtgcctgtggcggactccctgtaaatcccagcactttgtggaggcccgaggtaggtggattggcctgaggtcagcgagttccg

SEQ ID NO: 628064 - DNA, 550 bp, Homo sapiens
cgacggtcgcagcaaatcgagctgctgctgcggcggctgtggcggcggcagcggcggtgactgaggatagagagccacaggacgaggagctgccaggcctggacagccagtggcgccagatagaaaacggcgagagtgggcgagaacgtccactgcgggccggcgaaagctggttccttgctggaggagccacgttagcaggagctctcgaggacgatcagcctctgtgctcacatgccactcttcaatgaaaactggctcagaggactgtgaggcgagatatgtgctgtccaagtgcttggcattacctggtcagctggtatggtctagagcatggcagcacccatgaacgcaagtcatagagctgccaacatccaaaggtcgagtgtacccagtagaactgctgtgtcggacatgatgggcaatctcacacgttcagcagctacgatctatggctattgcgccgtcgggacggtctgtggagccggagacccggttgggcaaatcaaagtctggtagtgttgaccaaataggtctgagggctgaatgg

SEQ ID NO: 628065 - DNA, 229 bp, Homo sapiens
gttcctccacaatttcctacacctgctccccccatgatcagtacacattgttcctccactattcctatcacctcttgctgcatgatcgtgagttccaccacgaatgtcatttcattagctacctctggcatgatcacagctgcatctccatattatggattaatcacgatggttccttctgaaacacaagagtaacaatgaaatgtcccccaccaccccactagttatg

SEQ ID NO: 628066 - DNA, 339 bp, Homo sapiens
ctcctcctccgggtttcggcttcggccatttctttttttctcaaggtgcaatgaaagccttgcacgactttctgtgttgtccttctggtgcccgcgagtgtctctaaagccaagtttgattcttattgcttgtggaacaagttaccttgctggtgtagcaacacgtcaagctcttgaggagctgactgagttgcctgtgatggtggaactagcaagtgacttcctggacagaaacacaccagtctttcgagatgatctttgctttttccttagacaatcaggtgagacagcagatactttgatgggtcttcgctactgtaaggaggaggaggaattgct

SEQ ID NO: 628067 - DNA, 111 bp, Homo sapiens
cagtttacagcgtcagggcagtatacagcgggggtggggcgtcgccctgcattttcagggcagtttacagcctcatggcagtttacccttcttagctttaaactgggggat

SEQ ID NO: 628068 - DNA, 501 bp, Homo sapiens
cggaccttgattacgaatgtttcagtcggggcttcgtaccgccagcggcggtggcgcacaagctgctcaggcgatcactaataacgctttcatttcttcattaccttcttcagaggcgaaagggggcacggggcccttgtgaggccgcgtgtgtcacttaaaagttgggaagttcggattaacgttgccttcgtgggggctgttgcgttgttaatcagagtgcctagttggcggagttgattttaggcgcttcggttatattcatatacccgcagttttgataaacacttttggcggtttttgtaacaatccctcaatcaagattttttcagaaacctgccagccgccgcagcacgcgggccagagcggtgaaaaggcatagcagggcaatttgtagggtcttgttactaccatcgtcgaatggttctataggcccaccccggctacaacaggggccatacaacaacaactatgtcaccgaggtaagaaagatgagtgcgg

SEQ ID NO: 628069 - DNA, 242 bp, Homo sapiens
tccacgtcgttctcttcgtctcatcctctggcctgtgtggtctctcctttcctcccctctcctctcctcgtggtactgctgctctagtccatttgggccttctctcctattcggttttgatgctgcttactgcctcacggtctggatgcgtgctagcctcctctatcttgaaccatgttttctgctctttgtccccggttccccagaccagcagaaaccacatggcgatgagcacatgaaga

SEQ ID NO: 628070 - DNA, 1891 bp, Homo sapiens
  misc_feature (254)..(254): n is a, c, g, or t
  misc_feature (469)..(469): n is a, c, g, or t
  misc_feature (496)..(496): n is a, c, g, or t
gaataagcgaagtgcggctggctgaagcgcaatagatgaatgacacacgcatgaggcagaggtccatagctagaactccgctagtcgttgtctcgccaccgagtaagagcgcgagcagtgaatgcagaaagagcatgcgtacatggccacgactgctagggagatgctgtggttaccatggttgttgggactgcatgctactgctcgtagagcctctgtgctcaatgcgatctagagagcttccatcgccctcntggatcgccagatacactcttcttgagaagccctacgctttgcctccattaatagcataagagtgcacatagtatatggttccttcttgctcgctggcaccttgtgatcatttcttgggactaatcttctggtcgatttgatttggttggcctcgtaggcttggtacactatagccccacttagtaattcccatatatcgaccatgcctttgccntgactgggcttttctgagaacttgcanaagaaaactctagacacaaagcgatatcaattgcacaccaaaacaagctataatgacagagagaatagagcgaggcgtgcacccgaatatcacattggatatttatatgcgcacacgcagaaggggggctcacacaaaggccaatattacctgacagaacgcgcgccgacgtcttgtcctccgcgttgcttacaatggagagtgtgaggacccacaagtaattaagccccaagtaagcacgccgcaattttgtaatatgcaccacggctttagcgggccccttcggcggttctcggcacacgcgaggctcatcctaggaactcgaagactcgccgacacgatcggctgtggcggaaaacaccatcactggcggtgcggaaataccccccctggtagagcgaggacacacccctggtcgaacgctacggcaaaaggtcggatccccaatatacagcccccaacagaaggacgcacggcgtagggccccctcgtctaaaagtcgagggtgcacccgacaaacagcaccaacgccgcttataaccacaactacagaaccttttgtaagaagaggtccctcccataagaggcagggccaaaccttctgtgtttaaccacatctaccctccccacaaggcccctggcacacatacaccagggcgcggcagtaaaaaccacggcacgcgcacggcacacccactaaaagccggcacacacgcacacaggcggcctaacgcaccacagcacatgtcaattagccacccctaatcacagacgtagccacagccaactaggtgaacgccacacttccgtccgcacacaatgaacaatacagactccgaccaccgcgacgcacccccacccacacacaacaaccacccgccacacacatcaacgagccacacgaagcaaccacgccccacccagcacgacacagccgcggaactcccaacccccctatgcacactcccgcttcgcacaagcttcttcgactcacgcaacaattccccggtgaccgcccaccctacccaacacgccgagcaagcagccaggacactcacttcgcgacaacgacacacacgcaggcgtgaataccaacgacgatcaagacacaccaagcaccaccagtgcagtgacgcccacacgcatcgatgccgcaccagcgcagctcaaacacacgatgcgaaaccgagcacacacactactattagaccgagcgagcacagacctactcgcgacccacacactccgcccgctactaccgccgcctacgcagccagcccgcacctcagatgcgacgcaacacaaacagcaacgcacaaccacacacacacagcggagcggccacatctcacccgcgcacatgccaaacccaacacaccagcactcatgcaccac

SEQ ID NO: 628071 - DNA, 335 bp, Homo sapiens
ccccccccggggttttttttaagggggcccaattttcccccctgggggggggggggggggtgggggaaaaacccctgggggggggccggggggggcccccccaaaggggggggtttctttgcctttttttgggtttaacccccaaaaaatttttttttttataaaaaggggggccccccctggttttccccccgggtttttttcccgccccagggtttggggggggttttttccccggggtttttttttttttttccaaaaagggggggggtttttgggccccccccccccccccccccccgttttaaattaaaagggggggttcccccccccca

SEQ ID NO: 628072 - DNA, 237 bp, Homo sapiens
atcacttgtatcatgtgtgtcagaggctgcaggatcatgaagccacatcagcagtcagatttggcagaacaaaagtggtgccttcctccagttatgagccacatgatgagacatagaatgcatcgagcaacagcaagggacggaaaaacgggaaaatactggctacaaaacagtcttgcaccacactgaggtaataaacacctaactctcatttctgctggtcaaagggggtcccgg

SEQ ID NO: 628073 - DNA, 115 bp, Homo sapiens
gtcatggcggccttcaggtacttctgctcgtgcctccgcttccggcccctgagcgatggtccttttctttctgccacggcgggatcgggcacttacccattgcaagttccgagcc

SEQ ID NO: 628074 - DNA, 121 bp, Homo sapiens
tcgaagtctgtagagaggcaggcagggcaggacacacccaggggactttaatgacactagggcatgttttcatttctaccaatatgggcaatgggtacataggacgttcactagtaacgtg

SEQ ID NO: 628075 - DNA, 157 bp, Homo sapiens
  misc_feature (128)..(128): n is a, c, g, or t
ttgtggatctgtcctcagggtgtattcccaggagcaggattgctgggttaaagggcacaattatattgtgggctctcatatggatattgctaaattgctttccaaaagggttgtaccatgtttatgantgccaccatgcgtgttcgtgaaaggtacc

SEQ ID NO: 628076 - DNA, 202 bp, Homo sapiens
  misc_feature (12)..(12): n is a, c, g, or t
  misc_feature (98)..(98): n is a, c, g, or t
  misc_feature (138)..(138): n is a, c, g, or t
  misc_feature (181)..(181): n is a, c, g, or t
tgtacgacaagntcatccgcctgagggagagacaccgattacagaacccggtcagcggggcacccctcagcacatggtggggccacaccatttgccgngccaggctagagatcctgcagctctgaaagcaactgtggngggcatgacctgaagcacgacttccagcactgaaagagacatngcggtaagacctgaggctgag

SEQ ID NO: 628077 - DNA, 368 bp, Homo sapiens
aggatcccctctgcatcgctaatcctttctccatttcttctctgaccacaggggatcgtcaggtggtgtggtcagcgcccaatggcgcgctctattgtgttgtttatcacaagtcgcagcatcgtcaactgattgcagtatttcgtacttttcttctgttacagccagctagctggatggccaggttgtcggccaccttgtcctaggaaggcggttgtgggcttctccttacacagcagcaccagctccagatccaagtcgcccttgagtaggaagcccttggccaccaggcccacccgcatcactccccgcagggtgctggtcatgtgctccgtcttctgttccccagccccttctttactgtcgtc

SEQ ID NO: 628078 - DNA, 551 bp, Homo sapiens
gttctgcatagcaattgtatcttttggtttaagttgagtttcccagtctgaaatagcacaggaatttttataattattgggagaaaaggttgggatcaaagaaaaagggagggagaccctatggatttgttttcaaataatatcttctaagtagagaaatgtaagaaagaagacacaaccagtgattcaccagtgataggaacaagcagtagaaatgggaggtattttagttagaaaggattgtggaggttgggaaataagacagtattatctggaaaatagggagaactaaacaaaaagcattcatggagacattacatttaaagaggaattaaaacttctttctcggagaccaaatgaacgtatgaatgattgaatagatggtgaaacaggaaggaagctcatgtcatggcctcagatttcttttccttcactgagtaacattcccaaggctcacctgcacagtcaccttgtaaaattcctctttcatctgtcttcagctgttcttgatccaccttggagatcagactgtgtctgcagagctgataccc

SEQ ID NO: 628079 - DNA, 201 bp, Homo sapiens
atgctctggctaccattttcccatactacacttgtacacatcgctcgtcacgtccacatttccctgtctaacgatgaggccaggcacggtggctcatgcccgtaatcccagcactttgagcgcgtaaggtgggcggctcgcttgagcccaggaggtgcaggctgcagtgagccgcgattgcaccactgcactccagcctgg

SEQ ID NO: 628080 - DNA, 283 bp, Homo sapiens
cttcgtgcacatcatgtgaggagatgcttggaggagagctcatccatggtctgggacccagtgggaacgtctggctgtcttatgaaaggaaaccaagggtacaggatggtaaaccagtcatctccttttcgcactcgaacagcctgtgtttgactccttcctgtggattatcaggggagcaggagccaccccagctcatcacttccatcctccttcacaaaggggcctgctcagtgtgggctggtcacaggccgaattgccacatcccgctgtactttgtcaa

SEQ ID NO: 628081 - DNA, 1574 bp, Homo sapiens
  misc_feature (1484)..(1484): n is a, c, g, or t
ggcatagccagtaacctagggcccatgagtctcgatctccaacgcatatgggctaaagtacgtagataggctaaaacctactcgaatgcctagacactaatgcagtgccaacatatcgagtagtagctacacaactgaatcattgtacttccctgaataagaaccatcataagtggtgaattcgaggccatagaggcaacgccatgcagaacataagttactatagacgatcgatgcgccgtgctagctcattttggtaaccgcaaaatcactagacaaggcgtatatggaagctgttgccaccatatctctgacgctgccgaccgccctgaagcaaatcgctggtgtaccctcagatgagctaaacatgaggcatgacatcgcttatgcgcgcatgcaggatactcaactgtggtcagagggcccaatagcggcctatctattatcacacgctggcaagtcaccttattcatcggagacacacataaacctctttagccctccgtgcgtaagtcattcttataatgcattacgcataactcaaggtacctcgcatgatatcaaatgagaacgatctacaactaggaagccagggatgcaaaagctcaccactccaatccatttgtctatttactccttttggctctcccgatagaccacgaacgaccttctcaattgcgcccacgaacttcttctgtgccattcactacgaatcccacaaccctggagatggaccggggcagatcccgaggacaccaagaaaaacgggggctttgtaatggggctatggggccacccctggtaatctgtccacctattctgcctaaacaaactcggcttagtttgaaggtggaccttgcgcccgttgacacacctcatataatttaccagtgacggtgggactggtgatgtctccatccaaacgtcctagaccatatctaacttcacagtgaagtggtgcgtgccgagcggtggacatacaacagtttttcggttacccatgaaacatccaaatcgtggctgtgccactcttggtgcgcgccgaaatggtacgaccttgattttcgaaacagattttacgcgttgtgagaggtccgataataacgaaaaagctgtttacaaggtagattttgaacgattaaaggggttataaagctaagccaacatgaaggcctaacttccaatacaagcgtacacaaaagaataaaacgcctgcgtgtttaaccggggaaacgatccccacgttgtagtcgaacttacccccttacaaaaggcccccaaatggttccggagaagagacccccccaaatctggcttgggtggtcaaacttaagtaacctaggcccgcaggtaaccttctttaaaacagtaaggggcgggataatcggctaatatataacggcccgtcacacaatcaattacttcaaacaccaccgttgaacaatatgacaacattttagatcgaaaccccatatcccttggtnacttatatcccttaattgaagggcattcacttgatttcacaagagggttccacagatcatgaccttactgagaaaaagcgagaacctttc

SEQ ID NO: 628082 - DNA, 470 bp, Homo sapiens
agcggggaacaatcactttgaaatagtgcaggaccatagaaacgactatgaaagccgaaactgtgccaaacaaggttgatcatcatgttcttatttaatggaaaggatgtctttttctttctttctttcttttttttttttgggagagggactctcaccctatcgcccaaccgggagtgcagtggcgcaatctgggctcacggcaacctcggcctcccggggggcagcaattctccggcctcagcctcctgagtagcggggattacaggcatgcaccaccatgccgggctaatttttggtatttttagtagatcgggggtttcaccaggtgggccaggctggtctcaaactccggacctcaagggcctcagccttccaaagtgtggggtttacggttgtgagccaccgtgcccagccagggatgccttttttttttttttttttggagagacgtggagtctcactctggt

SEQ ID NO: 628083 - DNA, 212 bp, Homo sapiens
cctaacattcccagaatccatcagcaagcatgtatgaggcctgtggtgtaggggactgaattttttttttaacttctattccatttataattagtaggatatctatagtccactctacccaggtgtccctgcattatgaatgtactcatttgcatccctcattggtgtccaggccacaaaaatcaggcaacatgcagtaattttgcagtttg

SEQ ID NO: 628084 - DNA, 333 bp, Homo sapiens
caacaaaagtgtgcttacctattcacaaagatatagagccttactagcaaatattaaaataaaatgctgtacgtgactattatcctaaacgtgtaatgtgtaaatttggtctttaggagatggagccccacacttgtggccctggctggattatagtggcgtgatctcggctcactgtcgaacctctgtcacccggcgctgggctaaaagcatcgattccatagcgtgaattgggtcaaagctgattgggaagctactcttctctccccacccccatttgaaataagtacatcaaatttttatggtgaaatattttggtgggcctgagctaac

SEQ ID NO: 628085 - DNA, 310 bp, Homo sapiens
aggtaactatctcatttttctgctacaagtcgcagagttcaaacaaaaccctctgttgtgatttttcctaaactgctcttattgtacttggggaccacagaagacactgaggacttgggactccacagccattgcttccagcgtcatccacagagggttctctgcattggggacctggcagaatgatggcgtctggtagagaggcaggcgggcggctgctcattccctccactcctccacagatgtaagtcaagtgcccccatgtgccagccggggcaccaggcactggaggagacctgagcaagccagg

SEQ ID NO: 628086 - DNA, 267 bp, Homo sapiens
acaaggtctcactattcactctctctctcgcactcgtaccctaacattaaagagaacatgctgctatccgtgacttccaggcccgggtatttcgactatgggggtacaatagaaacaacaagaagccatatgtgtcactggctcagcagatggcaccacctagcccaagcaacagtacacctaaacagcagtagtaggacgcaatggcaaaagaccagctagagcaaaaccaagcctatacatctagacttgacgagcagcgcgtaa

SEQ ID NO: 628087 - DNA, 923 bp, Homo sapiens
  misc_feature (35)..(35): n is a, c, g, or t
  misc_feature (73)..(73): n is a, c, g, or t
  misc_feature (95)..(95): n is a, c, g, or t
  misc_feature (111)..(112): n is a, c, g, or t
  misc_feature (131)..(131): n is a, c, g, or t
  misc_feature (147)..(147): n is a, c, g, or t
  misc_feature (212)..(212): n is a, c, g, or t
  misc_feature (232)..(232): n is a, c, g, or t
  misc_feature (237)..(239): n is a, c, g, or t
  misc_feature (241)..(241): n is a, c, g, or t
  misc_feature (256)..(261): n is a, c, g, or t
  misc_feature (264)..(264): n is a, c, g, or t
  misc_feature (266)..(266): n is a, c, g, or t
  misc_feature (270)..(271): n is a, c, g, or t
  misc_feature (273)..(273): n is a, c, g, or t
  misc_feature (286)..(286): n is a, c, g, or t
  misc_feature (291)..(291): n is a, c, g, or t
  misc_feature (295)..(297): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (312)..(312): n is a, c, g, or t
  misc_feature (314)..(314): n is a, c, g, or t
  misc_feature (319)..(319): n is a, c, g, or t
  misc_feature (325)..(326): n is a, c, g, or t
  misc_feature (340)..(340): n is a, c, g, or t
  misc_feature (346)..(346): n is a, c, g, or t
  misc_feature (348)..(348): n is a, c, g, or t
  misc_feature (350)..(350): n is a, c, g, or t
  misc_feature (370)..(371): n is a, c, g, or t
  misc_feature (380)..(380): n is a, c, g, or t
  misc_feature (390)..(390): n is a, c, g, or t
  misc_feature (397)..(398): n is a, c, g, or t
  misc_feature (400)..(400): n is a, c, g, or t
  misc_feature (403)..(403): n is a, c, g, or t
  misc_feature (407)..(407): n is a, c, g, or t
  misc_feature (419)..(419): n is a, c, g, or t
  misc_feature (424)..(424): n is a, c, g, or t
  misc_feature (426)..(426): n is a, c, g, or t
  misc_feature (450)..(450): n is a, c, g, or t
  misc_feature (452)..(452): n is a, c, g, or t
  misc_feature (472)..(472): n is a, c, g, or t
  misc_feature (474)..(474): n is a, c, g, or t
  misc_feature (477)..(477): n is a, c, g, or t
  misc_feature (479)..(479): n is a, c, g, or t
  misc_feature (483)..(483): n is a, c, g, or t
  misc_feature (490)..(490): n is a, c, g, or t
  misc_feature (496)..(496): n is a, c, g, or t
  misc_feature (513)..(513): n is a, c, g, or t
  misc_feature (521)..(521): n is a, c, g, or t
  misc_feature (531)..(531): n is a, c, g, or t
  misc_feature (541)..(542): n is a, c, g, or t
  misc_feature (550)..(551): n is a, c, g, or t
  misc_feature (562)..(562): n is a, c, g, or t
  misc_feature (565)..(565): n is a, c, g, or t
  misc_feature (568)..(568): n is a, c, g, or t
  misc_feature (583)..(583): n is a, c, g, or t
  misc_feature (590)..(591): n is a, c, g, or t
  misc_feature (617)..(618): n is a, c, g, or t
  misc_feature (629)..(629): n is a, c, g, or t
  misc_feature (631)..(633): n is a, c, g, or t
  misc_feature (637)..(638): n is a, c, g, or t
  misc_feature (640)..(645): n is a, c, g, or t
  misc_feature (647)..(647): n is a, c, g, or t
  misc_feature (681)..(681): n is a, c, g, or t
  misc_feature (754)..(754): n is a, c, g, or t
  misc_feature (763)..(763): n is a, c, g, or t
  misc_feature (880)..(880): n is a, c, g, or t
ggggggttgggtgtagatttggaaacaagaatacnaggtcattggcagaagagtacagtcatgctttgttganatatggggatacattttgaganatgcaggcaattatgnngtgtgacatcaaagcgggnacttcttcgcccgctnaatggtgtggcctactacacacctaggctgttgcgtatagcctattgcccctcggctacaaaccntcgttcagcatgctactgtnctgannncntccggggaggggggnnnnnnggngngggnncntatggctgaacanagggngggnnnaggnacnatngaaananggtantataannggatgggatcgccngcagangngngggctgtggtggagctgaanntcattatgnggggcgtgantgggttnngnttngggngaaggggcgcgnctctncnttcgaaatccccatctctcctcgncnccgcccggatcctatccatngnggngngccnagagagngggagnacggaggggagaacagnccccgggnagtgcagtgnacactccagnnaatacagnnttggaaagggnaanagnatgttgtgtttattntgttttnntgtgaaagtgatatagggtctggatnnaaaaataaagntnnntttnntnnnnnntnattttatcacccagaaacaatcacttttaatgtnctggtagaggttagtctattttaacatttctgaaatcatatagatttacatgattgttctcacgtgacctgtnacataagcntttcccaagttgctattatctgttaataacagtggtttgattaattggattggctgtgtggatgtggaacggaagagccttgatgtcaagaagagctgaagcacagaaggtgcagtnggttatttgggacatattgtctgttgcttcaggacagggagct

SEQ ID NO: 628088 - DNA, 361 bp, Homo sapiens
aatagtccatcctcttttcgcgagaccagttccccacgcatatattgtcgtgtccattccatgcgtcagttattccctcccccaacacctcccacacatattgtgcgcactttcctaccatcccgaaatagcagcagatagttaccctgtacaacgtaaaaggagcggaatggcgcacagatacgaacatttgcatatatgtgtttacactccatatacattaaacgaggccagcaaagtacacagcactatcccatactcgatatttatatccatacgcacttcaaatacacccattgcatatgcacaatcaaattataagatccaaacctttgtaagcttgcttttcccaaataaacat

SEQ ID NO: 628089 - DNA, 243 bp, Homo sapiens
ataaaattaggtttctgaatctgcaaaactgaaaagtagacaagaaaagtcatggtgaccaaaccaagagagtggtacccaaagagagggccttattagccacctggaatccttctatctcacaatgtctctctaatgacagtatcatttacagaacatatttcaagctagaatttggttgccttaaggaataaaaatgacaacctgggccaggcacaggggctcacacccgtaatcacagca

SEQ ID NO: 628090 - DNA, 422 bp, Homo sapiens
tgaacatttctcatggtttctttgtgtcctaatataacacgagttgtacgtgtacttgggtatataaaaagtgtgtccagataacaagatgcttttgatctaacaatataaattaaatctagattagagctaaattagatttgttatctatttctgcctagttaaagtatcctatcattatagccttttgagtggtaatgctatgttatctggggcaattcagtattgatattcagtggtaagcactcttaattgttaataaagtaaaacacaatggttagcactctttatagtcaatcaaagtaaaacacctgttacgtactccatgaagtctataacctagagtcatttgtatgcttactggtctagaaaccactgatttatacttatgtacttttttctctctctgaagtcgttatctt

SEQ ID NO: 628091 - DNA, 101 bp, Homo sapiens
tccccctttgtaaatttttttcccttcccccccccaacatttttaaaaaccccccctccgaaaaatattttaccccccccccccccaaatattaaaaaccc

SEQ ID NO: 628092 - DNA, 217 bp, Homo sapiens
cttttgctgacagcatttttttcactgattgggagagcagatgtgtttctggcggggatactgtgatctggaatcaccgcttctacttcctttaacactgtgtgctcaagactaaggtcctcaaacacatcttcaatcaccatgtcggccttttcaaaaccttggtaatcaatctgcccagtcaagttgcttgaaagatggaatccctttcaaatga

SEQ ID NO: 628093 - DNA, 870 bp, Homo sapiens
gggatggaaagtcacccgtaagtatggcatgccagtgaaccacgctgctttgaggctctggagtgatctaccaccaatcgtccaagtgacagccctgggctgctctccaggatgtctacaaaatgggtgtattggtactgtccctgttgccgaagtgagactggtgtctcaaaccccggtatgtgtgtcacctttgtgcttccagtcaagtgtacaagggaagtaaaaatctgtcgaaatgcaccatgaagctttgagtgaagctcttcctggggaccaatgttggtttcaattgtcaagaattgtgtctgtcaagggatgttcggtcgtggcaacgtgtgctgtagaacagcaaaaaaagtgaccccaccaagtgaacggcaggtggttcactgcttcaggtgataatcctgaaccaatcccaggccaaataagggcgcggttatcccccttgtatggtatttgccaccacgctcacattggattgcaagtttggctggacgctgagggaacaagattgatccgcggtccgggtaaaaaagctgaagattggcctaaatcttggaagtcggtggattctggcccatgttggatattgttcctgccagccatgggtttgtgagacttctaagactatcactttggtccgcttgctgtccgggatatgagaccgacagtgcgggggtgtcatcacaccgtgggccagaaggttgtggcttggcagttccagttgccgaaggcaaaggaagattatcctaacggcacccccttatactgtgaacgctcaagtggactgccaatcgccaaacgggtacagctccacacaaagcattggacgtttcggggcacaaaccctgcagcctcgtggaa

SEQ ID NO: 628094 - DNA, 360 bp, Homo sapiens
gttatcggcctgctgagacttcacagtgttgcgcatactagtgtgtgatcgacgtgccggatggtagtgaagtatttaattagatagaggtttacaacggtgcatgtcgttgctgatctcctgctcgttgactggcgagcctcatgctggataaggagtctgcgggtgagtggtataagagaggctatccccggccggggacgcgctgtgcacggcgaggatgacgcctcgtagtctgcgttgaagcccgagaacatcatcgtggggttaggcaagccgggcgaggggccgagggcggaacaggtgggcgctgtggagcacagctgggtaggacgcacggtcactgtctttcgctgctcc

SEQ ID NO: 628095 - DNA, 1905 bp, Homo sapiens
  misc_feature (1558)..(1558): n is a, c, g, or t
  misc_feature (1676)..(1676): n is a, c, g, or t
  misc_feature (1811)..(1811): n is a, c, g, or t
tgggggggggaaggtggggaaatggtagggggtatggagagacttggtcatataaggtaagggcgaggggtggaggtgggaaggagaagtgtttttcacaataggagagggtggtatgagagtgtgggtgccgtgtacgcggagaactacggggggaatgcgctggtccgagaatctcaataaagaaccacggggaggtgtataagaagtgatagcggtgttctggggtgagacacaaacaatattgtgtgtgtgtgtgtaagagtgtacacagggggagagagagtgtggtgtgcacaatactgtgtgtgtgtgctccataggagaagagacttgtgagaagggtgagagaggtggtgtgttaactttatatacatactaagtggtagaggggggatcaatctgcgacggctgtactctagacagagacaataagggcgcgagcaacggggtggcacacgggggggcgcgaacaatccccgagagaggatgcgagagagcgcgcttgcgagaccaccataatgtctacgggagaaacttcacacactctctccgggagcaaaagcgtgctccacgacaagcggggggtagatgcatcaacgggaagagtagggagcaacaaaaacggtgagaagacaagatgtgttgatggacgaacacgaacatagaacaatcctcacactataatctataagttggtgcggcccctacaagggtggtggctccacatcgaggagctgggcgaccagaggcgaaaggataaactccacacgacgagggggcgtggtgcacccccatacgtagagagcggaagatagtggagaagacgacaaaaaccggcgagtctgaagaagagcagcaacaagtgtcccaaccagtggcgcgagaacaggccaacaacagtcgatacgcaagcaagcaaacagacgctgctgccaacatgcaaacgaaagaagactagtaacaaacaagactcggagaagaggccgaaccccagccgatgagagaagcgccactccccaccacataatcagccagaccagacatctccagtatgtaacacgtcgggcgtagaccacatacaacagagacccttcctcagcccagaagaagagacacacagaccacgaacgacaaaacacgaggcagacacgcacagacacccagtgcagacaaccgccagacaggacacgaagagccaacaccaccccccgcccacaccaaccaacaacgcagaaatacagaacaaaaaaaacacggcacacaacacgcacacacgacagcagagcctagacaccaacgaaacacaaaaaaaccacaacacaaacaagccagccccaacaacggcatgaacaagcacgacaagaccacgaccaacgccgcagtagcaaaaacacaaacaaatgaccgagaaaagagaagaaggaaccaacaacagccagacaaaacaggagaaaaccaacgagagccagaaagacaaacaagccgaaaggcgcgaacggaacgcacgagaaaaggtgcaaagagagggggcgacagaaacaacacacacacactnaaggcagcgagccgagacaactcagagaccgcaacagtagcgccagcacaacagacaaccacaacgacggacaacaaacgaccagccaagagacaagaacgcaaccaccacaagacanatacaagccgaaaccaagcaagagaccaatcagtacaactaacggcagcaagcacgccactactacacaccagacggaacgcacacatcacacaaacacagcagcagaccaacacgacgtcgcttgggtacgctnaacaaacaaaacaaacacagaaacgagacacgaacgacgacgagcgacgcgaacgagaagaaccgcacacacaacgacgcaaaacaccgacatg

SEQ ID NO: 628096 - DNA, 936 bp, Homo sapiens
attctagaggccgaggcgggcagatcacaaggtcaggagattgagaccgtcctggctaacacggtgaaaccccgtctctactgaaatacaaaaaattagccgggcgtggtggcacatgcctataatcccagctatttgggaggctgagtcaggagaatgcttgaacccgggagacggaggttgcagtgagccaagatcgtgccactgcactccggcctgggcgacagagcaagacttcgtctcaaaaaaaaaaatttagccaggtgggtgcttgtaatcccagtacttcaggcagacttgaggcggggaagaatggcttgacccgggaaacgggaggttgccggtgaggttcgagggttcaacacccttctggattcaaatccaagctgggcaaacagaaacgaagatttctatgtcaaaaaaaaaaaacaaaacggttaattgggggcccaggtggtggctggttttaaaaatataattggggaactgtgggggtaaattatataagaaacatacactttttttccccccaatttggggatttctcagttatattccaggacagatttttttggaaaagggtttttcttggccatcgagggaatggcgtgaggcacacttttttcacaacattattcgattggagccatataaggcggggggtacaggcttcaggtccttggggggggttattacaatattttaggacaacggtagaattcttggggagacaggtaatacggtcagtgggaaattgcattctaacaaattttcttgttttacctggttagggccttacaggttatattcaggggggcttaaaggggggaggtccccaactttttggcccaagagggtgaggtgaccgtgggcaatacaaagggttgtgccccagcgtaaacatggtgtgtgggataacaatcttttttcagagaa

SEQ ID NO: 628097 - DNA, 1013 bp, Homo sapiens
  misc_feature (869)..(869): n is a, c, g, or t
  misc_feature (872)..(872): n is a, c, g, or t
  misc_feature (876)..(876): n is a, c, g, or t
ggaatcttattttattttattttttctggcctggcacagtagcttacacctgtaatccaagcactttgtgaggtcgatgcgggtggatcacttgaggtcaggagtttgaggccagcctggctaacacggtgaaacccggttgtctggcaccgatgacagactcgtcagcgagagccaaaccaagcccttcagtgagtcacacaaactgtggagtttgaactgaacatctacaaggagcgtggaggctgagcttctcaagagtcctgcttgctgtgccaggagcattcctgtggtcctgtcagggtgcctgggtggggcttcactctgggctccagaagctactgctcaaatgccgcatcctctcagcaggacaaccaaaagctggctgggagccaaaagtcatgacgtgatgtgggagcaaattacagaaactcttgggcaggagctgagggcttgagtgtccaaatgagatacagcctcctcttcctgatcccattcttttcctcttcgaaaggttctttgtgcattttaaattcaaaggaagggtttggacaaaagggaggctgttccatccagaaagcgcatacttgtcagaacaagccgtctgccagggcgtctggcagggaagggctgggggccacgggctgacttacctgaagtcctcgggcagtggcaggggcccagagcacctccccactgtgaatcagaaggagggcattcctccactgttaccagcatctccatctccaccaaaacaagccaagcctttccctttcccacgttcctgggtcgagaagcaggtgtggtcctttgcagcaagctgacatcaacgaaaaacacattccttggcccttcgattcctgtaatcnccncgtntctgaggctgagttacacctgacctctgggtcagtccctgtttactcatccgcacaacccactcatttatcagataatgacccagcccttggatgtgactcctgctcggccccaggaggtgttcggttgagcggaga

SEQ ID NO: 628098 - DNA, 859 bp, Homo sapiens
gctaagaccttgcgttcatgtattcacagcccgcctctgagtgaatgtactatcatctctttaatgacaggaaattggggccccaagaaacttgatcttggtggcctcaggattgctgtgggacgcttgagagggccagctttttccttgggtgtgcacgaccccctggaccaatggtttcacacaggcgtcaacagaaagccttcgggctccaccacgtggcgtcatgaacgcttgaaagaacaaaaacaaaaatttctttggaacaggggcttctagaaagcctaccttttgtaaaaacaccatcccccaaaaaggcctctacgctaatggtggcctcttctcatcccttggacccgcctttaactcctattccattgcgttgggaaaacgcgcataccatgtagcgtacccccctttagtgggtggagcatagtgtggcgccccttttgtgcgatccctccataagtaaacacccccccccacgctgggtagtggcgcgtcacaaatatggggccgaaaccccccccgattttacctttttgtgtgagtcagccacgtttatctccccaacagaggaaaaactttggtgcaccaacacgccgaagcggagaaaaatagtgagtgccacctgtgatgataccccattgtgcgggtggacgtgcccaacgattgggaacgaatcagcacgctggtgtcgataaagctaacccccccccacttgtgtgatggcggacgtagccggaccatattaatcaacacacagtggagttgtgtggtgcggacgaaaccagcacccgacacaatgagtagctatgtgagtaattctacaccaacacccgttcttcttgtcggggtc

SEQ ID NO: 628099 - DNA, 961 bp, Homo sapiens
ggaatcttattttattttattttttctggcctggcacagtagcttacacctgtaatccaagcactttgtgaggtcgatgcgggtggatcacttgaggtcaggagtttgaggccagcctggctaacacggtgaaacccggttgtctggcaccgatgacagactcgtcagcgagagccaaaccaagcccttcagtgagtcacacaaactgtggagtttgaactgaacatctacaaggagcgtggaggctgagcttctcaagagtcctgcttgctgtgccaggagcattcctgtggtcctgtcagggtgcctgggtggggcttcactctgggctccagaagctactgctcaaatgccgcatcctctcagcaggacaaccaaaagctgaagtcctcgggcagtggcaggggcccagagcacctccccactgtgaatcagaaggagggcattcctccactgttaccagcatctccatctccaccaaaacaagccaagcctttccctttcccacgttcctgggtcgagaagcaggtgtggtcctttgcagcaagctttcagtaagagaagacatcagaagcaagcaagcgaataaataagccagataggttctgtgaataagaagggcctcggagaacatcaagactgggagaggggcttagtcctctctgaggaagggacgcaggccttagggatgaagggcaagcacatttcaagctcggtcccctgaggaggggagcccaaaaggaagccgtgatggggggttcgagctgccggtgtgaaatggaaggctcagccagacgaggcatgtcctcgctcatcagacacaggcacgctctggcccagagcaggatgcctcgggcctggcctccacccatggggcttcctcctctgaggcagagaactttgaaaagaagtcacccacgtggcttgcttctaactctcccagaaaggcagcaaatgtggc

SEQ ID NO: 628100 - DNA, 316 bp, Homo sapiens
ggaacagctcccctatctgtaatgcgggaagtagtcttaagagtggttataaatatcgttgcatactatgggctttatatactcgatgttttcataggataataatctcatgacatgctcctgtggtcctctaccaaggccttggagatacggcagcccggtacggtgagaatatgatgaggcgttatattgacccatgatatggtaggcttgcgtgggtcatgctgtgaaggcgctgctactgttcctgcagcttgtgcacgggtaccagggtagcgttgcacgtgccggagcctatcgcctgtgcagtatggct

SEQ ID NO: 628101 - DNA, 885 bp, Homo sapiens
taaaaaccctcatcaataaatggaaacttacaaaaatagtcaaaccaattctacaaaatgccagttacaaaggggggggtttcaaacccaaagtgattttgggatgtaaagtgaaatattagtgggcggaatgcaagccacaatagtgacgaaagttgaccccaatactgacgtgaagtccggtggaacgccgtggtggtctaccaaaaaatgtgtgagccgttaaatgccgtcggaaatggtgaagggcaacctcgaagtactcgtgaggcttgtaggagggtacacatagagcacccagtaaaatgtgctcataccccaggtgcttgaattacttgggttgacggtgggtgttctcttatcaaactatggtgtgagctcaggtgattggataactccttgattgcgatgtaataacgggattgttgtatcaggcagtggggcacttcctaggggcattaaaccgcggggtcgatcgcctgtggtggggcccattgccctccaaaatggggggagacgcggcctaacgctggacgttgtgacaaggatcagaaacttcttggggaacaacaacacacctttcgggaggtaaacaaaataggatatatccccgaatacaaaaggccctacatagggaccacgcgtgggtagtgtgggacgcgccttgggacagaagcctaccccgcagcatacagtcgggccccacacgggcaatcaggccacgagatagcaggcacaaaaagagccgacaatcaacagcagcggacatgccaacggaaacgcgactcacctctgtgaagaccaaaggccactcaagcaggccaagcagagcccaaggaagggaaaggagacgacacacacacactaacagcatagtgaatcacc

SEQ ID NO: 628102 - DNA, 1273 bp, Homo sapiens
ggaatcttattttattttattttttctggcctggcacagtagcttacacctgtaatccaagcactttgtgaggtcgatgcgggtggatcacttgaggtcaggagtttgaggccagcctggctaacacggtgaaacccggttgtctggcaccgatgacagactcgtcagcgagagccaaaccaagcccttcagtgagtcacacaaactgtggagtttgaactgaacatctacaaggagcgtggaggctgagcttctcaagagtcctgcttgctgtgccaggagcattcctgtggtcctgtcagggtgcctgggtggggcttcactctgggctccagaagctactgctcaaatgccgcatcctctcagcaggacaaccaaaagctggctgggagccaaaagtcatgacgtgatgtgggagcaaattacagaaactcttgggcaggagctgagggcttgagtgtccaaatgagatacagcctcctcttcctgatcccattcttttcctcttcgaaaggttctttgtgcattttaaattcaaaggaagggtttggacaaaagggaggctgttccatccagaaagcgcatacttgtcagaacaagccgtctgccagggcgtctggcagggaagggctgggggccacgggctgacttacctgaagtcctcgggcagtggcaggggcccagagcacctccccactgtgaatcagaaggagggcattcctccactgttaccagcatctccatctccaccaaaacaagccaagcctttccctttcccacgttcctgggtcgagaagcaggtgtggtcctttgcagcaagctgacatcaacgaaaaacacattccttggcccttcgattcctttcagtaagagaagacatcagaagcaagcaagcgaataaataagccagataggttctgtgaataagaagggcctcggagaacatcaagactgggagaggggcttagtcctctctgaggaagggacgcaggccttagggatgaagggcaagcacatttcaagctcggtcccctgaggaggggagcccaaaaggaagccgtgatggggggttcgagctgccggtgtgaaatggaaggctcagccagacgaggcatgtcctcgctcatcagacacaggcacgctctggcccagagcaggatgcctcgggcctggcctccacccatggggcttcctcctctgaggcagagaactttgaaaagaagtcacccacgtggcttgcttctaactctcccagaaaggcagcaaatgtggc

SEQ ID NO: 628103 - DNA, 934 bp, Homo sapiens
caaacgcaatggagatgtgagggctgctgcggctgcagccctctgccctgctgtcccctgtgccgcggtgtgatgcgcgcggaccatgccctgctgatctgcccgtgggctgccgttgtccccgcacctggacgctggcgcgtgtgtgcgcgccccagcctcgatcgctcgccgtggcgactcggcccaggcttccggcgccggtgtgtgggccctcgctctccatggggctgagggactggctgagaaccgtgtgctgctgctgccggtgcgagtgcttggaggagcgctgccctgcctgataaggagcccctcgtcagtgattaacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagttggcaggaaggctcaactattgatatccattacccttgctggcagggttcgaagggcaagtaaggaaacaggattggaacttgcatcttagaagatacaggtttccaaaagggaacgctgactcttaggtggtcagtgacttaaactcaagcacccatcagtgaattctaaaaaacacaacggaaagctcgagaagatgtgtcacaaactggctgacgaaaccaatattttcccaacaaggtatgggagctctcaggagagatttctctttcaaggatgagaccgcgtcatcatttggaagcttcgatgcatagcagaaagagatccattaagggccatgctcgagtcgaaacttagccccaaaggaaagcctgggagatccaaaggactgagaagacggccagtaaagaacttggcactaccattacgttccaaatccctagaacacc

SEQ ID NO: 628104 - DNA, 737 bp, Homo sapiens
  misc_feature (7)..(7): n is a, c, g, or t
  misc_feature (10)..(10): n is a, c, g, or t
  misc_feature (42)..(42): n is a, c, g, or t
  misc_feature (62)..(62): n is a, c, g, or t
  misc_feature (68)..(68): n is a, c, g, or t
  misc_feature (90)..(90): n is a, c, g, or t
  misc_feature (119)..(119): n is a, c, g, or t
  misc_feature (125)..(125): n is a, c, g, or t
  misc_feature (131)..(131): n is a, c, g, or t
  misc_feature (163)..(163): n is a, c, g, or t
  misc_feature (170)..(170): n is a, c, g, or t
  misc_feature (191)..(191): n is a, c, g, or t
  misc_feature (199)..(199): n is a, c, g, or t
  misc_feature (204)..(204): n is a, c, g, or t
  misc_feature (208)..(208): n is a, c, g, or t
  misc_feature (216)..(216): n is a, c, g, or t
  misc_feature (280)..(280): n is a, c, g, or t
  misc_feature (289)..(289): n is a, c, g, or t
  misc_feature (366)..(366): n is a, c, g, or t
  misc_feature (374)..(374): n is a, c, g, or t
  misc_feature (382)..(382): n is a, c, g, or t
  misc_feature (403)..(403): n is a, c, g, or t
  misc_feature (414)..(414): n is a, c, g, or t
  misc_feature (420)..(420): n is a, c, g, or t
  misc_feature (439)..(439): n is a, c, g, or t
  misc_feature (463)..(463): n is a, c, g, or t
  misc_feature (470)..(470): n is a, c, g, or t
  misc_feature (487)..(487): n is a, c, g, or t
  misc_feature (521)..(521): n is a, c, g, or t
  misc_feature (528)..(528): n is a, c, g, or t
  misc_feature (544)..(544): n is a, c, g, or t
  misc_feature (552)..(552): n is a, c, g, or t
  misc_feature (559)..(559): n is a, c, g, or t
  misc_feature (575)..(575): n is a, c, g, or t
  misc_feature (578)..(578): n is a, c, g, or t
  misc_feature (598)..(598): n is a, c, g, or t
  misc_feature (602)..(602): n is a, c, g, or t
  misc_feature (610)..(610): n is a, c, g, or t
  misc_feature (613)..(613): n is a, c, g, or t
  misc_feature (616)..(616): n is a, c, g, or t
  misc_feature (633)..(633): n is a, c, g, or t
  misc_feature (653)..(653): n is a, c, g, or t
  misc_feature (664)..(664): n is a, c, g, or t
  misc_feature (720)..(720): n is a, c, g, or t
taaaaanaanatttaaatttattgtttcacattagtttgaanaaagcacaagccaagagggnttaaanatcatttgcagaggtccaagcntctttacaattacagggcaggggcatcancaaccnagtccntgacttgcagccaaaaaaggcaaaagggctgngtgaagngacagaagagcacaccccacncatgtcangagcnaggnatcaaagncgaagaacagtaacagtcttgacaacagccccgtaagaattaccccgcagtaaaccccaacccngaatggggnagaatactgaattagctgagcacattctggacacaattctgaccaatttcagtctcatgatccctgtgggggcaggnttcattcnccaattcncttttacagaacagcagaacncgagccttcanaaaagngattaacggcctttccgcntcttcatttttcccccagccaccntgttccngacaccaatagcacccnctgtgtcatcattatctccagcatcctctcgcgngcgtttnttcttttctccatgcncccttaantccattngggcaaacctttgggnttnagcgacgcgttctgtcagcntcanaaccccancanccngtgttggaaaacctggnagtttcttcccaattaagtnttctatgcgcnggaagagttccacatcatactgtgtgaaaaaagtaatagcctttccggggcgcccngctctagctgttcgacc

SEQ ID NO: 628105 - DNA, 1219 bp, Homo sapiens
ggaatcttattttattttattttttctggcctggcacagtagcttacacctgtaatccaagcactttgtgaggtcgatgcgggtggatcacttgaggtcaggagtttgaggccagcctggctaacacggtgaaacccggttgtctggcaccgatgacagactcgtcagcgagagccaaaccaagcccttcagtgagtcacacaaactgtggagtttgaactgaacatctacaaggagcgtggaggctgagcttctcaagagtcctgcttgctgtgccaggagcattcctgtggtcctgtcagggtgcctgggtggggcttcactctgggctccagaagctactgctcaaatgccgcatcctctcagcaggacaaccaaaagctggctgggagccaaaagtcatgacgtgatgtgggagcaaattacagaaactcttgggcaggagctgcctcttcgaaaggttctttgtgcattttaaattcaaaggaagggtttggacaaaagggaggctgttccatccagaaagcgcatacttgtcagaacaagccgtctgccagggcgtctggcagggaagggctgggggccacgggctgacttacctgaagtcctcgggcagtggcaggggcccagagcacctccccactgtgaatcagaaggagggcattcctccactgttaccagcatctccatctccaccaaaacaagccaagcctttccctttcccacgttcctgggtcgagaagcaggtgtggtcctttgcagcaagctgacatcaacgaaaaacacattccttggcccttcgattcctttcagtaagagaagacatcagaagcaagcaagcgaataaataagccagataggttctgtgaataagaagggcctcggagaacatcaagactgggagaggggcttagtcctctctgaggaagggacgcaggccttagggatgaagggcaagcacatttcaagctcggtcccctgaggaggggagcccaaaaggaagccgtgatggggggttcgagctgccggtgtgaaatggaaggctcagccagacgaggcatgtcctcgctcatcagacacaggcacgctctggcccagagcaggatgcctcgggcctggcctccacccatggggcttcctcctctgaggcagagaactttgaaaagaagtcacccacgtggcttgcttctaactctcccagaaaggcagcaaatgtggc

SEQ ID NO: 628106 - DNA, 527 bp, Homo sapiens
  misc_feature (527)..(527): n is a, c, g, or t
ggaaaaaaaaaaaagagacagattcttttactgttactcttttgcaagtcttcttaagcattattatgttttacaaatgtctgtatttagccagttcttgtttttctttcaatgcagctacaaggacactggctatgcaaggtcataaattatgttatgctatagattacatgacctgtcactgtatgattaactgcttttgtttggcatctgtacgacagcgtataaaaaccccactttgtcttcgttcagtcctcagctttttggatatgaatcgtctgagccagtgcgtacctaaaatataaacaaatcctcctgtactctcataaaaaaaattattaagcaatcttctgtgctaagtaaagaaggctcttgccaggcgcggtggctcacacctgtaatcccagcactttgggaggcccgaggtgggtggatcacttgaggtcaggagttccggaaccagtctggtcaacatggtgaaactccatcttactactgcttgaggaagcccgtgacataatctctcn

SEQ ID NO: 628107 - DNA, 1206 bp, Homo sapiens
ggaatcttattttattttattttttctggcctggcacagtagcttacacctgtaatccaagcactttgtgaggtcgatgcgggtggatcacttgaggtcaggagtttgaggccagcctggctaacacggtgaaacccggttgtctggcaccgatgacagactcgtcagcgagagccaaaccaagcccttcagtgagtcacacaaactgtggagtttgaactgaacatctacaaggagcgtggaggctgagcttctcaagagtcctgcttgctgtgccaggagcattcctgtggtcctgtcagggtgcctgggtggggcttcactctgggctccagaagctactgctcaaatgccgcatcctctcagcaggacaaccaaaagagggcttgagtgtccaaatgagatacagcctcctcttcctgatcccattcttttcctcttcgaaaggttctttgtgcattttaaattcaaaggaagggtttggacaaaagggaggctgttccatccagaaagcgcatacttgtcagaacaagccgtctgccagggcgtctggcagggaagggctgggggccacgggctgacttacctgaagtcctcgggcagtggcaggggcccagagcacctccccactgtgaatcagaaggagggcattcctccactgttaccagcatctccatctccaccaaaacaagccaagcctttccctttcccacgttcctgggtcgagaagcaggtgtggtcctttgcagcaagctgacatcaacgaaaaacacattccttggcccttcgattcctttcagtaagagaagacatcagaagcaagcaagcgaataaataagccagataggttctgtgaataagaagggcctcggagaacatcaagactgggagaggggcttagtcctctctgaggaagggacgcaggccttagggatgaagggcaagcacatttcaagctcggtcccctgaggaggggagcccaaaaggaagccgtgatggggggttcgagctgccggtgtgaaatggaaggctcagccagacgaggcatgtcctcgctcatcagacacaggcacgctctggcccagagcaggatgcctcgggcctggcctccacccatggggcttcctcctctgaggcagagaactttgaaaagaagtcacccacgtggcttgcttctaactctcccagaaaggcagcaaatgtggc

SEQ ID NO: 628108 - DNA, 170 bp, Homo sapiens
cttcagtattaaacacatacatacacacacacaaaagcacatcaaacattcagatagcctgcaattgtggagacagcactcccagtcattgggtggataagaacatggtcctttttctgcacggacattactccaagttcgggtgtcagcacactcttgcctcacccaca

SEQ ID NO: 628109 - DNA, 116 bp, Homo sapiens
gttctcccccaaacagaggggtctgaggaagccgcagagccccggatggacacaccagaagaccaagatttaccgccctgcccagaggacacgaatgttcaggacacgaatgttca

SEQ ID NO: 628110 - DNA, 350 bp, Homo sapiens
  misc_feature (67)..(67): n is a, c, g, or t
gaggtgttctgtgacaccactgtgcgccaccgcgatagatgtgtccacgagctcacacgctcacagngcgcctctgaaatagtcgcctctcttctgatactctgagacctcgtcacacgagtgtgtctcctctatagtgctctcacgagagccccacgagcagacacatagaggtttgtgaagagtgtagtgtcgcggcacgagtatgtgtgtatagagcgctacgtgtatatcttctccccacgagagacgcgcggcagagtatgagcggctcgtgcaacgcccgtgcgcgtccaacatttcttcgcagcagacggcgggagtcaccctacgtatgctggctaacgtcg

SEQ ID NO: 628111 - DNA, 102 bp, Homo sapiens
aacagaccttctaagcttcttcaaggacacattcggccggggatccacaatcacactcctcgtccagtgtcaatgaagccattgccacactcaggaggatga

SEQ ID NO: 628112 - DNA, 368 bp, Homo sapiens
  misc_feature (291)..(291): n is a, c, g, or t
gagatggagtctcgctgtcgaccaggctggagtgcagtggtgcgatcttgggctcactgcaagctcccgccttcccagggttcaagccattctcctgcctcagcctcccaagtagttgggactacaggcgcccgccgaccacacctcagctaattttttgtatttttaggtagagacaggggtttcaccggtgttagcctaggatggtctcggatcgtcctgaccgtccgtgatccagccatgccatcggccgtcctcaacaagtggctcgggagttatcaaggcgatgangctaggccagcgcgccggccaatacctgtgtgttggtgttaacgacacaagttaaactatatggttaaagtttttgg

SEQ ID NO: 628113 - DNA, 338 bp, Homo sapiens
tttggtctaaatatggttgacaattctgtgaagtgcctttttatgaatattcttggttaagctatggcacctgtctttcgaaatccttaccttttaaggataaaatgtgacacttgggaaatagcttgtgagaaagcccctccctttattctttaaacctttaaatgacaaatctaggtaattaacgttgtgaattgctatgtctgctttgattttaatgaacatttgtctttcagaataggattgtgtgataatgtttaaatggcaaaaaccaaacatgattttgtgcaattaacaaagctactgcaagaaaaataaaacacttcttggtaacacat

SEQ ID NO: 628114 - DNA, 192 bp, Homo sapiens
aagatacacggaagactgtgggcgtggagccagcagccgacggcaaaggtgtcagtggtggtcattaagctggagatcctggccagctggaatgcctgccacctcctatagtgcggaccaccgctcacacaagaatgctctgcgccacgctacagcagcatcacgacacatagatccagcaagaacaagtac

SEQ ID NO: 628115 - DNA, 326 bp, Homo sapiens
  misc_feature (184)..(184): n is a, c, g, or t
  misc_feature (234)..(234): n is a, c, g, or t
  misc_feature (295)..(295): n is a, c, g, or t
tgctgctggacgaaataaatgaaaaagcttctggccggggtgcaaagttgtcacgcctgtaatccccagatctttgggaggctgaggcgggcggatcacgaggtcaggagatcgagaccatcttggctaacacggtgaaaccccgtctctactaaaaatagaaaaaattagccgggcgtggtgncggcggcatgtactcccagctactcaggaggctgaggcaggagaatggcngtgtggggtgaacccgggaggtggagcttgcagtgagcagagatgatccactgcactccancctgggcgacagagcaagaccccaacttcaa

SEQ ID NO: 628116 - DNA, 338 bp, Homo sapiens
  misc_feature (28)..(28): n is a, c, g, or t
  misc_feature (55)..(55): n is a, c, g, or t
  misc_feature (108)..(108): n is a, c, g, or t
  misc_feature (116)..(116): n is a, c, g, or t
  misc_feature (145)..(145): n is a, c, g, or t
  misc_feature (183)..(183): n is a, c, g, or t
tttcggcacagggcgacctgcgcgcagnctggtggccagggcgtgactcctgganagcgcgccttctactacaacgcgcggcgctggacgaccaccagacggtgcgcnacggctgncaggacggctcggtgctgctgctcgtcangaccccaggtagtctgggttggaggaggcagagcattnaccaaggggacctgggtactggctgaaggaataggctggggtagagggcacttttggaaggcacttctcctgcctcccgggagcctagatctcactccagggtctgggttcccaggttgaccatgaaaccctggcctgaccagctgatgcacact

SEQ ID NO: 628117 - DNA, 218 bp, Homo sapiens
ccgtgtggtcttgagagcaaggctggtactcctgtagatgggcactccacaagcaggcccatgcgtgtggttcgccagtcgaggcagatgttctgctggcacagagggctgcgtaggcctgcagactggcgcactccaggctcgagcccggcatgaagcagctgtcgaacacgcaggcatcgtagtagtgctgcgggggcaccagtgcgtggcactgg

SEQ ID NO: 628118 - DNA, 404 bp, Homo sapiens
ccgtgcggcggcgcatgatgatgcactccgggcgcaaaggagctgacattatgtacacgggcaccgtccactgttgcaggaagatcttcattgatgaggggggcaaggcctttttgaatggtgcgtggtccaacgtactgcggggcatggggggcgccttcttgctggtcctgtacgacgagctcaaaaaggtgatctaagggccgaggactgctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatc

SEQ ID NO: 628119 - DNA, 303 bp, Homo sapiens
gcagccaacagccaagaaacctctccgcacccagttctccccgacaggttaagcgagccgtggttgtttctcccaaagaagagaacaaagcagcagaaccaccaccacctaaaatccccaaaattgagaccactcatccaccgttggctccagcccacccacctccagaccggaagcctcccctggctgctgcctaagggtgagcctaaccccgggccccttgggtagcgcgtggccgccccaagggccgggtggcgctgggggggggcggggccttgtgggcggggaacgtgggtggtgagg

SEQ ID NO: 628120 - DNA, 120 bp, Homo sapiens
ggcggaccatgatgtcacgctcatcgttataaccttcttcatcctcctcctcctctccactcacgtctcctcttcaccttcctcctcctcatcctcgtcctcctcgtcttccactacctg

SEQ ID NO: 628121 - DNA, 754 bp, Homo sapiens
agcggggggggcagaatagttctgcgaaggaaggacggtgtctgtgcttcaattcctgtcatgtacggggtctagaaaagaaggagggagtgccctgccgatagaacttatagctgcgctctcgaaaatgtctctacgtgtaccgtaggacacaggtgtccatcggggccctgctagtgacgtgagtcgcatggcagtgcacttagagtatatcaatgaatgactaagtggatttatttcccgtatcatgctcgggctgccccagattcgtgcccgcaccgattacgtgatagaataggttaaatccacttggagtgtcaggctagaaagttgaattggtgagtttagagtatccttgaagattataaagacacaagtgtatattgtatggaggtataaaagtgtagcatgcgttcagcatctgggtggagagcttggactatatttcttccgagttgaactggggaccatctgtgaagattgagattctacgcgatcacatgataggtgctgtgagcagtatgaacataaatgctcgctggaaattgactatccagatttttatatggagctagtcagtgtagaaaagcgacgattgtaacttataaacaagtatagttcaagaagtgggcaacagtttatattgtacgaaatgcagtgtagagctagattaaaaggcaactctttgcatagctagatctgcccgttttggaagagttaccttgaacagagaatcgttaagggtttatacgaa

SEQ ID NO: 628122 - DNA, 151 bp, Homo sapiens
tgtccgggttatacggatgtggtggaagaacagactgattgctggtttggctgtggccatcagggagtgacccacagtgtatgagatcaggccaggaagaggcacagccccccaataaccatcctactggcccgacatccgtactggcccg

SEQ ID NO: 628123 - DNA, 718 bp, Homo sapiens
  misc_feature (215)..(215): n is a, c, g, or t
  misc_feature (668)..(668): n is a, c, g, or t
  misc_feature (673)..(674): n is a, c, g, or t
  misc_feature (682)..(682): n is a, c, g, or t
  misc_feature (692)..(692): n is a, c, g, or t
  misc_feature (712)..(712): n is a, c, g, or t
ttttttatttttgtggggggggggggaaaaaccccccccttcctataaaaaaaaaaaccacatttttttgtttagaaaaaaagagaaaaaaaaaaacccctcccccccccccctcctttttttttttttaaaaaaaaaaaaaaaaaaagacacccctctcctctttgtggttgaaaaagaaaaaaaaccccccccccccctcccccaatattcanaaaaaaaaaaaacacaaaagaaggggcgcgccccaacaaaaaaaaaaaaaccggcgggcgccccctttctaaaaagaagaaaaaggggcccccccctttttttttctccccccccccctttttaaaaaaaaaaaaaaacaacccccgccccctcccccccccccccggggagaaaaacaccccccccccccccacgagggtgggggggaaaaaatatttttttttttcacccccaccccccccctgggggggaaaattttttttttttccccaaatggtggtgttttatggccccccccccccccccccccccctccttagggggggggggggcccccaaaaaaaccaccccctccccccccccccccaaatttccccaaaaaaaatgggcggggggcgcccccaaaaaaaaaaaattttccccgggcccgtgacaagcccttcattccttgntgcgnntgcaaggnccactggggntctacagccctgcatgtggncctcgt

SEQ ID NO: 628124 - DNA, 1736 bp, Homo sapiens
cgatcctgcgcggttgcttctctgcgcagtcagacgcttccttttactcgtccgctcctgccgttcctctccttaccgtaacgctgcgctgccgtccaccccgactggaacgcatctcgactgcgacactggcaccactgcagccctcctgcagtgcccccagcaacttacgtcctctctctcgcgctctgctgcacacccctacacacggctccgtaaccacacagcactttactccaccctctctacacgcgcttggcactacacctgcactgcacacacactgcacgccacccgaggctcgtactcgctctttacacgcaaaacccgcgctccacgctctccaaccgcgggcccctggcctggcgacaccacgcgcacctgcacggcgtctggcacaaccaccttcagcctccgcaacaccccccacgcaagacggccacacctgcacacttctacccgcacaaggcgcccacgcctccccaaacccttctaacacaccgcctaacaccaacccttgcggcccacaccccttctccggacaccaagcacctggctgcgcttgaataacccaaaggcccacctacaacctgtcgagcatctaatcaccacccaatatggcggagcagaagaccacttctactggcaagaccaacttaacaaacacaccacctagcgcccacggccctggcggctcttccttctctacacacggcggctactgccacaccacgcctagcctcgcggcatctccacacggggggcgccccaaagccatgcgcgaccttacactccccaacgcgctggcgcaaacccaacggcacgaaaccactccatacccacctcacgcccctaggactggcgcaacgcacgaacacgccacctggcccaccgcacaccgcccccacgcacaccgcaaccttgacacacagcaaccgcgcgacacagcgcaacggcgccacctagcctcggcaaaccaacgcgcttctccttcatacaacctatacttacacttccctagcggcaacacacaacgacctcgcgcctccccttgctcgcgcctccccatgctgcacgcgggcctagggacgctacaccgcccaacaccggggccttcccccaacccacctaccacacacacccacggctacaccacaaccccttagccacatcgccctgcacctgccacacgccacatgaacctgcaacccgacacgccaacctcgacactgccaccaccaagccggaacagacctgcacccgcaccccaccctgcacagccaccccgactgccaccccaccccacaccgccacgcacctccaccagcacacccccccgcccccaccccacacccacacccccacccagccacgcaaacagcctcccacacccgaaccgacactacccccccacgacgcgccaacaccacccgcacgccacaccgaccgccctacacacgcctcacgcaacccggggtcaccacaccgccacctctcaccaccgaccagcccaccgccttcacacaccacccacacacccacacacagaccacacggcgaccaatcacgcacacctctccctcacacgccaacaccacaccgacacaccagacactccaataccaacaaaccccacccaaccgagcaccactaacacatcagccacggaccagcgaaccccatcagccacacacacacctaccaagcacaacctaaataccacaacacacgcggct

SEQ ID NO: 628125 - DNA, 388 bp, Homo sapiens
gacttgcggcactgtatagtgctgttgttcatcatgtcacttcttctgtgagatcacatgctgtgcttcgaggctttttccttgtggaggcacgaggtggtaggtcacttgtaggcatggacaagttgtgtgccagcaatgcaagagatggagacacagtgttggtagccagtggaggaactgcagaaactgggctcatgatatgcattggttctacttcttctttcactttaatttcaggaacgggaggtgccaagacggaggaaagactgccacccacagtgaccgatggaggtggtgcagctgcaaatggtggtgatgggtggagtgatggggaccgctccaggaatggttgaaagggcaacggctggttgtgacgagtgcccag

SEQ ID NO: 628126 - DNA, 154 bp, Homo sapiens
gcagatactctgactggagatgtgctggaagatgcacgagagacacgaggaggcttggctaagaagacgattagagagagtagggttggagggttgacacatctctggatctacgaggaaaagagtaggtttggaggaaaagcaatcaaggtgc

SEQ ID NO: 628127 - DNA, 390 bp, Homo sapiens
  misc_feature (90)..(90): n is a, c, g, or t
  misc_feature (125)..(125): n is a, c, g, or t
  misc_feature (383)..(385): n is a, c, g, or t
caaaaggcttcacatgaaacaaatgcataaatgattgccctcctctgtttccatggttcacctaagccagattaaggtataactgactantccctctactctcctctcacatgtaaattgtatantcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctannnttgaa

SEQ ID NO: 628128 - DNA, 507 bp, Homo sapiens
tgagatcatgaattgtgcactactctggttcttatcacacaaatggagactacgggaaagaagagtgactaagatctctgaagaagggaaaagctagatgactgggccaccagagggaaaaaaagccgcgcagacagaccatgagttagcacttgtggttggcctgggccatcaatgagaagatctggtcttagagccctgctttcctggtgaagggccctgaaatcacctgtgttccagggcaactggtaacaataaataatggttgcctgattgtggggaattagctcaagtggtagagcgcttgcttagcacgccagaggtagtgggatcgatgcccacattctccaagctttattatttagacatcgtggctcccaaacactccaggtctccaaacccaagttaggtgtctggaaacaggatgctgctttggttccaggacgtagggagcaggaaaaatagaagggctggtgatggctccctcttgggattcaggatagggga

SEQ ID NO: 628129 - DNA, 172 bp, Homo sapiens
  misc_feature (76)..(76): n is a, c, g, or t
  misc_feature (162)..(162): n is a, c, g, or t
ttggggcccattggaaaatcgcagggttgcaaaagaatacaatcttacttgcagggggatattctctatactctcntttaatgcatctaaaaatcccaaacatcccctgggtggtgatcacttacagttgtggccacctttattttatgtactttgattaanaaaaaaaaaa

SEQ ID NO: 628130 - DNA, 442 bp, Homo sapiens
cctctctgctcccagattcagcgattctcctgccttagcttctgagtggctgggactgcaggcacgtgccaccatgcccagctgatttttgtatctctgcctcccagaattcccaaatagatgggactataggtgcgcacaccgtgctggctagtttttgtattttttagtagagacgaggtttcaccgtgtcagccaggatggtctcgatctcctgacctcgtgatccgcccacctctgcctcccaaagtgctgggattacaggtgtgagccaccgcgcccggccaatttttgtattttttgtggagatgggatttcgccatgttggccaggctgttcttgaactcctgggcccaagtaatctgcctgcctcggcctcccaaagtgttgggattacaggcgtgagccaccacgcccagccattccatttactttgggcttt

SEQ ID NO: 628131 - DNA, 131 bp, Homo sapiens
ttcagtgcgtaagagaagagcgaattaaagtgacagaagccctttgagagtgcggagtgcgggctgacatgcttgagcccaggagtttgagaccagcctggacaagatagcaacctcacctctacaacata

SEQ ID NO: 628132 - DNA, 229 bp, Homo sapiens
cacaactacatactccaaggaattgactcagtttttgttggttatgtcagaggtgttgaaaccacagcaacaccatcttgaataggggctgggtaaaataaggctgagacctactgggctgcattcccaggaggtttggcattgttactcacaggatgagatagcaggtcggcacaaaatataggtcacaatgacctgatgataaaacagggtgcagtaaagaagccgg

SEQ ID NO: 628133 - DNA, 556 bp, Homo sapiens
tctagaggcactccccagtgtcggcctatctgtgtcttctcatttcatcccgcaggattaccttgagcatttcttacaaggcaggtctagtggtaacaaactccatcagctttgttcgtctgtgaatgccttaatttatccctcatgtttgaaggacagtttggacagacaaacgattcttagttgacagttttttctttttgcactttgaacattttggcccactgccttctggcctccaaagtttctaataagaaaactgctggtaatcctatggattatctcttgcatgtgatgggctgcttcttccttgctgcttttaagattctctcatctctgtctttcaaaactctgactataatatgtctccttgagttcatcttaacttggagctcaccgagtttcctggttgtatatattcgtgacttccatcaaatgtggaaaattttcagtccttatttcttcagatattctctctgcccttttctctttttccttgtttcccacaatgcgtatgtaggatagaagaacctgacagaagggggtaccgagctcg

SEQ ID NO: 628134 - DNA, 448 bp, Homo sapiens
ctcagggaacagacagtttaaagtgaacaggagcccttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctactgagaatcttgaggcactgtaaaatttaagtgtaagacattgatctctaaacatggaatctattctttgtactggatgtccacttaccttaaagtacttatttgcgcccttacaaaaatctatccaaacgtcaactcttatgaactggatgtatggttatacttttaaatgtacattaaacattcctaacacaagtattatatttcttaattttataaaaaattattataatgggcctgctccggcctcaacaagcagagcttct

SEQ ID NO: 628135 - DNA, 879 bp, Homo sapiens
gtatttgtgttttgttcgccgatctgagcgaatgaatacttgacccactcttttatccagatactggccgtcgttattacaagacattcccttgtacctgctgaacttctgggcttgtgagctggatatgcaaaaaatggttcccctacttcttggtgggtgcctgtaatcccaggtacttggaaggctgaggcaggagaatctcttgaacccagaaggcgaaggttgcagtgaaccgagatcatgccattgtactctagcctgggtgacaagagcaaagactccgtctcaaaaaaaaaaaaaaaaaaaaaaagagaacgcagaaagatgagggaaaacaaggagcacacacatggtgtttgcaacaaaggcagcaccattctgaaaccccccgtggagcacacaaagagactcatcacaccacacatagacccctctcaaacacataggtgacgaaacacaacaggtaatagcaaaaacaccactacacccaattttgaacccaaacacatatcacctcctccaagaaattctcctaagacaacaaacaaaaacatcttgtaaaaacaccatatataaacaaaatacaccctaaaaatgccatccaccacatactcactccacgtatatcatcaaaaataaaataaaaccacataacacaaggcttatcaaaaccaacacaataactattctacgacccacatatacataaaacttaaatattaacaaataacaacaaaaataatcatccgaacacaaaaaatacttaatagtatccacatatagcatattccccaatacttcacccaaaaataattactaaaaaaatacaccacaaaagatggtccatattaaacaaagcatatacaatatataaca

SEQ ID NO: 628136 - DNA, 96 bp, Homo sapiens
ggggggggcgggtttttgggggggggggttttaacctcttcccgcccccccccgggattcgggggccttttggaacccagggggccccttgttagc

SEQ ID NO: 628137 - DNA, 762 bp, Homo sapiens
ggagagaaagcaggaggaggtcggggagccagccatctgcgcccgtgcccctacggagccggtgcacagcctggggaaggggcacgcagcccccaccaacgtggtggagaaccccctcccggagacagactctcagccattcctccctctggtggcccctttagtgagccacagttccacaatggcgagtctgaggagagccagagcagttcctgaaggcgctgcaaacgccgtcaccaccttcgtgaacccgcataagagtaaccacatcgtgggccgcagcatcaccaatgactcggccgtgctctcactctttccagtccatcaacggatgcacccgcagtgtctggagcttgtcaaccaagcttggacgaagcgcagggctgtactatgaggggggttgccagaaccaaggctgggcacagattccggattccccggggggccgcttgaagttgccttgggcgaaagagccacccggggagaagctttccgccgggcagtgcccgaatggaaggccagatcgcggcccagggcccaagaattccatggtgggcccagaaagctgtggagaataaatgcgggggcagcaaagaacgcgccatgagtacccttggagggtgtccagacggccacctgtggacaaatccaggcgtgcctgcaactgaagcacggagagaaggacacgggccatattgcggggttgtgaacacgcagcacgcgaagggctccacattcgcggccaaatggcccggttttccc

SEQ ID NO: 628138 - DNA, 762 bp, Homo sapiens
ggtttttttttgggtgggtgggtggtttttaacaggcggggtctcactatttgggtccaggctagaagaatttctaatggtctataacacctcccgtttgggcaagtaaatccagaataatttaaggtcctttggtcatcagtagtttggcagacttaaaagtgtaaatttagaattagaagatgaagctatagtagtaagaatctcaagttggaagggcttgggggagccaaagcagcatatagagcataggcttgaattaaatctcagctcagtcacctgcaggattttaggcaccagtgattcacctttctgagcctgttcttaatccgtaaaaggatttataataattcttcacagcgtggtgaggataagtgaaatgtgttaaatgcctactacagtaggtgctcagatattatcaatttttcattatgcacattgttttcctgcttttaatggctgtctaaagtctagggaaaagggaagactgtaaaggatgagtagaaaaactgtgtaagctaatcatcaatggacttatttgccttccattttgtgttctaaaaattaggcacacaaaaggaaaccaaattttaagatgggaaagaagaagaaatgggtgtcagggctctaagtattgaacttaaggtttagggaaacgatttggtttgaatgaacatagaagtgtggctccctcactggaaggggacctgggggggaaacttggctgcaaatgttctggctttcacgtgtaacgacacgatg

SEQ ID NO: 628139 - DNA, 1214 bp, Homo sapiens
gaatattatccctaatacctgccaccccgactcttaattcagtggtggaagaatcggtctcagcaactgttgtagtctatcaccattaggccatttaagtttagtactcataagactggttaatgaatagacgaactgacatcgctacacagagcctctccaggaaggaatacggacgtaatgttctgtgtggaccactgtatgtgtccttacttttcttgcgtgtaggcaggtgtgtaagtatacttcatgcttgttgtaaccatgccatgtacttcttgtaaatgtggcagacatccgagagcatatgcacgctagacacagactttgtttcacaggaacacttgtttgacgaccccaggttaatagaacacgttcaatactgaggaacaagaataacagacaatatatatacatagagatgatgagcacctatcaaccgagatgacacaaaggaagaaatataaaacccctaagaactggatagtaaaaaagaaccagaacggtggagacacatattcacacaaaaaacccggaacacatggatccctaggattgccgtccgaggtttaacaaggacttgagatcgtgactgctggcccaaagcgagggaagccgattttcgcgaccactgaagtctgcctatgaagaaagcggggggaccttttcaccaagggaaggcgggtgtctgtcatccgaagtgttttaccgacacaagcgcttcaatttgaaaatgaaccacaggaactttttgaaagctggcgacacagcatgggtcggaggatgctttcccgatagagaggcgatcggaaagccttgtcccaatagaaggaccaatttcccgaccggtgccttcctgctggaagggaacagccaatccagcgacttgccaaccaggagaaaagacgcgcacttgagaggggagcctaattggaaaggttgaacacccaaagggtattgtacccaactgggaggaacggccataatccactgacaagtcccaccccggaagacggcgtgcggcaggactatacgcgggaacggcccccagatcaccccaggcgcgagtttccaaagaaaatccccaacaaattttccacggacgctcctatatccccgggcagcagaagactctggacagggctggcccatcttcctcgcccccaggagcctgggggtgcacctcgtggggaccccccgttggtagggggacc

SEQ ID NO: 628140 - DNA, 308 bp, Homo sapiens
cagatggcctgctttattttatacgaagagtttgctatcctccgggcactcttaaagtctggcattcacggctggagtgtatagggcccatccacttctctcccagcaggtgcgccagagcctccatccggtcagagccaaataactatgtgggtttggccatccacatgggccacggtagatgggcagcccaaaggctccatatcttgcaggctgcctcagtgctctccttgagctggttctaacacctattggtgtcgcgctcttttccagaagtccctgggcttgttctgccagacataacagcc

SEQ ID NO: 628141 - DNA, 849 bp, Homo sapiens
cgcgcgtcatgtctcccgatggtgggagcgttcttcttctaagcggcgcctccgtcctggtgtcagtagtcgagcacgatcggttggttcgtgcccctgggtggttgtcttgcctgtctcgccccgcgcgccccgctcgcgcttttggtgcacgcccactcgtttttttccgccagtcactccttcgttgatgtgtctgctccgcgcggccggccttttttttttttgtttcccgcccgaccgggggggttaccatctcccctctctgtgtttatctgttgtctgcggctcgctaaccaacgtagttgtttcggtacgcgacgtcctcctttcggcggcgcttcgataaatgccttctgctctcgacggaggtctctcctttgtggttccccccccatagttgactttgtttggaggagtttctcttcgaccatccacctgttcgaacctgcgtctcgtttcatcgccccaccccgctttgtgcactcaccgtgcgtggggtgatatatctcattttttgtgtgtgagacaccacatctgtttctctttcgtctctagttaatactcatctatctcatctctctgctccacgagagctcgccaacatcattattctcacgcacaccacaccattcatctcatcctttcatacacatttactccaccacgacacaccatggcggcgtcgactcacactcacacacacccacaacactcttcacaacaaagagttatcaccccctctttctccccgccgcatcaccccccccccttttttcaccccttcccccccttttctctcccctccccccccccccccccctctcccgctttttttttttttaaata

SEQ ID NO: 628142 - DNA, 2009 bp, Homo sapiens
  misc_feature (1812)..(1812): n is a, c, g, or t
tgggtgggattttgcccgtccggtggtgtcgaccgaaacttgctctgcgccgtctgtttgtttgtggtttgtgcgcggcgtcgcccggtgattgttctgtccctcgggtgtgtccttcatccatattgcgggtttatgtgtcttgttgcgcgcctcggtcgtcctggtttgttgtctcccaccctggtgtgtttgtcttacgtctgcgccgctgagcgtgttttgtgtgacacaccctgacgttaccttgttgtcgttcagggggtgggctgctcccttcctctgtatggtgatcgtcttccgtctggttcgttgtgttgatactgtccgtcctcttgtgtcaatgttgtgtgtgggtggggcgccctcctggcgactacggtggtgtttgtgtctgtataggttggctagtatatgggtaagtgtgtgggggccctttgtgtcatttgcttgtcgaaacccacccgccgggggggagaagtggggctgtgctctctcgctcgaatttgctgctttgctggtgtgacgccaacatgatgtttggtggctgccgtggtagttgtgtgtgccgtctttttgtgtgtccgtctgtgtgcccagcacttgcttgtggtccgtcgtttgcagtccactcagctgttggtttgggtgcccccccctcgttgggggtgtcctggccgccttcgtattataatgcgctgcttgtcgaccatgattgtgtggtgtggtggggaatgttgcacctccgcctgtcttctggcctccctcgttgttgttattcccccctgggtttcttccccccccttgcgcggtgaggtaggattatggtctcccgtctttgctggcgcacgagcatggtattggttgggttgtgtcaccgctgttcccgctgtggggggcctgccgtcgtagaacctgcctttgtgcgtctgcgcgctgcttgcgtggtgccgccggatgtttgtgtccgctcagcggttttgggtgtattatattgctttgcccatctgtgcgcacaccagcgttgggtggaatatgtgttgttttctgtccgtgtgcctctcagtgtcgttgtatgtgtgtccaagccattcgtgtggcgttgttgtccggcgcgtaggatgtgtctgttctctcctttaggagaggcgagaccacccccttcttctgtctgtggtggtttggtcggagtagtggtctccaccaccatgcgttggtgtgggggtggggttcgctaccaccaacggtggtcgtcgcgcccacacacttgttgggggtgttgaggctccttcatgagttaggggacatcatgatatccccctgcgtgttcttcttctcgtggggcgctgttgttcaccgcggccgccccaccggggggccccctgctggtttgttctgcggggggagatcccctccccccacatcgcgctccgatgtatctgcgcgccttggatgaggcgccactacttgtcctctcattagagaggtgttctcctcgtcgtcgtcttgggtgtttgtgttataagagagtacgtctgcccgcgtgttgagaaatgtgttcccacgcagagggcgcacgccacactcacaccgtcgtgtgtgtttctctgctcacgcgtcgagggctcactccacgcggtgatagacacacgggcgccacaatttctctgtgtgagaacttttgtatactctctcgttgtgttgataggcggagaagagaagtctgcccatgtgtgggccccacgcagacgtttgtataaaccacgccccttgaattactcttgggggaaacaccgggggaagggaataatngagaatggaaaaccctcgttggctgcctgcacctcgtggtgtgccctcttggcctctggcttgagatgttgataactcgtggggattcaccttttaaggccctggcccgtaggatatcccccccgtggcacctcggagacacccgtttgcatctgactgacccacggacccattcgtccggttcctggagcccaaaa

SEQ ID NO: 628143 - DNA, 529 bp, Homo sapiens
gctgccaaaatggtgtgtattatgaaatcctgacacatgctacaacatggatgacctttgagggcattatgctatatgaaataagccagtcgcaaaaggatgaatacagtgtgatcttacttgtatgaggtacctagtgtagtcacattcatagagatggaaagcagagtggtggttgccaagagctgtagggaagagggaatggggagttacattttagtgggcacagagtttcagtttgagataatgaaaatgttctagagaaggatgagagtgatggttgcacaacaatgtgaatgtacttaataccactgaactgtacacttaaaaatggtttaaatgatgaatttttgttttatctactttaccacagtgttttttaatgttaagaagaggaaaactttcctggtttttccaaagaaaaagtgttaatagtttaaaataccaccataatacattttagtgacaatcagttaaaatttcttagtagtctcaggatctaaaacaaaagtacaatatttttaaaaga

SEQ ID NO: 628144 - DNA, 498 bp, Homo sapiens
  misc_feature (77)..(77): n is a, c, g, or t
  misc_feature (84)..(84): n is a, c, g, or t
  misc_feature (107)..(107): n is a, c, g, or t
  misc_feature (109)..(109): n is a, c, g, or t
  misc_feature (143)..(143): n is a, c, g, or t
  misc_feature (150)..(150): n is a, c, g, or t
  misc_feature (379)..(379): n is a, c, g, or t
  misc_feature (484)..(484): n is a, c, g, or t
  misc_feature (493)..(494): n is a, c, g, or t
ctgctgcttttctaacactgcgggaagcttcctggcaacttggtggtagaattactagagaaccgcagctatctccnccagccnagctgtggtattccaaaccaaangnggcaagcaagtctgcgctgaccccagtgagtccngggtccnggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcncctatggggatggtccactctcactctttctctgctgttgcaaatacatggataacaccgttaattccatgtgttttcataataaaactttaaaataaaatgagnaaggaaaanngaac

SEQ ID NO: 628145 - DNA, 753 bp, Homo sapiens
  misc_feature (433)..(433): n is a, c, g, or t
  misc_feature (447)..(447): n is a, c, g, or t
  misc_feature (738)..(738): n is a, c, g, or t
agaactattctgtctaacaagcgtgcctgacgtcgcactcacggtcgactaataaaagtatctcaaggactagacagagtaccagcactaagcgcgctttgaagcttctaggagcgtcactaccatcactaaccaggagtattaaccaactgagagatcctaatgcgctagaacaacagttcacctgatcaattgaggactctccgacgtacagagactcacagacttagaacagaccgttacgtactgtacgtatggaccacaacacattggggctcactcgcccaccacattaacaacataaaaccctcattctcgcgggacgactcggtcaagttgatacacctatccagcatgcttatgctatccgtcaaccttgacatcaattccggcaattcctcttatagtgagtcgaattacattcacttggcgncgttttacaacgtnatgaatgggaaaacgctggccgtctcgaaccaaatggctttggaccacagcacgcttttgccagcgggcgaaattccgagaaagttggcacaattcgcctttttaaaagggggtccaactgaatggcgatggattcaaacgcggaatagttaaaacaagtgcgggccaaatttaggagattggggaaattcaatcatacggcgggttggtaaaaaactgccaatccaagaatcctccccagcgaatgggagaacagtattaggacggcgcaatgacaacctatagtatagnccggcgaagcttcca

SEQ ID NO: 628146 - DNA, 181 bp, Homo sapiens
gagtagagaagttcaccatgttggccaggctggtcttgaactcctgacctcaggtaatctgcctgccttggcctcccaaagtcctgggattacaggcgtgagccactgcgcccggcctagattaatttttgatggagtgcatgttatgtacagtggaataggagacatttgtgagttagtg

SEQ ID NO: 628147 - DNA, 96 bp, Homo sapiens
acaacaacccaactatagatttatatatatatgtattatagttgttccttctaagcttaagaagtctctaataaaatccataattccttataaaaa

SEQ ID NO: 628148 - DNA, 361 bp, Homo sapiens
  misc_feature (22)..(22): n is a, c, g, or t
  misc_feature (32)..(32): n is a, c, g, or t
  misc_feature (41)..(41): n is a, c, g, or t
  misc_feature (60)..(60): n is a, c, g, or t
  misc_feature (69)..(69): n is a, c, g, or t
  misc_feature (91)..(91): n is a, c, g, or t
  misc_feature (112)..(112): n is a, c, g, or t
  misc_feature (127)..(127): n is a, c, g, or t
  misc_feature (166)..(166): n is a, c, g, or t
  misc_feature (262)..(262): n is a, c, g, or t
  misc_feature (298)..(298): n is a, c, g, or t
caagagctttagagcgagaganagaaagaaanacacacacncacacaccctcaacgcagntagagaganaaagagaatggcgagccaaggngttgcctccatgttcgctctngcattgctcctcggngccttcgcctccatcccacaaagcgtcgagtccatcggngtgtgctacggcatgagcgccaacaacctgccggcggcgagcaccgtcgtcagcatgttcaagtccaacggcatcaactccatgcggctgtacgcncccgaccaggcggcgctgcaggccgtcggcggcacnggcgtcaacgtcgtcgtcggggcgcctaacgacgtgctctccaacctcgccgccagcccagct

SEQ ID NO: 628149 - DNA, 246 bp, Homo sapiens
tgtactcatgtagggggaaatgatctatatccattgctccagtttggttgagctgttcccctccaacttccccctcctgaaattattctcaggcaaattccagagtgggatattatttcattaggcagtctaagtaagaatccttgttcttttaagagatacagactcatatcttgcatattgtatttttccatcaatacctattatcatccccttcattcgtttaatatcgttcaaggtatctag

SEQ ID NO: 628150 - DNA, 354 bp, Homo sapiens
ctcagagatcctaacactggctggaacctctgactcagagcatgtctttaaagagtccacatctggccaggcgcggtgcacatgcctgtaatcccagcactttgggaggccgaggcgggtggatcacgaggtcaggagtttgagaccagcctggcaacatagtgaaaccccatctctaataaaaatacaaaaaattagctgggcgtggtgcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaa

SEQ ID NO: 628151 - DNA, 170 bp, Homo sapiens
cacgccagtatatttacgtatggaatagacgtattacacacgagcatatttcacctccgctaccataatcatcgctatccccgacgagccacccaaagagccacactatgagccacccaaagcgccccactatgagccacccaacgcgccacgaggagccacgcaatgag

SEQ ID NO: 628152 - DNA, 173 bp, Homo sapiens
ttcgactgtcgactaattgtagagggaagaggttgtgctggtctgcggagtggaggttgtgctggattgtaggagcagaggttgtgctggtggtgggaacagggctggaagtagtaccaggaccagaggttgtgctggctgtagaggcagaggttgtgctggcttgtaggagc

SEQ ID NO: 628153 - DNA, 183 bp, Homo sapiens
tccccggatgctgcacagtcatgaaagggatcttattgaggctccaggccacggggcctgggcaggaggctgccttcaaggaaagaacaaccttatttgagccttcttctctgggacgcaggttgtatggtgtgtccacaccttcttctatgcggcaagttgacaagcacgaagggtgaaagg

SEQ ID NO: 628154 - DNA, 502 bp, Homo sapiens
tcccagtctctggtaaccatacttctactccctatcactgtgtgtaacagatatattttaatgtatagctacccacatattagtcagaaaatagcaatggtagtctatactagtgcctaggattatttaactatagcatgacctccagataccatccatgtagtagcaaatgacaggatctcattcttactcatggctaaatagtactccattgggtatatgtaccacattttcttatatcatgttcatctgagcacttaaggttacttccaaatcttgactgtagtgtgaatagtgctgcaataaacatgggagtgcagatatatctcttgggtgtactgaagttgcatcattatgttaatgaaatgaaatcagtggccaggtggaaaccacgaggtaatcatccatcacagtatggatgctctacaacttaccctgataaagacatcgtgagttgaacaatatcattaagttgacaactgcatttactacacctaatctg

SEQ ID NO: 628155 - DNA, 311 bp, Homo sapiens
  misc_feature (237)..(237): n is a, c, g, or t
ctgtcccggagatgacgagagctgagcgagagtgtgacgaggctggatgaccggctccctggggttcagccgcttctggcctcagcattcgctctccgtgtcccgctccaggggcactggtggcctgggtggtgcatgtggaggagctggctttggcagccgcagtctgtatagcctgcggggctccaagaggatctccattggagggggcagctgtgccatcagtggcggctactngcagcagagccggagcgcagctatagctttggtggcgccgggagtggatttggtttcggtggtgcagaccggct

SEQ ID NO: 628156 - DNA, 987 bp, Homo sapiens
tgggaaaaaccaccgagacattattttaaaaaaaaaaggattttccccccagggggggaaacccgggggggggggccggtccgggggggggggcgggggccccccccgccgccggggggggaaaagagccacccgcgcggggcgagggggaggagagctccgccaggggagggggggcccccaaaacgaccccccaaatagtgacttgctccccagcaaggggtgtgaaaaaagcgactatcacaggcagaggggggcgggcacaccgaccccgtggaaagaaaggagcgagccaaggggataaacgcacaggcggggccagcgagggaggagtggtcagcaggcacaccaccaggcccgagtgatgatgggggggcccccagtggggggggactaccagctgtgtgggggggggggcacccagaagaaggtgtgtgatgtcggcccgcggggtgggagagaaaagaacccccctcccttggggggggggggggggtgtttgcttctggccccatggtgaaagaacagcggagtggtgcggagcaaaacatacatgctggacacttcttttaacaccaggtggtggtcttctgcatccgtcgcacgacagctgtgcacacaaaacacgttcggcgtgagaaaaaatgatcgcagcccccacgtttgtgtactagctggtgggccgcagacgggtttggttcccccgtattagagtgtcggaaacaaaacgtgtgcccttctgggatataagacgccggcgaccacaacggtgcgtccgggtgtgggaccaacctaggtagttacatcaccccgtgttagggagacacgacaaactatagcgtgtggtccccccccaaagtgcagcttcatcaccggggccgagtcccacgagatctggtcgggcccctgaccacgtacaggaagttatcacacggcggcggcaccggaggaagagacgcggctaatgggcggagcagataagaggag

SEQ ID NO: 628157 - DNA, 524 bp, Homo sapiens
  misc_feature (473)..(473): n is a, c, g, or t
atatgtctgtgcaacttcatagatcatggagtagtccatgagcttcggggttagagactcagtggctctccaggtgtaagttccaatatacaaacatgaaacatgtttggagcaacttctttgctaaactgggtaatagtttttcaaatattagaatatttcctcaaaaaaattttttttgctagggacagtctcctgctgtcacccaggcgggggtgcagtggcatgatcacagctcatggcagctttcatttcctggactcaagcaatcctcctgcctcagcctcctgagtagctatactttagttatgcgccaccaagtctggttaattttttttgtatttttggtagagacaaaaaatataaaagaccagccttgttgcccaggctggtctccaactcctgggctcaagcaatctgaccacctcagccacccaaagtgctggaatgacaggcatgccaccatgccctgncaggaggacaaactttggggcagagccaaatttcttcagcaggtgacaaac

SEQ ID NO: 628158 - DNA, 249 bp, Homo sapiens
tgttcggcttgagtgcgcagtgttcccaggtgtcgatcacagcaacacaggctccgagtccagggctctggacacctcccacactcactgggaccagaggcgagcccgggccagctgttccggtgttctaggctcattaagcccctatactgactcccatggtgctgtatatcataaattcacgtatggacatcattaaaataccatacaagcaaaagcactggtgaactctagactacatataacaag

SEQ ID NO: 628159 - DNA, 989 bp, Homo sapiens
  misc_feature (31)..(31): n is a, c, g, or t
  misc_feature (47)..(47): n is a, c, g, or t
  misc_feature (61)..(61): n is a, c, g, or t
  misc_feature (167)..(167): n is a, c, g, or t
ctgcagggcctcaagagaagtcctttctatnaatagttctgcctgcnagccttacctattngactgagtcacttgcttctctgggcttgcagcagcatccagggaggggtgtggtgagagtgcccctgttcccagcccaacagctcctcttttttctcttatgcatnggatttttttttcaagaaacatgcttttactttaacaaaaactgaaatccactggtctacgtgatttctaagatttcctatgtgcttagtcacccacagatgaaggaagatgggacagcaatgaagttatgaaaatgaaatcgaatgcttgtgactgcagttttcccaaggtttcatagaagtggtctggaggctcttcaaggagaactacaaaccactgctgaaggaaataagagaggacacaaacaaatggaaaaacattccatgctcatggataggaagaatcaatatcgtgaaaatggccttactgcccaaagtaatttatagattcaatgctatcctcatcaagctaccactgactttcttcacagaattggaaaaaaactactttcaacttcatatggaatcaaaaacagagcccgcattagccaagacaatcctgggcaagaagaacaaagctggaggcatcacgctaactgaattgaaactttacctacaaggctccgttaaccgagaacagcatgctactggtaccagaacgagattttgaaccaatggacaggacggaggctcaaaaatataccaaatttacactcggatcttgacaacctgacacccacagcaggggaacttcccgtcactaattgtggggaaacggctggcttttcgaaattggatgggacctcttaccttcaaattacagggcacattcgtgacggctcatctaacggccactggttgggcgcatcggaaaagggcacgaggataaagtgcaatgagagtgcgaaacactctcgggcccggcccgctcacctgtccccc

SEQ ID NO: 628160 - DNA, 776 bp, Homo sapiens
  misc_feature (47)..(47): n is a, c, g, or t
  misc_feature (109)..(109): n is a, c, g, or t
  misc_feature (116)..(116): n is a, c, g, or t
  misc_feature (131)..(131): n is a, c, g, or t
  misc_feature (135)..(135): n is a, c, g, or t
  misc_feature (171)..(171): n is a, c, g, or t
  misc_feature (205)..(205): n is a, c, g, or t
  misc_feature (210)..(210): n is a, c, g, or t
  misc_feature (213)..(213): n is a, c, g, or t
  misc_feature (248)..(248): n is a, c, g, or t
  misc_feature (294)..(294): n is a, c, g, or t
  misc_feature (366)..(366): n is a, c, g, or t
  misc_feature (380)..(380): n is a, c, g, or t
  misc_feature (386)..(386): n is a, c, g, or t
  misc_feature (423)..(423): n is a, c, g, or t
  misc_feature (428)..(428): n is a, c, g, or t
  misc_feature (525)..(525): n is a, c, g, or t
  misc_feature (532)..(532): n is a, c, g, or t
  misc_feature (561)..(561): n is a, c, g, or t
  misc_feature (588)..(588): n is a, c, g, or t
  misc_feature (653)..(653): n is a, c, g, or t
  misc_feature (660)..(660): n is a, c, g, or t
  misc_feature (678)..(678): n is a, c, g, or t
  misc_feature (697)..(697): n is a, c, g, or t
  misc_feature (702)..(702): n is a, c, g, or t
  misc_feature (763)..(763): n is a, c, g, or t
agagctgataaatataacgcaaccaatgagtgctgcaggatagtggnacaaagtgtgtcatgtgtctgcatagcttctttgcgccatataatgcattccacacttaagnttctccntctaaaaggcggcgnacangtgaatatgtgctcataaatgtgctgtaaataagtngcattttcatggcaagccctctcatctgccagcnatggntanactcacactattggaaaaaatctaaagttaacaanctggtttagctatggaaatgtgtctatttgttcctcagctatgctntctgtatcttacattagtggctctctagggggcggggggtgacaagagcagcatgttctccaaagagggtgnatcataatccccantgattnagatactgtgcctggggacaatcttccttcaagtccnaatgnatcattataattatcaaccaatggtacatataagagtacggcatgtgctgggacagagaaaagacagtcgacaaacactattctacatgaaacaggnaatcttnttttatgagtcactagaaaactaactgtnatactgacaggctccatccagattatnaaatactacaaaatgagaactgtttcaacaactattcagcataacgtttatggacaaaatgtatntagtatntcttatattctatatgtnttttatcacatagtaaggnatgcngaggtgcttaagccatccaataaattgaaaatacaaactttacatttctacgtttgtcagngtacaggattctg

SEQ ID NO: 628161 - DNA, 470 bp, Homo sapiens
  misc_feature (31)..(31): n is a, c, g, or t
  misc_feature (47)..(47): n is a, c, g, or t
  misc_feature (61)..(61): n is a, c, g, or t
  misc_feature (167)..(167): n is a, c, g, or t
  misc_feature (395)..(395): n is a, c, g, or t
ctgcagggcctcaagagaagtcctttctatnaatagttctgcctgcnagccttacctattngactgagtcacttgcttctctgggcttgcagcagcatccagggaggggtgtggtgagagtgcccctgttcccagcccaacagctcctcttttttctcttatgcatnggatttttttttcaagaaacatgcttttactttaacaaaaactgaaatccactggtctacgtgatttctaagatttcctatgtgcttagtcacccacagatgaaggaagatgggacagcaatgaagttatgaaaatgagtaagtacagctatccataggagtagcggctactaccagcaatcgctctgcttaggtctccagcactgtcaagttactctactggccctnggcttagtcaagactatttgaagataaacttttatctttggttaaagctaatatatttttgctgcctcattaaat

SEQ ID NO: 628162 - DNA, 716 bp, Homo sapiens
  misc_feature (673)..(673): n is a, c, g, or t
  misc_feature (675)..(675): n is a, c, g, or t
  misc_feature (700)..(700): n is a, c, g, or t
tttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaatttttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacaagtgcgagccaccgtgtccggccgattctgaacagttttaataccattgctatttttgngnttttcctgggccttttttttttttnttttttttttgagaca

SEQ ID NO: 628163 - DNA, 158 bp, Homo sapiens
ttatgcacgtctctttgacatccacaagcaagtctaaaagagggcattgcccagactgtgtaccatgggcctgaatcgctcagactacatgtaccagcgcagctgcaatggtccccagccctgaaacatgatcgaaatcaacaccatctctgccagca

SEQ ID NO: 628164 - DNA, 645 bp, Homo sapiens
caccgatccattatggtaaacccaaaggattataaatcatgctactataaagacatatgcacacgtatgtttagtgcggcactattcacaatagcaaacacttggaaccaacccaaatgtccatcaatgatagactgggttaagaaaatgtggcatatatacaccatggaatactatgcagccataaaaacagatgagttcatgtcctttgcagggaaatggatgaagctggaaaccatcattctgagaaaactatcacaaggacagaaaaccaaacaccgcatgttctcactcataggtgggaatttaacaatgagaacatttggacacagtgcagggaacatcacacaccagggcccatcatgaggtgtggggctgggggagggatagcattaggagaaatacctaatgtaaatgacgagttaatgggcacagcaaaccaacatggcacatgtatacctatgcaacaaacctgcacattgtgcacatgtaccctagaacttaaagtatagtaataaaaaaaattcaccaaacaccacaaaaaaaatcaagattgtcaaagaaaatttccacgtcccccgaaatcaaataaatagttagacaagcaggagttaaccagatatggccccattggcaaagtgtcca

SEQ ID NO: 628165 - DNA, 472 bp, Homo sapiens
gtgtcgtctagaggatcccatgcgcgacgcttccatcaagattatgctctgggggcaagaataaaaaaagagaggctagggtgtggtggctcatgcctgtaatcccagcactttgggaggacgaggagagtggatcacgaggtcaggagattgagaccatcctgacccatatggtgaaaccccgtctctactaaaaatacaaaaattagctgggcgtggtggtgcatgcctgtaatcccagctactcgggaggctgaggcaggagaatcgcttgaacccaggaggtggaggttgcagtgagctgagatagcaccacttcactccagcctgggcaaaagaacgaaactctgtcaaaaaaaaaaaaaaaaaaggtcccaggggtatgggattggggccgggggggagagctgctatatcctcgagacggggcacatattagattctcataaagaactcggggtgggaggaacgc

SEQ ID NO: 628166 - DNA, 103 bp, Homo sapiens
gtctccggtgttatagaggatccctgtggagacggggtactaatctgtgtcaggcaggagtgcagtggggcagtcatggctcattgtagccttgatctcccaa

SEQ ID NO: 628167 - DNA, 179 bp, Homo sapiens
aaatcggataacacaggccccagcatgttggagtgtccttggggggacagatcttggggtctacaggtggctcacacctggtaatcctagcactttggggaagccaagattgggaggatcacttgagggccaggagcttaagaccatcctgggcaacatggcgagacctcgtctctata

SEQ ID NO: 628168 - DNA, 674 bp, Homo sapiens
cgtggtggctcacacctgtaatcccagcaccttgggaggctgaggtgggaggatcatttgaggccaggagtttgagacctgcctgggcaacataatgaaacttcctttccagggagaaacaaacaaaaaaacaaaaaaaagaggcctctgggaagagccttcttaatttggggttaaagggccagaaatattaaaatttccctttgtgtggtgccaaaaaaaaaaaaaaaaacaaaaaacaaaacaattgttgtggcggcgcggatccgggccccctagagagagaacgtttctatagaaccaactgggtgtgtgggggccgggaggcgcacaaatatggagtcaaggggacacaggtggcgcaaaaatacgggtgtccccaaaagagaagaaaccggggggacaacggtaacaaacagcggcgcgaggagatcactacacaacaagaataacaaaaaccccgcgaggggaggaacaacaagcaggaggggcggttatgcgggagacaagaactctaccacgaaagaggagagagcttcactgagaggggaccaaaaacaccagggggggcgaacttattacccaacaagagagggggcactcaccaaacagggcaggccaccgcggaacttactccaaaatatataaccccccgggggggtcggggggggcgt

SEQ ID NO: 628169 - DNA, 374 bp, Homo sapiens
tttcatgctgacagcagctcaaaagtctgtgggacaaaactcccaccagggatgggctgggctgccatctttgctgtttcgcagtccttcactgttgataccttctagcctgctgaacaatctgacgtggttatgcactggagtgaacccccaagagactgcagcacccctaggacacagtggccacactctttattatgtgggtcccccttcctgtacctcctcactacacaggtcctcccagactgggtctctaaccacccctgctgtgtctatcaagccagtggcatctatgccactcactgagacaatgctcccagttagaagagtgggatgccatctttgctgtctccaggccctggatcagtccacag

SEQ ID NO: 628170 - DNA, 1845 bp, Homo sapiens
actagttctagatcgcgagcggctgccctttattttttttttttctgagtagaaaaaggcacaattaatgggattacgcagcactttccactcagtgggaactggtgggcgtgcatttccctttcgtgacattgtcacaacaccccacgtggaaatttagcctcccatacattctaagttcgtgctagtgctgtgaacaaacgcaaccaatacaggaaagaacatctcgacccccactctatattctcctccattatatataaccagaggagaagccagagagctgtgcaacacgcccaacagaagaaataggacaagaaaagagcgcgttcactctatttctcacaggagcccgtgggacacccaagagagggaccccaaacacgctctcacgcgtgagaccagcccaagagtgcgtgggaagagaagacgcaacagggcacataaaacgcgggagcagacccaacacagagccacaacaagaagcactcattctcaataacgcgagcgccacccgcaacgtgagcaacatctacaccagtgtatgaagggagaggagtacgactctgatggaggacaccctatcaaacaccacatggagcgtagggcgaccactgggacgacgctaggaaacagtggccaggccaggtaggccgccccaacacagccacctccaggacactgagcgccaaggcggcggcgccacaccaccgagagtggggacaaccaccaccgcgatgggcgccccaacgcacagaggcggccccccagactgctgagtggaccacatctatccaactcactaataataggccgcgacgaaaacggaaccagacgagacaacggaggtaccccccagagaaaacaatcacgcataccatcatcccccagacaccagtgggcgcaacacgctacaacacaccatacacggagactgacgcgccgcgtcagcgaacatactatcacaccccctggatgagcgccagctacccccactttcgatcagccaacaagccccccaaacaggaagaccaatcaagccgttgggagggagaaacaaagacgccacacaggagaggatgacacacgacattcccgcgccagttggcagccaatacccatcacaaggacccgctcataacggaacctcaacacgatggcgcaccccgaggaggaacacacccccccacgggagcgaggagggcacagcctattatcaagacagcgccacacttaaaaacacgaggcagccagaggccaatgtggggagcgggcatccaacgcccggctgccagacacggacctcgtgggccgtacacacaacatgtaaacaacaacaggggcagcagacacacatggattacgtaaaccccccccctgcatactagcccacccaacacgggcgcatcactgccgcagcgaaagagcaaacgacggcccatttgtcgaaaggaccgcatccccactgatgactaacggagtcgccccgacgaaacgacaccctcacgtagcgtgccggacatagaacggcatgtcccagcaaggaggtaaaatggaagcacaacacatctagggtcagcacacctactccagtcacaacaatagggagcacatagtcatgcaccagcaccctcccagtcgcgccggaacaacagcatcctacgaccccacgaggcgaagtcaacaaacaacacgtagacgaatagaggcactactacgagagagaacgcagcaacgaagtgaagcacctaaaccaggagagcgagacccactaaacagagcgccacttcagcagcgcactaacctcaggccgaaaggacgacacacacaccccaacgggacaaa

SEQ ID NO: 628171 - DNA, 878 bp, Homo sapiens
  misc_feature (229)..(229): n is a, c, g, or t
  misc_feature (280)..(280): n is a, c, g, or t
  misc_feature (284)..(284): n is a, c, g, or t
  misc_feature (309)..(309): n is a, c, g, or t
  misc_feature (311)..(311): n is a, c, g, or t
  misc_feature (319)..(319): n is a, c, g, or t
  misc_feature (334)..(334): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (364)..(364): n is a, c, g, or t
  misc_feature (367)..(367): n is a, c, g, or t
  misc_feature (369)..(369): n is a, c, g, or t
  misc_feature (374)..(374): n is a, c, g, or t
  misc_feature (382)..(382): n is a, c, g, or t
  misc_feature (401)..(401): n is a, c, g, or t
  misc_feature (415)..(415): n is a, c, g, or t
  misc_feature (428)..(429): n is a, c, g, or t
  misc_feature (431)..(433): n is a, c, g, or t
  misc_feature (437)..(439): n is a, c, g, or t
  misc_feature (448)..(448): n is a, c, g, or t
  misc_feature (571)..(571): n is a, c, g, or t
  misc_feature (577)..(577): n is a, c, g, or t
  misc_feature (592)..(593): n is a, c, g, or t
  misc_feature (601)..(601): n is a, c, g, or t
  misc_feature (611)..(611): n is a, c, g, or t
  misc_feature (617)..(618): n is a, c, g, or t
  misc_feature (626)..(626): n is a, c, g, or t
  misc_feature (628)..(628): n is a, c, g, or t
  misc_feature (878)..(878): n is a, c, g, or t
gactggttagtgatgcagttagtatagctttatactctctccactttatagctctaataagttgtgttagaaaagtttcgacttattttcttaaagcttgttttttgttcgcccatcactctttacatggtggtgatgtccaaaagatacccaaattttaatattccagaagaacaactttagcatcagaaggttcacccagcacctgcagattttcttaaggaatttngtctcacttttaaaaagaaggggagaagtcagctactctagttctgtggtntggngtatataattttttaaaaaaaattngngtgcttcngctcattactacacnggtgtgtccctctgccttnttntntttttnttnanagacngggtctcnttctatcggccaggctggngtgcaggggtgcantcacagctcatgnngnnnttgnnnctcccaggntcaagctatcctgtggcaccgtcagcctcccaagatagctgggaccacaggcattgcaccatatacgcattgactaattttttaaagatattggaggacggggtctcccgtggtgttacccgngctggntctcaaactctgggnntcaggtgntcctcccatntgggcnncccagagntntgggattacagacgtgaggcagttgatctggcgagttcccgaatcccggggcctttcttaaagagacagtttcgtccattgccaaggcgtggattgcgggtggtgaacattggccgtgggcgtccaaattctgggggccacgagtttttccagcacagccccttttatttctgccagcggggttcgtaagttgtgccacgtggtgtaatcctgggctagatctttgttgtggcgccaatgttgttttttn

SEQ ID NO: 628172 - DNA, 197 bp, Homo sapiens
ttggcaggcacttggggggccctatggcatgaaagcacttggggttggtgaggggacaggggatgtactgcgggactgggcggagccaagccctggggtttggcaagacactagagctggggttgggcaagttgggccccgacagcccagaaggcttttgtagtggcacgcacagtctctgggccgggtctgcatta

SEQ ID NO: 628173 - DNA, 715 bp, Homo sapiens
aagaagcgagagcaggtacaagtccaccagggatacttaactttaacttcaaaagaaaaggtgcacagaggggagcagaaaatggcaggaatcatcatttcccttgacaaatgagatcgtttaaaatgcgagccacagagatctcagggtcttcttaataactccaccccctggagtgtgtaacccaatagcctagcaaaggaacctgacgagctccagggcatacaaccaccataggctctaactcagaatatgattccttacctctcaggaagtgaggagggtagcaaagatctgtcctctgagggtaaaaacgggcttaaatttcccaggccagggacagtggctcacgcctgtaagatcccagcacttagggaggctggggtgggtgggacgtgcttgaggtcaggagttcgggacctaccctgaccaagctagtgctgaaacaccatctctactaaaagtacaaaacattagctgggcatggtggccggtgcctgtaatcccagctactggggaggctgaggcaggagaatcgcttgaacccgggaggatggaggttgccagtgatgcctgagatcgtgccactgcactccagcctgggtgacaagcgagacttcatctcagaaacaacaacgatgaaaggacttaattccctttggtagtgcaacgtcttgcaacatctaggtccgcgtgggggttccacctgtatcca

SEQ ID NO: 628174 - DNA, 426 bp, Homo sapiens
tcctgtctacttaccactttctcagctcttccatttataggaatatcaaacttcaaaagaagacttttattacattagatctgttgtgagttacagcaacagaacagtcttataaaaactaaatttggcaagcttcctattcctctactttcttcctgtgatttttttttttttttttttaaaatcgaaatctcgcctgtgtcgcccaggctgaagtgcagtggagttatctcagctcactgcaagctctgccctccgtgggtcacgccatttctcccgcctaagccttcccgagcagtgggaactacaggcgcccgcaaccaggcccggttaatttttgggtatattaagtagagatgggtttcacagtgctagccaaggatgttctcgatctcctgacctcgtgatctgcctccatgaggggat

SEQ ID NO: 628175 - DNA, 87 bp, Homo sapiens
gatatggcgtgggattgtagtggtggtagctgctacgacctgatatttgactactggggccagggaaccctggtcaccgtctcctca

SEQ ID NO: 628176 - DNA, 304 bp, Homo sapiens
ttctctcgcttcttcattgattggggaattttgaaagagtaattagcttgattcttgccctgggtccaagcgtgtgtgtgcctggtcagaacttgagtctcaggagcagtctcccactaggatgctgtccagatgtaatcagccactgcttagcacatgctcctcgtcccagacttacggcatcatggcccttccgggctggagagggtccagtccagagcacgagactcactgtctctttctcccaaggactcgactcatgcagggtgtttccttctcctgctattttccaccttgttgcagc

SEQ ID NO: 628177 - DNA, 258 bp, Homo sapiens
aagagctccgggctgaccaggttgaggcccgcaggtctaagaccaaggaagcacgcaagcgcggtgaagagcgcctctaggccacgagggaggagatcatcaagattttatccaaggaggacgagaccaagaaataaaacctcccagttggtctgtacttactgggcctctggtgattactatagatcagcctattaaaataaaacaagccttatctggcgctataccttatctggcgctatgccattatctggcggg

SEQ ID NO: 628178 - DNA, 1336 bp, Homo sapiens
  misc_feature (223)..(223): n is a, c, g, or t
agcggagggtggatgtgcagtcatgctgaaggtgccgtgatgagcggcagtcatgtgaaagtatttagggaaagcagtcctatgctctgatcacctgaattagatgacgagttcttggctaagacaccatcgtaagatcaggtctgtgctctaagattgtcgtgaatcttcttgctcgggtctagctatagtgcgatcgtgtccagttactacatcactgtgntgttttgtcgagtccaattactgcagagtgggtacagacgtattagattgtataagaatggagtttgaactagagtgaaccttgaaccacagagcgaacgtgctgtatgtgaacagagtggcaacatgtttggggtgaatgaccgggtcaaagttgtgtggcccagtacctgttggagatggtcgtgaatccctctgcccgttggacaagtacacatactcgtgaggacaagtatgcgagagaccgtagtacgatccgagtcagtctgtgataagcatgtcacaagttaggcttagtttcgaagttcctgtcagtacatgtaccactggttagtttgaacagcagtaacgtcgaattaaagttagtagtgctgtgtgagcaggattgaagaagttcagagggcgccttctgacgagaagggtatagtcgtttgtcgagccagagcagagtgggttatggtgagctaaaataatctgcctgtgaaatagagcttttctaaagccaggagggaagtttggctctggccgtggaattgccccattgtgggttccgtttttttagaccgattcagaaggtgtcccaaaggaagcgcagcaggttgaccttccgtactggccttggtgagaacgattcccagcgttgggagattttctgattgggccccttccagatgcgaaggtttcctcaaaattgacacgtggaaaacttcctcaatggggtcatgttgttggggacgtccaacacgtggcctcggttaaacatcagggtcttgaatgaaattggtttcgtatcgggttgaggagggccgtccctgacgacgttgggaaacgctttgctgggagacgtggtccctttgttgcgaaagaggttgtggcgacacgattggggaagcgatgcttcttggaagtcacttcgatcgccatgatgagtcgtggtgattctcaagcaggtgacacgttttggtgaaactgtgggggacacatttgaccgttgggacacatttttatcttcacggaaaacgagtgcctgacaagacaatggttgtggcctcctgcctgacagtaaatgaccccactgattgaatgcctgtctctggatcttaatcactgcgtg

SEQ ID NO: 628179 - DNA, 902 bp, Homo sapiens
ctgtttgaaggcttactgtagaagtggcttactgtagaagcagcttgctgagcccctccgagcggtccccagaattagctggttcacaacccccacctcccccgccccgctgtgtcaggtgtggatgaggtcgtcacactcagaaggacaggttgtctgcaggtcacaaggggaggcgcagtgggtttgggagctggtgtaggccctggtgtctgagggcccaggccttgccagcctctgctggctcctgctcctgggtttgaagatgtccgaggccgatcgctcagctccgtggtcgagcggtcactaaggacactcctgactgtgccatcttggactcctcaggcggggctccggagatagaagacaggtcgccggaggctccccctcctctcctctcccctctgcagatgctgccctgggcgctactcctgcagggtgccagggcaggagtggtctcgagaaacgtgtcgcttgctgattatttcaagctggggtccatatgtccagattccgtctttgattgtgaaaatatatttttagctttgtagtcttgctagattgtagtaaatgatccatattaaaaatagagaaatacaagtcctttagggaaggttaacgaaacaaaagggggcgttaaaatatcctgaggggccaagtaaaggtaccagggttctgtcaaagtggtcctataggtgagtcgattataagtaggatgccgtgttaacaacgtcgggagggaaactgcaattggtctgggaagacttatctggggtgctatggccctaccaggattaagcaggaataattaggtaggtacacgctgttgaaatgttcgtagataaattaaggatgtaggaaagagagggaggaagcaagagagatagcattaggacctgata

SEQ ID NO: 628180 - DNA, 529 bp, Homo sapiens
gctctagacggatccccgccacagcaggtccaggcacacgtattgggtggattgatactatttttctgagtgtatgtggattcttgtgggggttcataataatagctaacactggctaatatctcaggcactttcctaatcagttagtaggtactaattttctcctcagaacaagtggagatggatactataattataaagggtggtcaaaaggtgcaagagtgaggcacacagcgagacgcagaaaagtaagtggcccacagccacagcagtcctgaggggctgtgggcaagcggggatgtggccaggggcctctgtatcggggtcttcagcagggggctctagtgccggcaataccgggtgacggcccgagagcgggctcttttatcatcctgccagtatgcggactcacaaaatcctccagagacctaaatgcaccgactgagagcagcatcacacagcagcagttgaaaagacaatggcacctgaatcttgagcacttcggacagtttctcaagaagaccagaaa

SEQ ID NO: 628181 - DNA, 235 bp, Homo sapiens
ttgatcagcgatcctcccactcagctcctaaaagtgctgggattacaggtgcccaccacacgcccggataatttgttttgtattttttagtagagacggggtttcaccttgttagcctgggatggtctcgatctcctgacctcatgatccacccgcctgcgcctcccaaagtgctggtattacaggcacgagccaccgcgcccggcagaaatttctctaggatacagtagggaga

SEQ ID NO: 628182 - DNA, 165 bp, Homo sapiens
ttggtttatagttccatccaggagggaaagagggcgtgtggtcctccagtctggagtgtctgcaggtgggcgggcatctctactcagacagtctgttgcgcatcgactccttctcctggagggcggacatggcaagacgcatgtgctccttcaggtgctcccctt

SEQ ID NO: 628183 - DNA, 1161 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628184 - DNA, 1679 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattacaactgcttacatatattgactaggtatactctgcaagtctactcagcttttgttatgatgagattccacttaaggtccgtgtttctgaaacaaatgattttgtggaagttctgatttatggctgaaagagttgcaccattgatggttgaaacttcataattaataagttctcaggtaccttttatagctcttaagccataaagatgatttgtgtttcttttgttgaaatacaggctccctaatttttctttccctttggaattatctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628185 - DNA, 1455 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactcagcttgcttacattaagcagagtaattccagggatgtttctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628186 - DNA, 1383 bp, Homo sapiens
accctcatcaatagatggagacttacagaaatagtcaaaccacatctacaaaatgtgccagttatctcaggcggcggctttcaaagccaaaggtgaatgttgtggcatctgttaagtgtgaaattatttagtgtggcggcattgaaccaaattaggtgagagaaagtttgacccaatataatgtgacgtgtgaagttcccggtggacagccctgtgtgtggcttaccaaaaaatgtgtgtgtgacgccgctagaattgtccgctcgagaacatgtggtgtagaaggagaaatctctcgacacgtatacctctgtgaggcgctctgtgtctacgagagcgtggatataccatataagagagatcccaccacgtatacaacattgtgttatactataaaccggcacagcgtgctctgtggacatctatttatatgtgggtttatctcggcgtgtagtggaatttatctctataatttattacagacctattatagtagagggtggagcgacctctcctaaagggtgttgataattgttggataatatctcttcccctgttgaagtgttctccaagcaaagctataatatattaccgcggcgaaatgttgttgtgttgttctattaggggggaaaccgtgttggcggcagcaactattcttcctgttacggcgtcgctggcatcttctcttcctcgccctggtgtgtcgctgcttggatgtgtccgccatgttgtgctgccggcgaggccgcggccccctacggtgttgggccccccctcttcggcctcattaagactcgtctgtggacgcggaggaggcggttataaacggcggtggcagtcccaccttaaagaagggcctctttggagacaaagtgacgatgggtggtgttcacccacaaacagacggcgggcgtccatacccaaagcgatgaaccacgaatcgatagacaccatccctccctgatttggtaccccggacaaatcgatgcactcacacaactgagcgaaccatcacacgaagcgcgacttctcctcgtttgataacacgtgcggctagcttacatcaaccgatttaacgaagcacatcattaagacgggagcgcaatgcgtattactatcatagcttttccccgcgcacccgggaagactagacttgattgcccgaggaaatgacaagatgtagctacgcctgcgttcgttgctattcatggtcaggggaggcaaaaccacaacgagtagatagaatggtgcagatactagtacgcattggataatatcggagggactgtatgggtgagacccccgcattgtatagtaatgcgcatatcagatacactgagcgcagctctgcagcagccaatctatcatgtggaacaatacccg

SEQ ID NO: 628187 - DNA, 1722 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacgtatcctttgtttcactacctaagactggtcatctctgatggaatttagcggcctgggtctggtttattgatgataatacggtgtaaaaatattacttttttttgtcttgaagagaaggggcttcatttatatggggttattttgcttgcaatgatgtcgtaatttgcgtcttactctgttctcagcgacagttgcctgctgtcagtaagctggtacagaaggttgacgaaaattcttactgagcaagaaataaccttgttgtaattactaaaatttgagaaatgtgattcttgactggaaaaatagatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628188 - DNA, 237 bp, Homo sapiens
acgcaccatgcctggctaatttttgtattttttacagagacagggctttgcattgttgccaaggctagatcctattggttttcaaatggtatatcacatttacttctataatatcttacaattacacttctgtttcatcattctcataacttactattacgtgttcaaccacgtttcaggtatcatttaatacacattgctaggtactaaatgattgctatgtacattattgttagt

SEQ ID NO: 628189 - DNA, 1442 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacaaatgtgattcttgactggaaaaatagatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628190 - DNA, 675 bp, Homo sapiens
  misc_feature (44)..(44): n is a, c, g, or t
  misc_feature (122)..(122): n is a, c, g, or t
  misc_feature (180)..(180): n is a, c, g, or t
  misc_feature (194)..(194): n is a, c, g, or t
  misc_feature (241)..(241): n is a, c, g, or t
  misc_feature (271)..(271): n is a, c, g, or t
  misc_feature (338)..(338): n is a, c, g, or t
  misc_feature (529)..(529): n is a, c, g, or t
  misc_feature (546)..(546): n is a, c, g, or t
ttcgaattggggcggcgaagtgatgctgcgctggacgaggctgntgcgcggcgctggatcgggacacgatgatgtgcacgatttatgagcgtcggccgctgatttgtcgggaattcgagatnggcgcaccggagtgcctgaccgaacgcgaaggaatcgccacggcgtaccgctgatctnaggccagtgacganctcaatgtggaagggggcttgaccccgatagtggtggatcagttggnagattccgcgactgacactccgccatcggngcaagccccctcccacaaggttttgaattacagcggcatcgtgtagtgcagtgagtagctttctacnccgtcgttattgctgctgatcccggcattagagtagtgcgtggcgcgaatgcccacttcatgcccaccggtgaagcgcaggccgaaacccaagcggtcttcgaactggaaagcctggccgatgttgttgtcctccagtttggtacgggagaacaccgccacgccgatcccggcttcgatgtagggcttgancgactgaccggcaaatncatacacaaagacaggcgagaacgacaggctgctggcgcctgcacggtcatcaccttcccaataggtataggcgccgctccaatagccggtcaggcgaccgacatcactttgcattcaagtcttgtccc

SEQ ID NO: 628191 - DNA, 1447 bp, Homo sapiens
  misc_feature (303)..(303): n is a, c, g, or t
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattccccaaacactttttttccccccccccagaaggttntcccgcacggtggtgggactcaccgcgtctggccaggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628192 - DNA, 236 bp, Homo sapiens
tgcagtacggatgtgcgggctctggaccagggttggcaaactttttccataaagggccagacaatagactttttttttttggagtcagagtctcgctctgtcacccatgctgggagtgcagtggcacaatctcagctcacggcaacctcggcctcccgggttcaagcaattctccggcctcagcctcctgagtcgtggggactacaggcgcccaccaccacatcggtacgggccgg

SEQ ID NO: 628193 - DNA, 1447 bp, Homo sapiens
  misc_feature (286)..(286): n is a, c, g, or t
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattccccccgaagcaaggtttnggacgggggctggagactggccgggaaacctttcaactcgcttcttggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628194 - DNA, 211 bp, Homo sapiens
acccccgggcgcgggggtgaaaaaaaaccttttgacaaagggtttttttactaccggggggccgggggggaaaacacccccttccaaacgggggggtatactttttggaaccctggggggggggtcctcttttttttattggggggggtgataattttagggttgagaaaaaggtttttttttaaatgaatccctttattaaattttaaaa

SEQ ID NO: 628195 - DNA, 1431 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccaccagctccgaggtagagtcgggactcacacgctctgcgccacgctagcttaccggaaacactgtgtcgtagacagcgccgaactgtctttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628196 - DNA, 782 bp, Homo sapiens
ccaatctccagaaggtttctgggtgtcttcttttccctcgggtccccttgctgccccgagcaccattgtgtacctctgccacagtgtgctttggttactccatttcacagtaggttcctctatcagcatcttgcacagttgcctagcaacatagtttaatgtgtggaggcaagaagggaggaaattcacaccatgttcatcctactcagtgtgaactgagtctatagttgatatcctctttgtgtcactcaatgttgtcctgcctgagttcaggcttggttcttacgttgcggcagctctttgtgcctttatttaggcaacagaccagaaatagaaacccttgaattttttttttttaatcccttatattttcctggcagcacctgggtagatttctataactactttttctggagtcttggtaacgtataattcacactttaccgggcttacgatctaaagaatacttaatcagggtaattcaaattacaggtcaattggtatggataaggtctggcgtgtggcccagactgttctcggactccgtggactcaaagcagtccttccacctgtggctcccaaagtgcgtggattacaggccgtgggccaccaaattggctcatttttatttctaaagtccgtggcataaactttccaggtttccataagttgtggtgtgggcctgtgtcccaccacatcctggcgggtttatttagggcgctggcccagtggttggaaagctcactataggggtggtgacttggtcccccgaatggcgtaag

SEQ ID NO: 628197 - DNA, 1440 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggctgctttcggcaaacatgtgtcgtggaggccgaatgttcgcaaccaaccccaaaaaaacaaaaacccccttggggtcgcggccggttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628198 - DNA, 821 bp, Homo sapiens
  misc_feature (301)..(301): n is a, c, g, or t
  misc_feature (338)..(338): n is a, c, g, or t
  misc_feature (343)..(343): n is a, c, g, or t
  misc_feature (377)..(377): n is a, c, g, or t
  misc_feature (395)..(395): n is a, c, g, or t
  misc_feature (401)..(401): n is a, c, g, or t
  misc_feature (412)..(412): n is a, c, g, or t
atggagtgctggttgggtgaaaccggttggtcatttttgtctgtttctatagaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttggtttgggaaaanatcctgggggcacccaggagggattggaaaaaaattnctttnctctacagcaatttatgtgtgaggaagctcctcnaattcctcgtggctattnagggtncaaaatcaagntgcctagggaaattcccaagggagtgatttccggggagctatctggtctacctggaggtccctgaacaatgattccccatttaattgagcagtctccagttttaaacccactgtcttgtcccctcatttggcataacggtctcccggggatgttcacagttacaccggtacggttcactttatagaccacaactttattcccattaaaggctaaccttattttccaatatttatgataatctatgtacatatatggtcggtccatatgtattggtaaataggtggtatataaggtcaggttggggtctggggtccaagtgtatatatcccttgtaagttctaaacggcatttggatgaatcacattatgtacctataagattggtcccaaaagtacctgtacagaaact

SEQ ID NO: 628199 - DNA, 412 bp, Homo sapiens
  misc_feature (84)..(84): n is a, c, g, or t
agatccccctttccatcccctaaagggtgtactattcttcatgcaaattaggctgtaggtgtgtaagcaagattcccccttcangcagggtgccaaggaaggtccagccaggctagcccgtagtccccgcagagaagcgtagctctggggagagggccatagagacaggtggtgccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaa

SEQ ID NO: 628200 - DNA, 1266 bp, Homo sapiens
gactagcactagtctgatgacccgctaattcactgacagcatagggctgtctgtagtttttgcgggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628201 - DNA, 337 bp, Homo sapiens
  misc_feature (4)..(4): n is a, c, g, or t
  misc_feature (85)..(85): n is a, c, g, or t
  misc_feature (158)..(158): n is a, c, g, or t
  misc_feature (171)..(171): n is a, c, g, or t
  misc_feature (174)..(174): n is a, c, g, or t
  misc_feature (180)..(180): n is a, c, g, or t
  misc_feature (259)..(259): n is a, c, g, or t
  misc_feature (329)..(329): n is a, c, g, or t
  misc_feature (335)..(335): n is a, c, g, or t
ggantgggcaaccttgtcagaatggattcctacccataaccactgaatcagaatttcttaggtggggagtactcagtaatatttnaatttgtattaagtctctcaggtcaatctgcgtactaaagttggagaaacactgtcctagaacagtggtcctncaactttttgggncantttccncccagaaagagctttttaaaataatgcgcttcttggctgggagtacgtgtcacgcctgtaatcccagcattttgggagnccgaggcaggaggattgcttgagcccaggagtttgtgaccagcctgggcaacatagcaagaccccgtttntatttnac

SEQ ID NO: 628202 - DNA, 586 bp, Homo sapiens
  misc_feature (25)..(25): n is a, c, g, or t
  misc_feature (71)..(71): n is a, c, g, or t
  misc_feature (158)..(158): n is a, c, g, or t
  misc_feature (160)..(160): n is a, c, g, or t
  misc_feature (176)..(176): n is a, c, g, or t
  misc_feature (178)..(178): n is a, c, g, or t
  misc_feature (237)..(237): n is a, c, g, or t
  misc_feature (252)..(252): n is a, c, g, or t
  misc_feature (283)..(283): n is a, c, g, or t
  misc_feature (343)..(343): n is a, c, g, or t
  misc_feature (436)..(436): n is a, c, g, or t
  misc_feature (443)..(443): n is a, c, g, or t
  misc_feature (518)..(518): n is a, c, g, or t
  misc_feature (522)..(522): n is a, c, g, or t
  misc_feature (574)..(574): n is a, c, g, or t
ccaacatgggcaaatgtctacagangaatgcgctgttctatatgtctgtaaggaatctgcccttaactggnaactacagggtccctcggaaagttaaatttaaaaaagatcggccatagccaagttcttcgtggattatggaaaaaaaatggccctgntnggtcttggttcaaaanangggccccggttgaatggaaatgcttctccctggggcaggaatgtcgtggatctggggtnctcgggtctcttggnggcggaagacgccgtctgtgcgtctcccggngctttctggtgcccctttccggggggcttggctgtttctggctcccttggggtgtttggngggtggggtttgtggcgcccttgggccttgccgcgttcttctcgcgctgcagaggtgaattttcggaccagacacaatgttgtcacaatagcnaaaagcnaattgtaggataatacaatatagaagtttcccagccaatttaaaccttccaaagtcgccaagtagatcaaatctngtgnttcccagtgttctcgacatcacaggcagagcagagctcaaaacccagatggncccacaatttcc

SEQ ID NO: 628203 - DNA, 216 bp, Homo sapiens
ctcccgtttccctttttggggttttttttcccctccgaatgggtgaggccccccctgccccgggaggttgggggttgtgggacccggtcccctgggggggaggccccccggggcctgccccgcgggccatttctgtcttcccccccctcggggcccctgtcttgtttttgggttttggtggggggcccggccaaaaaaccgggtttttttgcagga

SEQ ID NO: 628204 - DNA, 270 bp, Homo sapiens
ttaagttttttagacgggggcctgatcccccgttaggtgactttctcctcaaattcagattgcacatggcaattattgggtaaaagacttaatcagacatatttgggttcaaggctcactaatataaactggtgcaaacattatacttccactcattcaatggttgcatcctgccaggcatccagtgggactgggaatatggacacttgaacattaaacatctgaagaattttggaatgacaggttacaagtgaacataatcagttttat

SEQ ID NO: 628205 - DNA, 726 bp, Homo sapiens
  misc_feature (170)..(170): n is a, c, g, or t
tttcaatctttttcttgccagattcaataacaagctttttatggcctgggtgaagcgaaaaaaattcttgtgttacaacaatcacatttgaattgtaggatacttgtgccaaaagcccaggcgtcagattgagaatgaacagtttgctcgtcattgtgtcaaggcaaaanaatagacaataagcatttttaggtagaactctctccataaggcaagtgtctttcagtgagtaaaagctttgacctgtatgtttaattcatagagcaggttaatggtttgctcaacacaagcacgatctattttcacgttcgctttgaaaatatctgtaacgcctatagatcctatagccacagagttttcctttaagactttttccttttgctttcgtgtgatcacatgttttctgttccagtcactggggaaaaacgtgagttgaaggcgtgtgttataaaagctttgattgtctatttagcattcctttgtgggtctcaagatatatgaagcaataaatgtcattcaaggccgtgtgcttattctgaatgcctcatcgggttttataagcggggtaaaaatacttagatgcttaccagtcttgatattagactgagtggcattggacgtaagtttgtccgagtgcatcaggctatataaagtacggcacccgcgaatttgtggctttgttttttgaatagcaggatgtacgcatttcagtataataaatgtttt

SEQ ID NO: 628206 - DNA, 749 bp, Homo sapiens
ccactgcgttcggaggctgtgatctctcggtgggggggccactcgtctgctgacgtgggtgtggcggagggagaggcgatgctgaaagtgtattgtgtgtcccactgtcttgaagctgggcctgccaacgcctgggcccacagctgcaccggaaggcccgggtggaaggaccggttggagggaaccggggctgatgtgaggccctgggccaggtggatgcggctgtgggggcggtgcggcaaatgtatctgcagcaagtatctgcactactctagaaaagtcctcagaagctttaccttggagggtactagcttcctatcactgtccctattcctagacctggggctgagactgaggaatgcgagacggatgtgcccagggagggacccaacgagagcagcaaagacgaaggtggcgtacctgggggtgtcccaggggactcttgtcacgtgccttcagaccaccagcatggaggctgggaggtagaggggagtggggatgagtccggcaagcaccaactggtatctctgagatgcgaaacgcgaagacgaaagcaaccggacgcgtacgtgaaccccacaagtccattgccccccccaagggagccaccctcgcaagcgagaccgcaatcaagacaaagggcaggtgcggatagagcgcggatagaccgaactggccgacaggcacagggccacgtgcaaaaggaaagtacacggggggaacgagccggggttctggctgacaacggg

SEQ ID NO: 628207 - DNA, 365 bp, Homo sapiens
ttgaagtcctcccagatagggtaggagctcttcatgtcgttgactatggcctggaagagcccgcccagggcgccgcactccttctccgccgtctccatgctctggctgggccgggccgcggcggcggctaggcgcacggagcgcggggagcagcgcaagggagggggccaggccgcgcgggcgctcgctccgaggccgggccgggcctcccgcctccaggctgcgctcagcggccggccgcgccgcgctccggggtcgcgggcctccggcgggcggcgcgggccatgtcgcagcggggctggcgggcggcgcggggggcgcggcgcgggcagctcgcggcgcagccctagttctagatcgcgagc

SEQ ID NO: 628208 - DNA, 331 bp, Homo sapiens
cgtcgacactggcgaaagcaccaaaggggtcggcagtgtttctctcgaactctggtactgaagccaatgaggcggccatcaagatctgtttggctcgtaaaaacggacgtatcatcgcccttaatcatgctttccacggtcgtagtctcggcggtctttcgttgacccacaagatcgcttaccgtcaaccgttcggtccctcggctgtcgatgtcaccttcatagctcccgaagacccagacgcattagctagtgagctagacaggggccatgtttccggggtctttatggaacccattcagggtgaggctggggtcgtccccgtcgacgc

SEQ ID NO: 628209 - DNA, 121 bp, Homo sapiens
agagctgttcttgaggatcccccatgctgcagcacggtaaacaattctcctgcctcaacctcccaagtagctgggactacaggcgtgtgccagcagtgcctgggtaattttggtattattt

SEQ ID NO: 628210 - DNA, 775 bp, Homo sapiens
gaaagaaaaaaaattatctttagggtaagttgcacttggacatagtcaatgtatatggagttgtcagctgacgtcaggcatttaccctaaagatcaaatctgtgttcaaatagattgtgccattggccagagcacggttgacccaacacctgtaatcccgagcacttgggaggcctggaggcgtggcggatcacgaggtcgatggggttcaaagaccagcctggccaacatagtgaaaccccgtctctcactacaaaaatacaaaaaattagctgggcatggttggtgtggctgcctgtaatcccagctgcttgagaggctcaggcaggacgaatcgcttggacctgggagtggtgaggttcgccgtggcgagccgaaatggcgccatatgtattccaccccgggtgacagtgcaagactccatctcagaaaagaaaaaaaagacttgtggctttcacttgtccgcgtgtccataggaatagctgtcgagaggccgttgcctagtctagataacagctggggggtataaggggacttccataaatcggtaagcccccacgtagagcatagcgtatgtcgggcgagtcacttaattgaagacccgattttagctcgttttgacatttataactccgtggtccaataattccgcgtagatacatccgtaatggggggctagtgtcaataatatcattgatgaattccccctgtcagtataatgtttacaaatctattggctattgaaggggtgcccttgggggaccaggtgtgaatc

SEQ ID NO: 628211 - DNA, 91 bp, Homo sapiens
gtgtcagagtctgagtcggagtcagagcagcggccaggctgaggaggagaaggaggaggccgaagcgctcaaggagaaggagaagcccaag

SEQ ID NO: 628212 - DNA, 168 bp, Homo sapiens
aatgaaattaactacaatctcaagtactctgaagaagtcctgaagagtacagcccctggttaaaatccatgtgtgaatttacaggcctgaccataggcaattacaatggctttacctggcaggcctcgtggggaaatctgcctttccctcaccagactttatagccaa

SEQ ID NO: 628213 - DNA, 110 bp, Homo sapiens
gggggcctatgaatacttggttgatcttctcatggagtgtgtaagtgatgtactctgtatatcctgaatatgaatattggcctgccttgcaaggttggggaagtctcctg

SEQ ID NO: 628214 - DNA, 1136 bp, Homo sapiens
agcggaacggcggacgggggctggggcgccgagtcccccggctttgggcggtccgttcgctgatgccccttggtgatggccttttcctccgtcctccagaccaggagcttctgaaatgtcatctgacgagactcgacccaagattcgtggggactcgcaatgggccaacgagtttgagaagatgactatggagaagcagaaggactgaacccgaaattctcgtgttctgttgtcggaggcgaattctacgagttgactcacaatgtgcaagcctggctgctgagatgctatgcgaggtctagcttcatctgctagatggcatggctagacacccgcgcacggcgtgagaggccaagccgccgatccttttgtccaactcacagtggtcgagatggactcacgtttggtcctccggtcgttgccctatccctgacctgaggccacaagtggtcgactgccctattcgcaatgggactcgatgctcgaaatcccgagcacagaaactccagctggattacctcccttgaaaagcggtgcgatgccaagtctgacgtatggtcattgcgcgcgtcgaagaacgtagaggacgcttaagattggaccaaaggacgcgcgtctccgtcgcgacccaacaggcttggctagccgatcacactgggggatatggcacgtaaagtgcgtcttcctcgtgtcacgggaacgtaaccccaccagggccgtgtttgaacaactggtaggggggcatgtttcttttgggaaccagaacacgtttgcttgtagaacgcctcccctattagcagtgccaggattctgaccgattgcacgagctgctgagcagagaaacgaccgcgattacccatgcgccgtacgcgagcgggaagaggaaattcgctgcgaccatgggttccaaggccacgagtgtggtccaaaggcggtcacaccccgtggccggagcagcaatggtgtccagacctgggcaatgggacgcaggtggacacatcgccgtgcacgggtgataggcaccggggctaatctccacggcgcggttgacccgtgggggagggcaacaagcggtgtcagaaagccccatggaggggactggtcacacacatccatgcgtacgcacgaggacatcc

SEQ ID NO: 628215 - DNA, 108 bp, Homo sapiens
ccgggcacggaaaacagactggcattaacttcactccagagcgcaagaggcaccaagttctctcctacactctaggagcagaatcttaaacttgcatacaatcactct

SEQ ID NO: 628216 - DNA, 112 bp, Homo sapiens
  misc_feature (21)..(21): n is a, c, g, or t
gtttgcacctcgctgctccanctctggggcgcaattcaaccttcagcctgcgaccctgcggagaaaaaaaattacttattttcttgccccatacataccttgaggcgagcaa

SEQ ID NO: 628217 - DNA, 127 bp, Homo sapiens
cctcgccagtggagtacagaagcttatatactattaatatcttgaggttacagaaagaatggaggctcagagcatagccaaaaacaagtaatggtgataaatcaggtcacagtggcgaggctaggac

SEQ ID NO: 628218 - DNA, 105 bp, Homo sapiens
ttctttaagatataggatttttatttgagagttggggcagaggtgggggagggagtctagacatcttccccactatatgctgtctgaactgagctaaggagctaa

SEQ ID NO: 628219 - DNA, 130 bp, Homo sapiens
aggggggacccggggagggcagggggtttcccaaaaatcgccctggaaaattttataaaaaaatttttgtggggcggggggccagtaaacttcctgggccccgggggtccttcaggagtttttcaggcca

SEQ ID NO: 628220 - DNA, 978 bp, Homo sapiens
cctggactgtggagaaggggatgaaagtagcaaaaaatccagatagtgtgggaaggtatcaaagatatcaacacagggaggagctgtgcagtgagcaagcaaagcaggaaacaagcctattacaaatcaacttgtgattaacctttcagttacctctgccagaactgggagatatttcacaggtgcaagggacagcatttattgaatgtcaatcgaagttccaaacagttccatcagcccaccagttcattccagtttcagcccacgttccaaagcaatttactcattggcggtccaaaaacccaaccataatttcacataacaccatcagtgacatgcatatatatgttagcattatatccaaattggcctgtcgaccaaagaacaccagcacaagcgaccaccatatcaggcacgaaaaaacctatacgaaagtggtacatgcagtcacgggccacaaaggtctctcagaagttgatctatcacagaccattacctaaatacatcaaagatacatcgcaacacatggcaggcataaagccataaccagcatcgtccatgcacatggtggctacaaacctgtcgcagggcaccacagtccaggccatcagcatgaaccattcggcagacattcagtaccagcgcagcacgaacaccttcacacacatgctcacacgcagtgctggcacagctctatcacatcgcacattggcataacctttgcacgaacacagagcacaagtggcatacttgtgcgagcagtcccttacacacatgtcactgcagtgtggccaaggcccttcagctcgcaattacaataccttggtacgaacatcagaaccattccttactaagagataaaaacctccattaaatggtaacaaatggtggtaccgggttaaaaagaaaacaggtccgagccttaacaacaaaactgggaagaattcaatacaggacaagaaccttacacacatggta

SEQ ID NO: 628221 - DNA, 207 bp, Homo sapiens
tatgcgtctcactagtagtaacaatataacgaaacttatggatctgagtatatccttgataatagaatcataaaccatatgaggaacatgaaagcctgcatctactatcaactatgaaaagtgattgacgaaccacttagctatcagatgatgaacactgataagtcatatgtcattactataaattttaaaatctgttaatcagat

SEQ ID NO: 628222 - DNA, 427 bp, Homo sapiens
tgtccctaacacacccttccagttgtccttaaatagtgaaaccagtacgtctttctaaacggaggtttcaagactaaacattatttaagaagaaccgaaatctttgattttacatccgatactttacacaatctaagtcctctatctctggttactttgtgttttgtttattcccgaattattgctacgttcacgatattctaataccattttttattttattcatatacttttcccgtgcgtacttcttaactttcttaagtaggaaccatttaatccgatccagaacaccgtttccgtgggtttcgattacttcttctcatttactataaactgacaatgtatacatatattcctgctttttcttttatatggttatttgtagaagtagttataccttaatttatgtaaatggataaaatctcta

SEQ ID NO: 628223 - DNA, 385 bp, Homo sapiens
atagatagatagatagatagatagatagatagatagatagatagatagatagatagatagatagacagacagacagataggtgataaatagatacatacatacaaagatagatagatagatagatagatagatagatagatagatagatagatatttgtagatagatatttggtaaatcaatggatgtctctattggtacacacgctgtgaatatcttatacacaacagctactcagtaatcattttgattaaataaaatactttctggtaatagaaacacctcatatcagataaaaattcttaaagaaaacaattacaagtactagacagaaaacatttacacacacacacacctatacaccttcaaacaaatgaggtcgacgc

SEQ ID NO: 628224 - DNA, 187 bp, Homo sapiens
gccgcggtatggatgtgtggatctggacgtcgtaataaatgatgtgactgcggctctagcaggaaggcgtctaggccagtctgatttaggaatgtgctgaggagcttagcattttccgggctcagatccgctttgtaccttgaactgatttccccaaatggctctttgtgcaaccgcatcacccgtt

SEQ ID NO: 628225 - DNA, 183 bp, Homo sapiens
actgccggtaggtcatccagaaaacagggaaacacgaaagtctagtagatgccccagaagcccagctcctcctcgaagagcggcccgaacacgtctgcggggcagtgcagctaaccggtgcggtagtaaatgagcacataggcgaagacgcccgggtaccgatagaagaagaactcgcgaccg

SEQ ID NO: 628226 - DNA, 105 bp, Homo sapiens
  misc_feature (13)..(13): n is a, c, g, or t
cttctcaccagcnaagacccacctgcctacattggctacagacccactgtccctcatgctgctgagatggaccctgagctcctagccaaggccaacccctccacc

SEQ ID NO: 628227 - DNA, 226 bp, Homo sapiens
agccaggtagcatattacatgattacacttatatgaaatatccagaatagataaatccacagaaacagaaaacaggctgttgatcaccaggtaccagaggtaaggggaaagaggaaataatcacctactgggtatgaagttttattctggggtgatgacaatgtttttccattacatagaggtggccattgcacaaccctgtgaatttactaaattccagtgaaat

SEQ ID NO: 628228 - DNA, 167 bp, Homo sapiens
aattcagtgcgcccagagtggacacacccctacagcatgttgtatacccagcactgagaggaacacctagccatccagaggggtcaggagagcaaactgaacagaggcgaatgtgctcagaggggtccatggcccagtgaaggaagccctggatagagctccaatca

SEQ ID NO: 628229 - DNA, 2443 bp, Homo sapiens
agctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctca

SEQ ID NO: 628230 - DNA, 301 bp, Homo sapiens
  misc_feature (114)..(114): n is a, c, g, or t
  misc_feature (123)..(123): n is a, c, g, or t
  misc_feature (282)..(282): n is a, c, g, or t
acaaatgagagaatggtacacacttggcatttagaaaagttataccctccctccccggcctttttgtgtgtgtgtgtgtgtgtgtgtgtgtgtgtgtgtgtgtgtgcgcgcgcnccctgttgngaggggagacagtctatcacccaggctggaactcagtggtgcaatgatacctcactgtagcctccaactcctgggcttaagtgatcctcccatcttcgcctcccaagtaggtgggaatgcaggtgtttgccaccacacccagccaatttttgtattttnaaaaattttttgtagagac

SEQ ID NO: 628231 - DNA, 570 bp, Homo sapiens
tggaaaaagtcagggaggccagggggtgggtttgaaaccagcttgggggggttcgattccttcctttttggtctaaatttagtgctatataccggggttcttcgaagtggtggtggaacggggtggggggggcattccaataatagatccacatcacgggggggttaaagtgtgagagagtttcattctatacataattataaggaacatttttgcggccgttcgagaaggcgaaagagggattctctcgtaaatctccagtgcaacagagttatcttacaatattatcacgtgtgcgtggttagaacgacaatgtggaatgtggaggcccatacgagaagtagaataagagaagtgttatcacaagtggtgcggtgatagtgcaactcaggggggataagactcgcggagggaacaaatagaccctttggggccattcagctgtgcacattatacagcggggtggtgcggccccgaaaaactagtgcctcagtgagtgggtgcttcgacggaagagccagaaacatgtgacacatcgaccaagaagggccgggaagaaaacgtccacgt

SEQ ID NO: 628232 - DNA, 3150 bp, Homo sapiens
agctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctcaaaaaaaacaaaaaaagaaaaaaaaaataaaaaaacaaaaagaaagagagagcggcggcgcgcggcaacaaagaagtcccccccgagagaggagccccacagaaaagcgagcgcgacccacgacaggttctgtagcgcgaaaccgggggcgaccctaatagaggagcaggagcgcgaaatatatatacgaagcagacagcaccgagggcgcccagagacgttaataaacaaacgagagcaagaagacagaggagaaacacagcgagcgaaacgcgcgaggagcaccaacttggaggaaagaggagagagacacacaaataaactctactgtaagagaggcagaacggaggcgaccacacatacatatgtgtgtgggccacaaattaaatatcatcacaagacgagagaataattaatataaaagaagaacttcaacatagaggagaaaaacaaatatctaaaaaccactttaacgcaggagcggacaactcggggcggcgactacccatagaaaaggacgaaaaagagacaagagcaaccgcgcagcggaaaaaaaccctaaagcgagccaccccagaggggaaacagagcggctccgcgccacaccacccaatgttactacccaacgggagacatcaaagcacccacaacacccgagccgaaccacaacccaaccgacacacacaagaaaagaagacagcaccacac

SEQ ID NO: 628233 - DNA, 1472 bp, Homo sapiens
agcggcttgtcctggtggcagtagccgggctgaaaggacgcgtgtgttgttctcctctctgccggctactgggcgatgtgctacgccccacgtggagtatccgcgtgatacctcccggaacacaagggagcgcagttcatcctgcgacagacagagatggtcgacttgtgcctgcatgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccacggtggtgggactcaccgcgtctggccaggtgcttttggaaacatgtgtcgtggaggccgaatgttggcaccgaagccaaaaccgtaggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628234 - DNA, 2134 bp, Homo sapiens
agctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacatgggcctcggcgcctgggcagaggtggtggaggtggagatgggcacctgacagctttgccttttgctgacacagctccataaagactcgtgctttctca

SEQ ID NO: 628235 - DNA, 1102 bp, Homo sapiens
ccacgtggttcggccggacaaatatcctggatcagacagggattcctctaaccggctcgtactccatcaagttacgttcacagtccatgatcattaactgcaatcagaccatacacaaaacatgatcatgtctaaagagtcaatcgatatagagagaaataacatgaactatcacatatatggatagtggaggacgtaagttgaaggctacagaagagcaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628236 - DNA, 2237 bp, Homo sapiens
ggcccaagtaaataccagtattctaaacaagctgcgtgtatcctatattgactcttttactgtttagctactcactggcagagacagtaatgtgttcaatgttagtaagttctccatacccttgggagggaggatgagcgagacgacagctttattggtccgttacatgaagtgaagaatcagacagcactgtcctgttagagggatgaagccagatggctttctaaacgcttccaggagtttcatcttaatatgtgtcccaggaaagtttcagtctagtttcttttttgattgctacccgaaccctcgaacaccatttgcagtaagagacgttctggtataggttctatttcagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctca

SEQ ID NO: 628237 - DNA, 343 bp, Homo sapiens
ggtcgacgactgatactcctcctaaaagtagatgaaaaaactcctaaggaaataacatgaggccgggcacggtggctcatgcctgtaatcccagcactttgggaggctgaggtgggtagatcatgaggtcaggagatcaagaccagtctgggcggcgtggtgaggcctcgtctctgctaaaaatggaaaggttagccgggagtggtggcgcacgcttgtggtcccggctgcttgggaggctggggcaggaggattgcctgagcccatgaggtggaggctgcagtgagcagacattgcaccgctgtactccagcctgggcaacagagtgagacgctgtttaaaa

SEQ ID NO: 628238 - DNA, 1083 bp, Homo sapiens
gcctgtgggatgtatggagagctggcagagcaagcggcagcgactgcaacacggaggcacttgcactatcttatcatgtatgagtgcgcttatgctttagtggctagacctgcactcgtgcaggcctgactggtgacaaacagtgacgaaagatgctatgcacgacgactcagatggaggtatgataagaatgcactgagggagcgtgtttctgaaacaaatgattttgtggaagttctgatttatggctgaaagagttgcaccattgatggttgaaacttcataattaataagttctcaggtaccttttatagctcttaagccataaagatgatttgtgtttcttttgttgaaatacaggctccctaatttttctttccctttggaattatctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628239 - DNA, 2524 bp, Homo sapiens
agctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaatgtgatgaatgtgtgctgatggccgactgtaaaagccacctgtgcatgtgatgtgatgcaaccttgtcacttaggtgccacactgggggacgactgttgtgtcgccatgtagatgcattcaagttcctgtgctgtgaactactgcttgtgtacatactggtgtgcagtgcttggactgatgttgatgtggaacattgttgtgccccaagtagcgtgatcatgcgatgatggcttcaatcttgcaaatgtagtaccatgacttgtgttgctggccatgggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctca

SEQ ID NO: 628240 - DNA, 1104 bp, Homo sapiens
  misc_feature (45)..(45): n is a, c, g, or t
ctgggggtgtttattctcacaggcgcctttaaatttttttgcgcngggtggtgggtagaagataaaatagtggggggaacaccgttttgggcggctgtgcccgcaaaaaatgttctctcttctcttgtgggatgttctgctagaagacgatttgttgtgataggcacagcgaggttgttatatccccctcggttgttagccctcagagccgctcacctcgtgatagcgccctcccgcgctctctctggtcgccccctttgtatgtctccgcattggtagaaagagtggttgttgatatgatagagagagagaagacaaaaataatagtagatagagagagtgtcacaggtgtggggtaatatgtttgaaagagagagagtggggggagatagagaaaaaagtgttctcatgaagaagtgtttgtttagaaagaactatcacatcgcgcgcacacactaggtctcacagagatttcttctctggtgtctctgtcccctatataataggtggcggcgcccccgtggggtgtcgtccacaagtatatctctccgggggcgcacaggagacacaagcggtgtgtctcaccccccgggtctcttcgcttctcccacagctccacagccttctgggtctcacagagagagaaccttggccacaggagactcgggggagagagcgcgagcacagaatggaggcgccctctcttgggacactctctttgtgcgccacgcgttcttttgcgaccgcccacagagccgggaaaaggcgggctgggctttgcgctatgtcgcattctcttcccggataacccctgagggagcccccccccactctcttttttatggaatgaaggggaaagctggaggcccccaactttgagtctctccacattggagagtggccccaaatttcttccaatctaagggcaaagttctgaaaaggccccaaggcgcccctccccaacagtttggccattggcctccagcacctggggggaaggggtaaaatcagagttattgtttcaaggcccacccccccccccggacaggagaccgtgtttttgataaagagttttgtaagagtgaaaaaaatttttaaaaatta

SEQ ID NO: 628241 - DNA, 555 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgatcttccttcgtgtagtctgaatataacgtctgacggcagcaagacaggcaagagtggcgtgctggcgcaa

SEQ ID NO: 628242 - DNA, 287 bp, Homo sapiens
atgcactatcaagggatcgtatatagtagatgtgtgagcatgcgtggttgggtagagacacgggcagtcaatcatggtagcgaagtgtagagtgcagtggcgtgatcatggcgcactgaagcctcaaactcctgggctcaggagatcctcccgcctcagcctcctgagtagctgggaccacaggcccacaccaccatgcccagctaattttgtattctttgtagagatggggttcatcatgtttgcccaggctggtctcgaactcctggactcaagcaatccaccca

SEQ ID NO: 628243 - DNA, 585 bp, Homo sapiens
ccgaggccccgttattgacgcgtctcctctgcttctgctctgcaccatcatcattctaatacactattacactattctaagtagtgtaatactacatcattctaatgtaacactacatcattctaatacactattaacttgtcttttctgtctctacagatatccatgtttactagaatgtaatattaagctctttggaggacaataattttttctttatttactactacagccctagaacctaaaaatcattcctggaacataataggagctctgaaaacatttcttgttgaatgagttaaaaacttaggaactaaattacaactagagtttggtggagcaaaacatgccaaatagtcacaaatttaaaagtatatggttttctttcctttggagctggggcttcactctattaaccaggtgggagtgcaaggttgcgatcttggctcactacaacctccacctatcaggctcaagcaatcttcccaactcagactcccgagtagcctggaccacaggtgcacgccatcatacctggctaatgttttgtatttttttttataattttttatttaaaagagaaag

SEQ ID NO: 628244 - DNA, 473 bp, Homo sapiens
  misc_feature (131)..(131): n is a, c, g, or t
gccgggctgagaggagcgtggctgtctcctctctccgccatggcgtgtgctcgcccactgatatcggtgtactccgaaaagggggagtcatctggcaaaaatgtcactttgcctgctgttggtgttaagangcagaagaagcctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 628245 - DNA, 424 bp, Homo sapiens
  misc_feature (26)..(26): n is a, c, g, or t
  misc_feature (44)..(44): n is a, c, g, or t
  misc_feature (109)..(109): n is a, c, g, or t
  misc_feature (268)..(268): n is a, c, g, or t
  misc_feature (381)..(381): n is a, c, g, or t
cccgcggtttttatcccttgaccatntactatgacataaggttntgtacacaggagatattctattgatgctacaaatggaaagccaatgcctttaccatacatagaanaacaaccctaagaaacaagcaaaacaaaaacaaaacaggggctgggtatggtggctcacgcctgtaatcccagcactttgggaggccgaggtgggtggatcacaaggtcaggagttccagaccagcctggccaatatggtgaaaccctgtctctaatanaatacaaaaattagccgggtgtggtggtgggcgccttagtcccacctacttgggaggctgaggcaggagaatagtttgaacccgggaggcagagtctgcagtgagccgagatngcaccactgcactccagcctaggagacagagcgagactctgtc

SEQ ID NO: 628246 - DNA, 987 bp, Homo sapiens
aggggagcgatggcagccgggggtctgagcctgctccgagcgcaaatgcggcgtgactgggtggggaggttgcgggaggagcagcagaggggacgcgcctccgccaggtgtcgcgcatcctgagtgaaggcggctggctggagctgcagcgccgagcgagtggcctggctgctggcctgagagctgcggacctggtaactgtgagctgcagggccgtgagccggtgctggctgctggaggggccattgaagcgggcggccaggcaggaggtgtgcgaacgaccctggatggagctgcggggggaaaggtccgggaggcctggcacatgctgcccgttcctggacaccgccaaaatagcttggtccgtctacaacagtgctgcggggaatcaggcacggtgccagcggtctatcccagacgtaccggtggaccctaattgcgagttgttggaccactggctttccagaaaacggggacgaacgcggtttcagttgcctgccccgacctgacgcggacgggcccgtagccaatagcccttcagcccaccattgaggcattcacccctgatcttgccattgacgcacggaaaggcgtgggattgcaagccactgctgcgtggtctcaggaaacctggtggaccgggggcttccaaccttgcacgcgcagttggcgcttggcctgtcggcaacggtgccaatcttcctgaagcttcccaccgggggaaacccacttgtcacatttcggaaaggttcgtggtacccttcccttggcggtttccccagggcaggggcaggatacgggttgccggggggttgttaccgacgtggtttaccgtgagtaccggcaacgttgtcccttccagcccgtgaacacccagaaaccatgggcccggcgaacctttgtccagccacagttggtggcggaacccaagtgcctggcgggtgtaccacccacttggttgccacatttagggcgggcacgcagtgg

SEQ ID NO: 628247 - DNA, 201 bp, Homo sapiens
gagtattccgatttcatttagggagatacttgggattaggattacgaccgttgcgaagcggagtacggatgctactcagggaatgatggtaaaagggtagcttactgcttgtcctccgattcaggatagaatgacgaggtctgcggctaagagacaataaagtgattggcttagtggacacacattctggaggggtaccga

SEQ ID NO: 628248 - DNA, 825 bp, Homo sapiens
gatcgctctcccgggcttagaaggcccggtactgacgcgcagtgccagaccttagccctcacggtccttaagtctcggtcgccctcgcctcgaagcctgccacccgcgctcagttgcccgcctcctcagccagcatgcttggaccattctgagctcgtgcccacgcaagatggatcacaagggccagaaggctagctgaacagattgttccagggaattattcttttttctggcaatagtgtgggatttatctacggggtacgtggctgaaacaagtttcggggtggacttgtcctatattagttaattggccggatttgtgctttcttcatgtgtttgtgctgacaacttcctccattggcccatcttatccgcggggaatcctctcaagtgtgtttaccttgtctcaaggaatcaaggcaccaggaacggaaaaggaaaccagtgggaacggaaaatttaacacgaggcattgctaaaaacataatggaggtttttcatggattcagcaccgtgcttttgtgttccttgtgagatgagctaaattggtttcaataccccaagaataagagttaaaaccacctaaatgctctttatggcacagtgtggtataagattagttctctttaatacttcattttctagcccagtgggggttttgatttatataaagtaggtttagaccttttcctttcataatctgtgtctctgagatggggaacaggaacccacaagtttgaagttctttcaggtgtgaataatggaaaataaatgctccataaatgatgtgacaatgtgctattcaaaggttataatctttggttc

SEQ ID NO: 628249 - DNA, 473 bp, Homo sapiens
ccgagttatgacacgagaatgcccagagactgagtctagcccttagagaatgctctgaatttggtactcgggcattatacagttagtaattaaacttgaaatgccattactactagtatattcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgtcctcttcaacctaagcaatatggatgtc

SEQ ID NO: 628250 - DNA, 737 bp, Homo sapiens
gacgattctcatgtgacctagggaagtcagatcggtgtgcaggaagtcctggtaattctggtccgttgtacccgtctggataccagcgttccttcagcagcgcaggctggtggtcccatgaggcccgtggaaggagtcaaatcttgacggggaattatgggcagttttaatcttgctagggcatgttgttatccagccaagaactccgaaagctcagaacaaggacggaggaagaaactgacccgatcagtgccagaagtcgattgtattcaatagaagaataacgcaagaacagtaaaagaaggaaggaagagaggtagacagatacaagatgaacctcctgtcaaacaaatggaagggaaaccagatacaatgatgagtgaaccaaagcactgaggaagagccaaagcctgaggcaaaagccagaagaggaggagaagctagaggaggaggccagagcacaaggaacttgtagagaaaggctgattcaatcgtctccaggagtttaacatgaagatatacagcaacaggcactttaagcaatgtgcaagatatgtgtagagaagtggctgacatagatgagataaggagagtcacgaaatcaagctgatagtgaatgcgttggcaaggctcaatcgagaacatccttatacgctatttaatggtagttaccttgattccagtctgatatgaacaataccatataggtagggtaaatcagcatctctgactattcc

SEQ ID NO: 628251 - DNA, 118 bp, Homo sapiens
ggcaaccagcgagacttcccagtgacgatctctgactatgggtggactcgggtgtagacctctgaagctgagatcacacgaaaacctggcctccccaccacttgccttcggtgcgggg

SEQ ID NO: 628252 - DNA, 268 bp, Homo sapiens
atctgaactaaggaccagaggctgccagatgtttctggctcctcacgtgtccttcaggacagaacagaagcacaaaggcttagccaagagttcttttttattccctttgatcctcccccaaaggggaggggcttaggcagcttttggacccccaggaatggaccgggattccaggcaatctgtttagaggccccccattccaaattttatccttttcctttccttcccctaagatgtttccagggccctctggtccccacactgtcct

SEQ ID NO: 628253 - DNA, 387 bp, Homo sapiens
ccaccttggtggagaataagaaggctcaagctggtggtgactggacatggatgtggatccccatcggagcttagttgtcttctgcctgccccctagcctcagccgcctcatctggaaagtgggtgatgataggccgggtgtggtggcttacacctgtaatcccagcactttgggaggccgaggcaggcagatcacgaggtcaggagatcaagaccatcctggctaacatggtgaaaccccgtctctactaaaaatacaaaacaattacccgggcgtggtggcgggtgcctgtagtcccagatactggggaggctgaggcaggagaatagcgtgaacccaggaggtggagcttacagggagctgagattgtgccactgcactccagcc

SEQ ID NO: 628254 - DNA, 1428 bp, Homo sapiens
cccccctgtttttgtgcgccctcttacttctttatagcggtgcgctccaccagctttgatgtatggactcacctcaacgtttgttgtgtgtcccgctccaagatgattagtcctccaagggcttttggggttgcactcgctgtcgtgctctcggggtaaattttctccctccctcggggaagcattttccttgcgtctgcggagactccctccaccactgcgtggttctccttcgtgtgggtccctcccccattgtgcgtgccgcagcaaccactccttaggagagtgttctcgctgcgttgtggttgatcattttcgctgttgtgccgccccaccatctcgtcgtttctcgccgctttttgttcttcccttcccctcggccgcctacgcccactccaatttgttctgctcgcatcccaccataaactccccccggaagattatattgtgcgtcctgctttgagaagaaatcttcctcctacgagagagtatattctcttcgtaagaattatcatagtcttctcgggtatatatcttgtgattagtagtagaaaatgtatcctcctagaagtagatcctccttccctataagagtgtagattagaatatcatccccccctctctgctcccttcttgttccccccatcacggtgtgtctacccggcattgttggtggaacaccaccgcgtagagtgatatcgtctcctcacgccctccgcgggccgcgtcatattcctcgtgtgatattatagtaaggggcgctgttctgttgctctccctccgcctcccattatatatggcgcccactccgtgtaacacactactttcccctccgcacaggcccactttgttgcgcccctctctctctgatatttatcactcctttcttctttgatactctctgtgtgtataacaactctctctgttatatagagtttcccccaccacagagagtgtgtgtggagtcatcacacagctgtgtataaatagtgagactctgtgtgttctccgccccccctctttccacacactctcacacaagagagtctctctctctgacaacacccgacatagggccccgcccctcccacactctttccccactctctctgtgtctcagttctcacttctctggtctctgcgaccagcggagaaaggagaaagagaactctggccactctgtgttgtgtgtgagaaggagaagaaattgtgtggcgttgggaataaatatgtgtgggtgtggagccaccccgtgaattctatagaggtataaactcacaagcttggcccccacaggtggtccgccccaggctgttaatccagcgtttaaatccagagggctcccctttttttttttgttccaatgattttaagttattggaaatgccccatttttttaatatgccaattaaaagttttaaaacttta

SEQ ID NO: 628255 - DNA, 359 bp, Homo sapiens
tttcaacagtgaacgcgccagtctatgagaggcggctgggtggtgaagaacacctgcggttcgtttgacacagcggttcctaaacggtttggtctcaggacccgtttacacgtctaaaaaataacttgaggaccccccaaagctttagcttatatctatagatatttgtggcatgaggaattggggccagaactttcaaacaacatattcacttaataacaaacccattaacttttaatacaaataacactttaatgcataaacttctcaaaaacaaagtgagaagataggctcatggttaacatatttttgccacatttctttggtctaaataaaggacaagctggggtctcatatca

SEQ ID NO: 628256 - DNA, 456 bp, Homo sapiens
aaaaccccaggcatatgagtgtatatacatgtagtcaaagagtaatcttttcctatatggataccaataatataaatggtttatattcctagctaaatctttcaggcagtgacaagaacaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggtcttcttaattacttacttgaagaaatattagacaaagttcattcaattccagaaaaactcatggatgagactacttcagaatcagactatgaagaaatcgggagtgcacttttagactgtagattgtacgaagacacatttgtaaattttcaagcagcaatagagaacaacattcatgcatct

SEQ ID NO: 628257 - DNA, 688 bp, Homo sapiens
aattcggccattatggccggggctacaccaacccgcttttcttgtgacacagtacaaccaccacactccaatagtacgtaaacatggtacgccacataaaaggtccaccgcagagagaaattgttttgtttgggagatggaaggcgacgcggagaggagcgactgaaaaccctaagcccgagtgagggcacaaggaataccacccataccctttgtacaccgagaggactagaaccccttataaggggagagcgcaggcttataccacggagcccggaccagcgagctgagaacgggtaccacagaagagagggatatgaaccagcactgggggttgatttataggtagaggcgacaaacctaccgagcctggtgaaagctggttgtccaagatagaatcttaagccaacttttaaaggtggccacagaaccctgtaaatccccttgtaaaattaaccgtcagcccaaagaggaacagctctttggacactaggaaaaaaccttggcgagagagcaaaaaattaacacccatagtaggcctaaaagccggcaccaattaagaaagggttccagcttaccacccaataccctaaaaaaaccatccacgatcctgactccccgccttgtgcgcccgcccttggccccaaactactcttagactagaagaaagcttatgccttgccggccc

SEQ ID NO: 628258 - DNA, 162 bp, Homo sapiens
ggagtactcgccaacagcactacagctccaggctggggtccgcaatcttctcctctgggtgatgacctgggggaagatgatgaagatgcccctatgataactgcatttacagataacgtccccatggtgatagccgagtctcaggctgaccaaggagcttgc

SEQ ID NO: 628259 - DNA, 257 bp, Homo sapiens
  misc_feature (35)..(35): n is a, c, g, or t
gccctttgaccggccccttgatcccaaatttattnccgtgtccaaaggaataatagggaaggggtttggttttggccaacccatgtaacaaaggcccctgttaaaaaaaaaaaaaaagtttggcatcagagggggcatgtggagagcaacttgggaagaacaagttcattttgtattgaatgatttttaatgaatgcaaaattaatccttgcagatgggcaataatcattaaaatcgattaaaatgataagccctta

SEQ ID NO: 628260 - DNA, 966 bp, Homo sapiens
  misc_feature (712)..(712): n is a, c, g, or t
agggctggtggaggctgggtgttcgatgcatggttggcgcctttgaggattcatgagcgactgggcgcaggccctcaggaaggatgacaggggaggcctggtctgatgcttgtcatccccacagggaaaagccatctttgatacttgggcaggcctgactgtgttcacggcataccttggcctaaaatggcgatcccagagtggtttagccagcttgcagcaaggatttactgtgaactggaaatcacttggaaacgcattcattatttcagtgtccataggtggaccattgtctagtcttctaaggttatatggccaccatatactagcttatttccagcaattccatagcaaaagcagtataagcatgcctgggaacgttcccatgcgagagtcgtggtcttgggtgtggtcttcgtagtaccgtgagctgggcaccatgaacctctcggcaggtcttccaagtggggaactccagcgaagacgttattgggccgtgccatgtgtttgcgagttgtgacttgttgccggttttcccgatcgaggccttgtggtcctgagttgggggaattggatgcccggtgaagatttggtcagctggaggatgctagcttgggtgggtgaccttcgaaggtccggcagcggagcgtttcctggtgcacgcatcgtcagatcggggggaccgaaatgcggagtctagctctcgagatgngacaggacgaacttgggattgtgcggggccagcctggttgtgagtcttgcaccatgtgtcctctatcacaggcggggcgaggggcctgagatccaaaacttggtccccttgaatggacaggggccttattggcagaagacacaggggagggatctcggcagagaagggggccacagagacaaacggtgtagaaggcgcacacaaacggagccacccttgaggaagacgggggtggcacacaaggcagacgggac

SEQ ID NO: 628261 - DNA, 114 bp, Homo sapiens
gaatgagctggtcacatcatggttatgtagatattggtcgtcggattgttggagacatgcgccacgcggtttgtcgcgtttaatctgcgcggaatagccgacgttgacccaacg

SEQ ID NO: 628262 - DNA, 460 bp, Homo sapiens
tagattatgggttgataggtgcagcaaaccaccatggcatatgtatacctatgtaacaatccggcatatgtatacctatgtaacaatcctgcacattctgcatatgtatcccggaacttaaaagaaaaaaagaaaatatgccatgaagtggtcactgtaaaagccgttattggctgggcgtggtggctcacgcctgtaatcccagcactttgggaggccgagatgggcggatcatgaggtcaggagatcgagatcatcctggctaacaccgtgaaacccccgtctctactaaaaatacaaaaaattagctgggtgtattggcgggcgcctgtagtcccagctactcgggaggctgaggcaggagaatggcgtgaacctgggaggtggagcttgcagtgagccgagatcgcgccactgaactccagcctgggggacagagcaagactccatctcaaaaaaa

SEQ ID NO: 628263 - DNA, 182 bp, Homo sapiens
ctttgtacttgctaatgactttagctcggtcatggagtttatgaccgacactagccatttttttctagtccactgtcagaatctctcattgctttcctggtttcctttattcctcctggagctcgacgagtttgagttgaggcctgcataatccttggcggatcactctatatttgactgct

SEQ ID NO: 628264 - DNA, 106 bp, Homo sapiens
  misc_feature (35)..(35): n is a, c, g, or t
ctttcttcttgtcttcagttccacagcatcatggntcatccaatcggccagtcagtcttccccctggcaagggcagccccaacgaggtcacggcgagctcgcaatt

SEQ ID NO: 628265 - DNA, 254 bp, Homo sapiens
aaaaaaacaaaaaacaaaaaacaaaccacatttttttagagacaggggtcttgctatgttacccaggctgaactttttaagtagaagtatactccaacataacatgaaaagtataatatagtaaacacgtaaaccacagtaacatagtcattttttgtcattatcaagtagagtattatgtagtgtacataattgttctatatttttatatgactgtcaacatactaggttggtttataccagcatcaccacag

SEQ ID NO: 628266 - DNA, 899 bp, Homo sapiens
  misc_feature (38)..(38): n is a, c, g, or t
  misc_feature (480)..(480): n is a, c, g, or t
  misc_feature (492)..(492): n is a, c, g, or t
  misc_feature (650)..(650): n is a, c, g, or t
  misc_feature (880)..(880): n is a, c, g, or t
ggtgaaagaatggtaggaattatctgtggttgaaagancttatcatcttataagattggagaagttaattatgtttgtatcctaaggtggcaagtcagtagagatggaaaagttagaagtgtaaggatgaaaggagataattaatagctaagttgctgtggaaggtgtgaggaatgggatatggagcatagcctgggagttagtcttgaatgtggaagggtgagccatttcacagatgtagaaggggaggaagtgatggaagggaaggaattggaagaggtagtagatatcagatacgatattttggaaagttggacattaagaagagtgtgattggggaggttgttgtgactttctgcctgaagattcagagtcaggatcatgtgctaacaggtgacttgaagtttagaatagccatttggggagagtagacacaagaggtggggcactcatggctgacatttgttagagcaaaagganttattagagtgnaaaaaaaacagacctgtgagatagtctgaaggagtctagacgcaggctttcaaagtttgtctcccagagctagggttgaggggctactccttcctcaagcaatgaaatagagcaatgtgggctgggcacagtggctcacacgtgtaatcctagcactntgggaggcctgggtgggcagatcacttgaggttgggagtttgagatcagcctggccaacatggtgaaacctcgtctctactaaaaatacaaaaattagccaggcgtggtggcacatgcctctagtcccagctactcgggaggctgaggcacaagaatcacttgaacctgggaggtggaggctgcagtgagatgagattgtgccattgcactccagcctgggtgacagggngagactctgttaaaaaaaa

SEQ ID NO: 628267 - DNA, 549 bp, Homo sapiens
tggaatagaggccaaagcagtcatccttaaaaattaaaaagtcttcagcatatggctagccagttttcccaacaccatttattagacagggaatcctttccccattgcttgtttttgtctggtttgtcgaagatcagatggctttagatgtgtggtgtaatttctgaggcctctgttatgtcccattgttctatgtatctgtttttgtaccagtactatgctgtttttgttactgtagccttgtagtgtagtttgaagtcaggtagtgtgatgcctccagctttgttatttttgcttaggattgtctttgctatacggactcttttttagttccatatgaaatttaaagtagttttttccaattctgtgaagaaagccaatggtagcttgatggggatacattgaatctgtaaattactttgggcactgtggccattttcacgatactgattcttcctatccatgagaatggggtcgttcttccatttgtttctgtcctcttctagttccttgagcagtggtttgccgttcttcttgaaaaggtccttc

SEQ ID NO: 628268 - DNA, 918 bp, Homo sapiens
gctcctcttttgccggctgaagcatggagggtgtatgaagagacgacgaaggaggttcctgctgtgcagagacccttaagaaaaagcgaaggaattcgcagagtctgaagatcacgcgcctgagaaagaagtttgcccaaaagatgctcgaaaggccctggaggacagcttatctatgaccaatggcaatagcggtatcacaaggaatatgggccagatgtacagaatctgaaatccgatggtggggagggcatgtgcaagaaaagctgggaagtcctatgtacctgcaagaacccaaattggcgttgccattcagaatcaggcaggtctcacatgggacgtgaggcccaaaggtccgaaacgggtgtcgcaggcttcttccgcccttcggttcaacattctttccaaatgtgggaccccttggtgtaggaaggcttccaaccaaaggggtttccgaattaaaccaagtgcctagcagggacttgtgttagcaagccattatattggacattggggggtacccccaagttcgtgacaaggtccacgtaactcttgtaagaccttatgtcctacgaggcggtgcgtttaatggagcaaacatccaaattacagaacaggcgaaaatgtgtttgggaccagtagtagccgctttttgattggcctacgaagtctctttgggtaccaatgagcggagcagttcaatcttgcagtgggagagcatttgcgattcatttgagaatcttactacgggtggcgggcaaaggccttccacaagagcgccaattacacctttcccggtgggccctttcacaattggtccttcctccgacgaagctggggactgggagccaatacaggaccccccaatatgtaaaacgggggggcgtgtgcctgtcaaccggcgaggcccaatttaca

SEQ ID NO: 628269 - DNA, 999 bp, Homo sapiens
  misc_feature (580)..(580): n is a, c, g, or t
  misc_feature (592)..(592): n is a, c, g, or t
  misc_feature (750)..(750): n is a, c, g, or t
  misc_feature (980)..(980): n is a, c, g, or t
caggctttcaaagttgtctcccagagctagggttgaggggctactccttcctcaagcaatgaaatagagcaatgtgggctgggcacagtggctcacacgtgtaatcctagcactttgggaggcctgggtgggcagatcactatcatcttataagattggagaagttaattatgtttgtatcctaaggtggcaagtcagtagagatggaaaagttagaagtgtaaggatgaaaggagataattaatagctaagttgctgtggaaggtgtgaggaatgggatatggagcatagcctgggagttagtcttgaatgtggaagggtgagccatttcacagatgtagaaggggaggaagtgatggaagggaaggaattggaagaggtagtagatatcagatacgatattttggaaagttggacattaagaagagtgtgattggggaggttgttgtgactttctgcctgaagattcagagtcaggatcatgtgctaacaggtgacttgaagtttagaatagccatttggggagagtagacacaagaggtggggcactcatggctgacatttgttagagcaaaagganttattagagtgnaaaaaaaacagacctgtgagatagtctgaaggagtctagacgcaggctttcaaagtttgtctcccagagctagggttgaggggctactccttcctcaagcaatgaaatagagcaatgtgggctgggcacagtggctcacacgtgtaatcctagcactntgggaggcctgggtgggcagatcacttgaggttgggagtttgagatcagcctggccaacatggtgaaacctcgtctctactaaaaatacaaaaattagccaggcgtggtggcacatgcctctagtcccagctactcgggaggctgaggcacaagaatcacttgaacctgggaggtggaggctgcagtgagatgagattgtgccattgcactccagcctgggtgacagggngagactctgttaaaaaaaa

SEQ ID NO: 628270 - DNA, 218 bp, Homo sapiens
  misc_feature (148)..(148): n is a, c, g, or t
ctttgttctacttcaactgggaacatgcacattggattataatggggaatcttggaaatgcagacatgccttcaacaagaacgcggtcctgtacccaagtctctggtgtagtgcagctcacagatttgctgtcccattttgactcccncaattcttctcctcctctgatgaagactttattgaggtcaggattgaatgggaaatgaagagagattatt

SEQ ID NO: 628271 - DNA, 698 bp, Homo sapiens
cccacgcgtcgagcgagtgagtgagtgagtgagtgtgtgtgtgggggggactcggctagttgtagtcaggtgacattccccgcgtccaccattcaccccataccccatccaccgccgtcagctgcaacgtggacggcgtcccatgagtgccgtagagaacatgagcagaaaagcggaatagacatcggaaggctggaagagctgacggaaagcagcaacccgcaggagtttcacagtcgtgacggacatgatcgacacagcggcgtccagtcactaaaatgcacgtgcgacacagaaacacgctgagcggacacacacactacaaccagcacagacatatatcaacaagataatgacgaggacagtcagaacaccaatcactaccgaagcgacgagaaaggcactccacgaggacgcgaaataccatacgcacaacagcgcaccacgaagtaatataccaagctatactgccgcaacggaagaaaaccaacacgacacacaagccaaaagactactccgcacgacacatacagaagacgcgacacgacactcgctactatacatggaagcacgcacaggagagcaaacgccgagcagcatcgatacaacgatactaaaagatgcactggtggaattacaccaatcatctaacactacacctcactggcaacgactgcacaggtacaacggaaaatgca

SEQ ID NO: 628272 - DNA, 380 bp, Homo sapiens
gtccctgaggatttaatgagattagattaaatagccatgaaactcttatcaatatttatcatgctgcaatctcagcacttcgggaggctgaggtgggaaaatcacttgagctcaggagctcaagaccagcctgggcaacatagcaccagaccccatctcaaccaaaaataaacaaaattagccagatagggtggcacacttctgtagtcgcagctactcaagaggctgaggaggatcacttgagcccaggaggttgaggctgtagtgagctatgattgtgccgctgcattccagcctgggcaacagagtaagaacttgtctcaaacaaaacaaagcaagaataacttggtctacccgtacgaggccacgggtaccgagct

SEQ ID NO: 628273 - DNA, 346 bp, Homo sapiens
  misc_feature (318)..(318): n is a, c, g, or t
  misc_feature (330)..(330): n is a, c, g, or t
tccagagtatcccattcaattgcggtgagcatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatgctcaccgcaatatnatggtaccgagncgatcactgcgtgttt

SEQ ID NO: 628274 - DNA, 466 bp, Homo sapiens
  misc_feature (454)..(454): n is a, c, g, or t
cattttatcatagtgcatgaaggaagtggtcatttattttagtcagaataaatttgtgtccttaattagtttctcacacttgattctgctgaaatcatcagtgccttttatgtgcagattgacgtatattccttttttactgactttatatataaagattcttgggaactcttataatctggaaataataccaattgaaaagagagagaaactaacactgtacaataattacaaacctagaacacatgggtaaaagtgttaggaatatcctgaatttgtgtttttgtctttttcctccattcagtgactgtgaagtcttttccaaaaatcatgctgctcctttctctaaagttcttacattttatagaaaggaacctttcactcttgaggcctactacagctctcctcaggatttgccctatccagatcctgctataggtaagtaaagagttgnaaattaaaaaag

SEQ ID NO: 628275 - DNA, 128 bp, Homo sapiens
gggccgatgtcagcctcagaacttctggaactgcttcttggtgccgggcagcctttggtgaccttgagcacgttgaagcgcactgtcttgctccgagggccggcactcgcccagtgtgacgatgcacc

SEQ ID NO: 628276 - DNA, 5401 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 628277 - DNA, 5437 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataatgttagagatacatagattcgacactcctacagaacacaagaagttcaccacagattctctatagactcatatcaccatcaccttgcgtggtacagctgtgcaataatacttgtgccagacgcactggcaccactggtgaagagtgaccacgccagcgcatggcaagcagccgtgccagcgtcgacaaacgaaacacaggacaacacaagcgagcggaagcagcactgcaccgccgcacaccacctggcgtgaccagacacgagggggagggccggcatggaacactcaccaacccacacacatcacgacacccggattgacccaccccacgcgccaggagaaagtacccaaaccacaatcccatcacgcacctggatgcgcaggcgaagccacgccgcaacacaacggacaaggaaagccacacgcaaggccacgcgaccccacagcgccacgcgcagacacactggcatacccagacacagggcaaccagcacccaacgaacaactggcacaccggacccggcgggcacgggtaagacaaccgggaaaacacgcgtccacatcgggtacaccagacaagcagcactcgaccaaggcccactgacgacaagaaagcagcagagacaagcgaaacaagaaagagaatggcacagccaaggaaaaaaacgaagacaggagaaaagacacaaaaggcatcgaaacacaacacagacgggcaaaccgcggcgcaaaaatgagaaaggcaaagcagaaaagctaaaccacgcgaaccaacaggcaccaaatacaagagaacacaaaggaacgcaacagatggaaaacaacagaatagctcacgcctaacacccgcaccagaaga

SEQ ID NO: 628278 - DNA, 222 bp, Homo sapiens
tctggaagtactgacatctctgccaccagaggcactatgaaatcatcagtaggctacctgtgggagagaagatcccagaaaatacttcaataggcatttgggccatgagaacatgcagcagaattatttacaactctcacatgcatatgccttgctcggcaatatgtgcaggagcatacatcagtcattcactttgcgtatggtctagtgtgcagctattaa

SEQ ID NO: 628279 - DNA, 4182 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctaaaaaaaaaacaaaacaaaaaagaaaaaaaaacatgagtgtgggggcggccctgggcccccgcgaagaaaggctttcatgaaacacaccacgtgtggcgcccgcacaggagcgccaccaaaagagtggagtaacagagtagaaaacactaggggggcacaactacagcgggggtgcacacacagagaggagagcacccctgggggggaccaaggagaaacaaagggccgcactagaggggatcttactcaaaacgccaaactaaacacaaaaaagcgaccccgccggggtagcgacgacaaaacaccggaacaggcggtgatccgtgagagagacaagcaacctcaccaaagaagaatgggagagaactaacccaggaaggggacaataaccaacggggggggacgaataaacaca

SEQ ID NO: 628280 - DNA, 385 bp, Homo sapiens
aggatacccagtaaatcagaggcaattctgggttttcagtggcaccaaattctggagatctgagtattgggtaattttggtattgtccttctattaaaaaacaacaaaacccagtggggtggggaggagtggggggcaaaaaaaaaaaaaaaagaaaaaccaaaccaaaactcattgtatttttctgattataaattcaatatttatgtgttctgattataaattcaatattcatgaaaattcagaagaacgttatgaagtaatgccattaacattcccatactgttatcttgaacacgatggtcaatggtttgatgtatttccttcaaaatttttgtctgtatatatttatgtttttaaaaataaaatcaggatatcatgtgta

SEQ ID NO: 628281 - DNA, 5347 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattgcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 628282 - DNA, 317 bp, Homo sapiens
gttatcctgaaaacgcaactgatatgggtggtgaggaatagtgcaacaggacaacgagaaatgagtgttggacagatagcgaggaggccatggtagtctcagcttatatccttcctgtttaggagtatgaggcgttactgagaagccatgacaccctggagccccgttgttttgaaatgattcccgttaactaagctcagcactcaaaacttcctcagggccagctgatcagacccaaatccttgctcatgtctgaccacaagaagtgtttcccaagcttcctcactggacagctacccaataagggtatgactttg

SEQ ID NO: 628283 - DNA, 4639 bp, Homo sapiens
  misc_feature (63)..(63): n is a, c, g, or t
cgactcttgagatcccccatgtacctcctcagtctgatgctccagttcaaaagtgaaagtcanagttcgagtaaatgtccatggcattttcaggtgccagtgcatctttagtggaggtcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagcgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 628284 - DNA, 324 bp, Homo sapiens
caaccctgtgatgtgggatcccagacttccctatctgttaactaaagggctgttttcaatcaaataattgttacgagaagcagactggcgcctgtagcactgctgttggagatccaaataggagattgggttgggaagtttttccctcgagtctctgctataatgatgtgtaattagcactgtccaggcgagtgtgtgtgttgcatctggacgccttggtatgcccaatcattgagcgttaggttaaacgtacaaactgtagctttctaccggagccagtcggctggctctgcccttacgttacatatttttaaacatgccaaa

SEQ ID NO: 628285 - DNA, 5433 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgtaatgaacaagctgtatatctggcagtaacatagcgagagtcttgaccatggtatcctagttcgtgcaagtctataatagagattgagagctataaatgtagaggatgctgacaagtgacttggtaagccctatgaattttcaaagccctaaatcccataagtcggaacctccagaatagaggtacaaataaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 628286 - DNA, 634 bp, Homo sapiens
  misc_feature (15)..(15): n is a, c, g, or t
  misc_feature (125)..(125): n is a, c, g, or t
  misc_feature (154)..(154): n is a, c, g, or t
  misc_feature (189)..(189): n is a, c, g, or t
  misc_feature (401)..(401): n is a, c, g, or t
  misc_feature (413)..(413): n is a, c, g, or t
  misc_feature (496)..(496): n is a, c, g, or t
ataaaatggtgcaanattttaaataaaaatactgctggtggtggcccagattctggtagttgaagggttggggtagggctgaaaattccttttgcccaagggagggccgggtggcgggggcagcnattttaagaaccccctgtttttagctctnccggctactttgggatggtgtgttgtgttagaaancccaagttcagaatctaggccccaggactagaaagaaaagttaaggccggggagaaattgaggctcagttttgcagcccactcctccagtccccacctctgggcagggatagagcgaaggggcaggacaaccctagaggtggactccaccctctcccgagtgcttcacgattggatgcggtggcagaaaaacgcaggtggggcttgcgccanccaccctaactnccttctagggaaatgacattgcccagaatcccttgcagcgaaggttctggatctgactaaagttcccccaaacagaatctctngtgaaaatttagatttgggaactgagtgaagtgggagaggggcagggctgaggacaactatgggctgggacggaccgcggcagagggagcgtagtgctgcagtaagcggctttgtggcatagtggcttgctgcagagg

SEQ ID NO: 628287 - DNA, 356 bp, Homo sapiens
atgaaaatatttaaatctgttcaagaatagttcaaaatattgcgggaaatgaacatgatcatctttatgccacgattcttcattaagtcatggcagatggagcctaccaagaagataatgatgaatcatcctcaaaacgttttttaatcctcaactatatgaaagcatgtgaattaggcttatcagaataacatgcttcagtgggaaatacaggacttatttatttaatcagatctaagatggactttcttattgcatgaataagatggagaaacatgccatttctcaatgaagattctaatattttatctattgtgttcattgaattccatggtttctcataacctgctttggtt

SEQ ID NO: 628288 - DNA, 5155 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 628289 - DNA, 227 bp, Homo sapiens
catcccccctcggaacccaatgagcatgcctgtgttgggttgtttgtgagttgtataatgacttgttggttgatgggggatggtgggctgttaattgtcagcccaccgcccttaatctgacgcaggcttatgcggaggagaatgttttcatgttacttatactaacattagttcttctatagggggatagattggtccaattgggtgtgaggagttcagttatatgt

SEQ ID NO: 628290 - DNA, 413 bp, Homo sapiens
gagaaaaacaaaggcaggaagtgacggtggcctgacggtgcgtgtgtgtatgcagagaagggagggagccggctcagtttattcttgttttgacaaacttcaaggtccaggcagccatgtgcagggccgggccccattgctccccgcgcggcattggaggtgtccgccggtgaggagaagcccaacgcctgctccaggcttgtcaggcggaaacggttaacaaggagatttggtcagcaaaacagacccagcctttccgaggcttcgtctgacttgccccgaaaggttggggaggggggacttgcgcagagcctcagggaccctcctctatggggactaccattcatgagctgtacgtttctttccacagcctttgcagggggaatatcggaataaagtgggttcaggcgcca

SEQ ID NO: 628291 - DNA, 3086 bp, Homo sapiens
tccagagtatcccattcaattgcggtgagcatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 628292 - DNA, 85 bp, Homo sapiens
  misc_feature (9)..(9): n is a, c, g, or t
  misc_feature (21)..(21): n is a, c, g, or t
  misc_feature (26)..(30): n is a, c, g, or t
  misc_feature (35)..(36): n is a, c, g, or t
  misc_feature (38)..(38): n is a, c, g, or t
acatctgtntctctgtgccancagcnnnnngaccnngnggagcgatgagcagttcttcgggccagggacacggctcaccgtgcta

SEQ ID NO: 628293 - DNA, 589 bp, Homo sapiens
tgggttcacaatttttctcattactctccccgcgttgagaggtgtctccgggggccctttctcgtttagaaccccatctcttcacattttgaaaggttaaccgggttctcaggccaatatctctacatattgtgtgttttcagagatcgttaatctttggggatcaacccattctcagtgatgcacaaagggcacttgaggcgcagcttttatataggcgacacctgccggtatatgtgttcctcaatgaagttggtgctctcccgtatgttgaccccctcaaccagtgcatgctcattcttgataagctcctgaaaatccggcttggttttcttcttcatgatggattcacgggccccaatatggagactcagcaggcggtgctcctgtttcaggcccttagtctcttggcacacgaaattcttcatctgctaaatgtccatgcctctccggcgatcatactgggcctgcaagttccggcctatgtggctcaagaagccaaagacattggaagagtgctcgttccgaatctcattacaccctgtgtcctcgcgcattgagtagcaccttcagtctcttgtcagagtat

SEQ ID NO: 628294 - DNA, 154 bp, Homo sapiens
gcgcctagaggaccggccattcagtcactagtcttcagatggtatctcagactatagaaggagctccagttgaattcaccagtggacaaaatgaggaaaacaggtgaacaagctttttcttgtatatacatacaagtcagatcagttatgggac

SEQ ID NO: 628295 - DNA, 155 bp, Homo sapiens
acaacaacctatctgaaacaactttggagttttagctgaacgacgcgagggggctgagggtcagagtgggtctctgtggtccaggaggtcaggtagaggctagtctcaaagtgggaagccttctctgttgaaaaggctacattcagcccctcagc

SEQ ID NO: 628296 - DNA, 629 bp, Homo sapiens
  misc_feature (37)..(37): n is a, c, g, or t
  misc_feature (84)..(84): n is a, c, g, or t
  misc_feature (110)..(110): n is a, c, g, or t
  misc_feature (247)..(247): n is a, c, g, or t
  misc_feature (251)..(251): n is a, c, g, or t
  misc_feature (285)..(285): n is a, c, g, or t
  misc_feature (368)..(368): n is a, c, g, or t
  misc_feature (371)..(371): n is a, c, g, or t
  misc_feature (378)..(378): n is a, c, g, or t
  misc_feature (465)..(465): n is a, c, g, or t
  misc_feature (481)..(481): n is a, c, g, or t
  misc_feature (486)..(486): n is a, c, g, or t
  misc_feature (529)..(529): n is a, c, g, or t
  misc_feature (549)..(549): n is a, c, g, or t
  misc_feature (552)..(552): n is a, c, g, or t
  misc_feature (565)..(565): n is a, c, g, or t
  misc_feature (601)..(601): n is a, c, g, or t
tctcggtttgtggtgctttggtgtggcggcccttgtntcctttacactggggggttccatgttctctccaatcggggttttggntttgggcttttcctctcttgtgtttnttgttttctgggttctcggtgtcggtggcctttggttcctggggttgcgccttgtgggggtgtggggcggcgtggtggggctcctgctcttcttctgggttggggccggcctcggcggggtggtctgggactttgcntgtntggggctggtgctgttggcccctggggcctgggnccttgtcggggttcgcttcttccgtgttttgctctggctgggctgctttcttccttctggtcttcactctgaagatgaagcanacncagaggnaaaccagggttgtgatgctagctccccagactgctcccaggacaccaccagccctgccttctggtttccaatgcacaaggagactcngagagatttgccgggngcccngaggatgctgagcacggcaggtgaaatctccttcttctgcagnccctacttgaggcagctccnggnccccggtattggngatgggggtggcgttcagggcggggaagcctgggancagctcaggtgtgcaggggggttgcgtc

SEQ ID NO: 628297 - DNA, 160 bp, Homo sapiens
gcacactacaggtcacacctggcagggatgtcggaaactctactctaaacctctgactttctagactaggaagctgcttgagtggcttttcaaatttacatccagctagttaatgccaacgccaagaagaaaacaccctggatcctaggtttcccttaaa

SEQ ID NO: 628298 - DNA, 181 bp, Homo sapiens
cattataagcaggaacatttaaagagcatttgatcttacttatactcggtggaccgaaagccctatagctagacaatacgcggaaaatagtaccatcatcatgttattataaaaaaatttaagtgcagaagtaaaaaaccaaggaagctacatgtaataacagtaacatacaaacaccact

SEQ ID NO: 628299 - DNA, 675 bp, Homo sapiens
gatggcggtcatgagtttgtggcggacgggtttcggttactgcggtggctgctctgtctggccggccccttggcagtcgcgtcggagttggggggcattcctcactcgtggcttttccgaaggctgctggggtaattcaattattctccaggcatccctgattcgtactacagttggtagacccatgaggaaaaggatctattattggcatcgagatcctgtctagaatttctagtgcacaggctgttccctatgacaggttattgatgagttctacattgtcattgatcggggattgccacgtcgcaatttgtccataactcatggtgacatgtattcagtctggtcaaagctagaactagtcagaaattccagaaggctatgtcccagaaccactgcggagatatgcataatgcatcccatatcatgatggattgcccagtagatttcgtactgatagtcctgaaatagatatatgaaagatcaatggccgtccttcagattggagttgagaaggctgaattgacgggtaaaggagctggaagtgcgaaaattgatgcatgtgagaggagatggagcctggtattactagtgagagcactgacaaggaattattgatgcattctccgaaagaatgcctgacattaaagcattttgttcttcagatacaaagat

SEQ ID NO: 628300 - DNA, 354 bp, Homo sapiens
cgggcacggcccagtggaacaacagatgcggtagcaggctctggaccctgcaggctcgatgaacatctacctggtgctagatggatcacacagcatagaagccagcagcttaacaggtgccacatatggtctagtgacagatgccccataccccacaatttgcatcgggtctgaagcagacaggattaaggcagactgattcacgaagcacttgaatgatagcaattctgaagaccacaagctgaagtacggggctaacaccaagaaggccctacaggcagtgttcagcatgacgagctggccagatgacgttccttatgaatgttggccgtgcccggcatgtcatcattctcg

SEQ ID NO: 628301 - DNA, 205 bp, Homo sapiens
gcagagggggccgcaaagtggggcatgagaagtctgagatggaagaggccctgacagccattacagaggaattgaccgcttccatgagggacgagaagaaagaagcagcagaacaaatggaagaggaacccgcagctgaagaagacgaggtcgctgccaaaaagtctgcagagaaagcaactgcacctgacgttaaagaagagga

SEQ ID NO: 628302 - DNA, 196 bp, Homo sapiens
atccacattctatcacaggtgatgtatggtcagacttaacgagccccaattgtcaaacacttggatcaggtcataagcctgtttccttgtgctagcaggaccctgtacagcatttatcaagctctagtacctgtaatagcttttgtgatgacttctaggctgaataatactcagaggggatccgtctagcagtcga

SEQ ID NO: 628303 - DNA, 337 bp, Homo sapiens
tggcttccagcactttgggaggcagggcaggattgcttgaggcgaggagttcaagaccagcctgggtaacatattgacaccccgtctctacaaaaaatatttttaaaaaagaataagcagaccagcctggccaacacggtgaaacctcgtctttactaaaaatacaaaaaaagatttagccgggcggtagtggtgcacacctgtaatcccagctactcggaaactgaggtaggagaattgcctgagcctggggaggtgaaggttgtggtgagcggagatcgcgccactgcatcagagtgagacactttctgaaaataataataataagcaattagaa

SEQ ID NO: 628304 - DNA, 343 bp, Homo sapiens
tgagcttatcgttgaacaaacgaacctttaatagcggctgcaccatcggcgatgtcctgcatccaacatcgacggtcgtaaacccttattgttagagtattggactctacagttatgattgcgctgttatcctctagggtaacttgttccgttggtcaatttattggatcaattgagtatattaattcgctttgactggtgaagtcttaccatgtactgctcggaggttgggttccgctccgaggtcgtcccaagcgaaatttcaatgcatgtttcgttagtttaggacctgtgggattgtgatgtacctgaatgcattaataaattaaagctccatagggtc

SEQ ID NO: 628305 - DNA, 241 bp, Homo sapiens
aaaaaaggggggggcccccccccccccccccccttttgggggcccccaaggtggggggggggggccttttttgggggggggtttggggggaggaaacccccttgggggtgcccccccccccccccccccccgggggggtttttttttgggggggcccccccccccccccccccccgcccaaaaacattttttttttttttttttttgggggccaataaccccccccgggggtttcccccca

SEQ ID NO: 628306 - DNA, 119 bp, Homo sapiens
cttggaacgaacatgagagatagtgcaggaaaggggcctcggaaacgtgatctctaacagttaccgtgatttgatgctcgtcaccctatgcactaccatgagcgtatgacgcatgcttg

SEQ ID NO: 628307 - DNA, 713 bp, Homo sapiens
  misc_feature (500)..(500): n is a, c, g, or t
  misc_feature (530)..(530): n is a, c, g, or t
  misc_feature (536)..(536): n is a, c, g, or t
  misc_feature (558)..(558): n is a, c, g, or t
gtgggaggggtaggtgagcgtcgcgaggcagcgtgagcttctgagtgaacgcggtgcttttgggaacgcgggacgggcgacctgtggcgccaggagcgggccgaggcgcggggcgcggtgccgtctggatgggaagttacggtttacagcgaagtccacccagcgtttccgaggtgaaggcgccgcgccaggccgggcgggcggctggtgatgggcaagccgggtgtaccaagtccaggatgcacatgaggagcgtttgtagccgtcactgaatcacctcatgactagcggggcaggcctctaattcaccgcaggatttccgatctcactctgttgcccaggctggagtgcagtggcacaatcacagctgaccacaaccttgacctcccaaggctcaggtgatcctcctgcctcagcccccaagtagctgggacctacagacagggcctcactctattgcccaggctagagtgccgtggcaggatctcagctcactgcanctccactcctggctcaagcgatcctcccanctcagnctcctgagtagctgcgactatnggagtgtgccaccatgcctggcttaattttcatacttttgtagagatggggattcaacattgtttcccaggccatctgaaagcaaatcctgttcagatgcaggcgaaggttctggtgagccaggctctaccttaccgtccttacgacttttgagg

SEQ ID NO: 628308 - DNA, 620 bp, Homo sapiens
  misc_feature (20)..(20): n is a, c, g, or t
ccaaacactggcattcacanctttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatccatgtgttctgtgttaaaaa

SEQ ID NO: 628309 - DNA, 628 bp, Homo sapiens
  misc_feature (20)..(20): n is a, c, g, or t
  misc_feature (591)..(591): n is a, c, g, or t
ccaaacactggcattcacanctttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaggnagaggagaaggaggaataaggtcgacccggtccggaa

SEQ ID NO: 628310 - DNA, 328 bp, Homo sapiens
cccctggcctttttggtcccgggggacccggtggaggaaaaaatggccccggtggaactggtagggggaataggtggggcccccattccggtgggctttttggtaaaggcccttttggaatttggactttaaaaggggggggttccgcccgggggggggaaggtgggggtgggctagaaacaaaggtggaggggattttggcttttgaagaaggggaaattggggcccttgggggggaggggaaaaccccttgggttaatggacggggggggggggaaactcctggaattgaaaaaaagggctttttcccctttccttcccaaaatta

SEQ ID NO: 628311 - DNA, 573 bp, Homo sapiens
  misc_feature (6)..(6): n is a, c, g, or t
  misc_feature (46)..(46): n is a, c, g, or t
  misc_feature (573)..(573): n is a, c, g, or t
aaacgntaattagaacaacattttttctatcttttttcaacactgnatttttgggagatcgaatttaggactgacctttattgcacccctgagcgcggggaaagaatgggctttaaattttttgaacatttgtccccaaattcttgttgaccaaacatgcagggtatctatcaaggtgtgagggcaaatcttacggaagggaacatttcgcccaaatgcaaaacactcaacattcctgaactggttggcccggggcataggggaaaaccatttacttggaggagcttagaggcatatgaaaaggttctttgaatcccccatcacagtgtgagaggagagtataaaacacgggcgcggttacttcactgagatgtttcccatagcctaggcccttgacaagacagacaaatttttttactcacgcacctgcttatcttgaacagagcaattaccctgttgcacagagtatctgtgtacgaactatgggtaagtcttctataaaaaaaaagtagaacatgggatttactttggcactagggacataataaatttttgtccacccacaagtgaacn

SEQ ID NO: 628312 - DNA, 1223 bp, Homo sapiens
  misc_feature (672)..(672): n is a, c, g, or t
gacgtgggctcggcgcgatggagtggaggagatgcgtactgacgccaatatccgtgctgaatatggaacaggctccagccctcggaaggttcctggttgcagcctccggcaatttgtctgcgaactgaacctgctgtcgcgatcagatggctctgcttccttcctgcaacggtgacacctcatgtgcctgagtcgggtgtgtacgtggtccggtgccgagtgtgaaggtcagtcacaaggagatttatcaacaaggccacactcgaacgtgatcctgaggtccgacatgattgcggtcctagtccttggattgtttgctacgaagaaagtagcccgtgtgagtcgagcgtggtagtcaggtaagcatcagttggcgcagagctgtggtgcgctgcctgggcgactacggtgtagcaactcgctcgcgtgatccgtcccatacaacacggttgggatgtcgtagcctaggcgttgtgtacaaggccgagtgacccggtctactgcatcgcattggaccctggtatggtactggagagtgccccgtccttgccaatgtgtcctacttgggtaggatgcaaggattgctggctccagttgcggggcttcttcgttcctgatggaggtgtccgccatggcgcccctgggaactttccttgcaattgaggcaacccnccttcagctagacattgggattaccccttaaccattgcccacaaagtccacacgtacaaaacaggggacgtggcccccggagtcaaggttcccattggatcgcgtctttgctcgcttggtgaagcgaagtctgtttgggcaaaaccgtgaataggtcttagccttgaattggttccgaagtccaacccccaaagggtgaagacctacttggatcgtgcccaatgcaaccaaacctttgcacaggttctttcgcgaggccaaaggtatgaccgcgtaggggtcattttgccgcggactcccacaatgagggcctcccgccattttcaggatcaaaaagctagacgggttcttttccccggatgtttgcattagccccgggcggaacacaatcggccttggccaaggacagcaggcctgatttaaccctgtccccaaagaaggccgctggaagggggcccaatcggcccttgtgcgtgtgcccacaggggggggcctcggttgccccccgatttttggcgcgttgcccaatcccgaaggtttcaacacgccct

SEQ ID NO: 628313 - DNA, 1584 bp, Homo sapiens
  misc_feature (1192)..(1192): n is a, c, g, or t
ttttaatggggcttgggtgagggaggtagggggtagttggtgtttaatattttaagtggggtgatgaggaatagggtaaggagtatgggggtaattatgggtggggccaatacggtagtattatagttgggggcatttccgggaataggcctgaaaaatgtgttggtgggagaaagaaatgtataaattataccgccagatagaatattgatagtgagaaattgggattgtgggcggatagggttgggctcataggggtgtacgcctgtgagaaaatagggaggaaactcaggtagaattgaacgcctctccatatgtgatgtggcaaatatacaggcctcctatattgtgaatatggaccatatacatgtgtgagacatgtgggacgtctcacaaacgtgtgatatacacagtgtgtgaagtgtgtaatgtacacgcgcatgtgtccaaacatgtggtattgagcattttgtgtgcgtaatatcaccaatatgcgccccaagtccacatgcgcgcacacacatacccgagtgtggggaaacaaacgagacacaagagatatttggaatactcctataaagagagggcactcacaagagaggcacacttgcggcgcacgccaaggaaatcaatattacctcacattatatttggggcgttctccccgggtgtgggaaatgttgtttgtggcgcgagaaaaggttcacaaggctgattaacaacatataccctgatgtgtgggaaaacccgcaaccgccgcagttagaggggagcgaggaacatattagcagccgacacaagatagaaaacactactacaagactgggcggacaataaacacgacggttgtgaagggggtcgtgggaaaaccaaaacaatataaggatggcgacccaccagaagaggaagcgatgacatctaccacacaagcgggagacctcaccaacaaaatatcatcccaccagactaacacagggatgggtggacacaaccacacaattactacttataggttggcggggcgaggatggtggcgccactaccaacaaagcagcgcggaacagagatcaaaaaaaaccgacccacttaatataagagggagaataaaacgacccaccccaacaaatgtgtgtggaacagacttattaccttccacaatattaagagactcttccaaagaggcaacccacanatgtacacaccaccattgatagataggtgtgtattttaccccacaacaaggtagttggtgggggctcctcatccataatatgagagtgattgactaccccccgggaggagagagaataacgaaaacaacaaggagttataaaccaccaaactcatcaacgggggggcgacaacgcacatcatcataactattacccgcggatagaagcaactccacgtagggtgactaggcagcaaaaatagacagagcaaccaattatcatatatcacaccactactatccagcgaggagtaatgcacccacccgggaagaaagagaatagtccgacgaaacaacaataaaggggagtgagaatcaggcggcgcacaacaaaacacaccaaaagagggggg

SEQ ID NO: 628314 - DNA, 780 bp, Homo sapiens
gaacgaagggaattttgcttcagcctctttggcgggacaaggaagggatttcagtcaccctggaaggggccaatttcgggctgagatcaacatcttgctgtgtgagcaacccgtggtaccagcaagtcccagctgctgcatgtacgtgtacaaccatcgtcccctatggggccagtaccgacgtctgggaagggctccagtgcagttggctctcccttgcgtacgtcttgaaagaccctgagacaaggcagctggtcctgcagacaggtgcccttgtcctgagtgacaacggcatctgctgctatcgatgagttcgacaagatgactgaaagtacaagatcggtattgcatgaagtcatggcacagcactactctgtccatcgcaataggactgggatcatctgtcagctcaatgcgcgcacctctagtcctgagtctagccatgcattaatcccattgagatctcaagtggagactcctcatgagaaatcaagcattgaaacacatccaggtgcctcatagctttattgatcaaggtttgatttgatcttcctcatgctggaccctcaggacgaagcctactgacaggcgtctggctcaccacctggtcgcactgtactaccagagcgaggagcacggcagaggaggagctcctggacattggctgcgtgctaaaggacgtacattgcctacgcgcacagctaccatcatgctcgcggataagtgcaggaagccagccaggctctcatcgaggctttatgtagacatgacgacacactg

SEQ ID NO: 628315 - DNA, 1258 bp, Homo sapiens
  misc_feature (478)..(478): n is a, c, g, or t
  misc_feature (901)..(901): n is a, c, g, or t
cgcggcgggagcatgttcctggctcctgagctggatgcctgtggccgatgtgcttcctgcgtgtgcctgctgggtgcgtgctgtgtgcctgtggggctgctcctgcgctgccttgctcccggtggcttgtgcatgtgagtgtcctgtgggccctgatgtgtgcatggtgcctgccatccctgatgtctgctgcctgcactggtctggtgtgcccaggtgccttgctgcctgctgcttggcatgcgctacgccttgtgttcttcgagtgccctgcttgcgtgcagagcgagtgaggagccagcatggggagcccgactgtgggccgtctgcctgagtgactggggctggacgatggccgatggcaggaggattcaatccatgtcttgctagaatgcgaagccagaagttgaggcatttattgacacaggattgattggccaaggacaggacgggctagaagtttagattttttggcatngaaccggcctcgttccgctcttcggcacttaatcgagaactttgaatagaccagaggaaatgtgcccattcaacgtttaacagcctatagttgcacttttcgacgtgggcccaaaacttataaggcatttttaattacccgggcgcgtccagcgctttgaaaaacatttgccttggaacaaagcttttttttagaagtgcgcaaccaagatagaggttaagcctttcctttgggaagcgcggtgccattgaaagccatcggaggtgaccaaattgccaattacactttggaaaacgtttacccctaagaaggcttgggccaaggtattcttagttgacttggcgtgcatgaaaccaggaacgagcggaactttttggcctaagtatgccttaggcgactaattgcaggatttcgttgcaattntttcagagcgttccttaaggcagggcagaaccacagactttggaccaacggcagcacccaacgcgacgattacgccaggcaagaacgcatttacttgttcaggctcggaacggacggaaaacgcgccaaataagcccaagctttcattctttggcggccaattgttgccgtttaggacggcccttgttgtctcgcttacctatcgtggttcttcccagagcagcccgtccacaaggccaccaacagcgatgttattgcaaaaaagcttcttgcgagaattctgagagaaattacaaggtgcaagaacaccaaaagaccaattgtgcctgcataagtggaacctggggtaatagcatg

SEQ ID NO: 628316 - DNA, 399 bp, Homo sapiens
cgcttggcgctttcggttgcccaggctggtgtgcaatggcacaatctcagctcactgcaacctccacctcctgggttaaattctcctgcctgagcttcccgagtagctgggataaaaggcacacgccaccatgcctggctaatttttgtatttttagtagaagtggggtttcaccatgttggccaggctgctttcgaactcctgacctcaggtgatctgcctgcctcggcctcccaaagtgctgggattacaggcataagccattgcacccggcctctgtactccgcttttaattattttgggtatatatccagaagtggaattgctagatcatatggtaattctatgtttacttttttccatagcaactcgaaagcaccaagcggggtaccgagctcg

SEQ ID NO: 628317 - DNA, 185 bp, Homo sapiens
tgtgtcttccccggggttatgtataaatatagagagatgaggccttctctcccctgctctcccttccgctccgtgctgctctcccttccgctccgtgctgctcgccgcggtcccagctcctctttccacatgagggcgaagggaaggggggatgaacaagtcatcaccgaattgcaatcgtcgac

SEQ ID NO: 628318 - DNA, 161 bp, Homo sapiens
acaaggcatattctgacttcttgcaattcaaataagatggaggttcctacagagatctgattacctaaagccccatgcctgataagcattgatgtggaaagacacacacagacttggggcagagacgacagctgcacagtcatgggccatcgggaacgggg

SEQ ID NO: 628319 - DNA, 2862 bp, Homo sapiens
  misc_feature (1198)..(1198): n is a, c, g, or t
  misc_feature (1854)..(1854): n is a, c, g, or t
aaaacattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctntgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggntgaaaccctgtctctactaaaaatacaaaaaaaaaaaaaaattagccgggcgtggtggtgagtgcctgtaatcacagctacttgggaggctgagatgggagaatcacttgaacccgggagcagaggttgcagtgagccgagattgtgcccctgccatccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 628320 - DNA, 306 bp, Homo sapiens
ctaggggcctgctctgtcgcccatgctggagtgcagtggcacaaacacagcggactgcagccttgacctcccaggctcatgcaaccctcccacctcggcctctcaagaaactgggaccacagcccccacctaggaactgactcagagcaagaagacagctccgactccctgtgatttcatccctgaccaatcagctcttctagctcactggcttcccccaacccacgaagttgtccttaaaaactctgctcccgactgctgggagagactgatttgagtaataaacaactggcctcgttggcctca

SEQ ID NO: 628321 - DNA, 888 bp, Homo sapiens
  misc_feature (664)..(664): n is a, c, g, or t
  misc_feature (696)..(696): n is a, c, g, or t
gaaaaaaaaactaatttccttcccaatattaggacttagaaaagctctaggtcccgcaattggaatttagcctaggggaatcaaaatagtaggagcataactctgggtttccttttcaaaatcccacacctcatccttcctgcgaccgcatgttaccaacattggtagttccaaggacaggtgcgtgtccatcccggtgtggcaacatcctgtaaaacaagtgctcagctctaggggaatgaaggctgttggctggctgatactgaaatagaccttttctctacagacatccctcctaccaacgcagggacttcactgaagatgctatttcaccaaaatctgcaattgtaaactgaaggacatcgcatgttaaaatgtggggaccatggtcaggtcatcatgtgattgtccatatagtccctgtcttctttcctgcaacaacggacactttctggttgtttcacaagcaaggcagtttttggattataccagactagactccacaggtgtaaacgtcctaacttgtgggggcaactgtgccagaagatagaagagagtaccgctgacggatgtgttcaatatctccagcagagggagtgtttcagataacgtggctctcggacatacttgactccaactcttgctatttaacaattattagtgngccaacttaaaattgtcagtgcgcgtgccttnttgggaacaccagtgggccttgtgagagaataaataccggcctatatgcccagtggttggagccggaagtggttccataaaaaaccccccgcgattgccgaggggggtcaacaaacgggagagttacatacacagacgcccggggggtcacacacgcacaacctgacaggcgctaccatatatagtggcaga

SEQ ID NO: 628322 - DNA, 3242 bp, Homo sapiens
  misc_feature (1)..(1): n is a, c, g, or t
  misc_feature (1578)..(1578): n is a, c, g, or t
  misc_feature (2234)..(2234): n is a, c, g, or t
naatttgcgttccttgggagaagccccagctctgtctgcagtggcgtaccaggggggaacaaggatcccttctctaagacccttcacaataccagaggctgcctgcctattgggtagaggtgcaaactttcccccactctgcccagcacagcaattgtctctgcaataggaaacttcccaccagtgaaaagatctgggactcaagccctgccattcagattcttttgttccacagggtattcccttgatgtgatgttcttccccttcctctaggaatgggacttcctggaagccagactacagtgctcttctgggtctagccacccagtgggcctaccagactctgggctggtgctagggaatgtctgcaagggatccagtggtgttacctgtcttcaagactcccagcagtgaataccagcaccatctctgacagaagtgggaggggagtgatgcaaactctgcaagattccttggttgtagatagacttagagtattgactttctcaaatgctggttataattatagtgaacttatcacgtggacagacgcaggacttctggttagccagggtgttgtaagcagtggtgatagctgagaatatgcagccgttttctccttcctgggtacagtgctattctgcctagagagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctntgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggntgaaaccctgtctctactaaaaatacaaaaaaaaaaaaaaattagccgggcgtggtggtgagtgcctgtaatcacagctacttgggaggctgagatgggagaatcacttgaacccgggagcagaggttgcagtgagccgagattgtgcccctgccatccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 628323 - DNA, 619 bp, Homo sapiens
agcgggcgacgcgtttccgggggcgggggggtgggggtggggagggggcggtcaggccggcggggtggggcggtggagaggcgggagagctctgtcccggctgctcccacagcccggcggctgccgcaaacccgcgcgtgcgcagtagcggccacctgctggtacctgggccggtctgggatccccgggatgcccaggaaagaatggcagttctccgctgtgtggagtctctcaccgggcctagacctagaaggcaggaatcccaggccggtcagcccggtggagggggcggggcggagacacgcccctccgtagccagccaggtgtttccccgcgaaagagaggcacgcctggccgaagcaaccgacccgtcccaaccccgcgtctagagctcctccagcagagcccggtattcttcctcgctgaggggtgcttccagcgaggcggctcttccgaggactccagctcccccggggtctccgtttctgggaaagggttagacggcagataaactgtttcacgttagacctgtaacccaaggagatgtgtatagagctgagatgaagaaattccgtaaaatattcagatatatatgcaaatgaaggtgactgtagaaaag

SEQ ID NO: 628324 - DNA, 2667 bp, Homo sapiens
  misc_feature (1003)..(1003): n is a, c, g, or t
  misc_feature (1659)..(1659): n is a, c, g, or t
ggggaggtgaggaagtggagagagcagctgtggtggctgaagggtgctaggacagagggagcatgataaagccatagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctntgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggntgaaaccctgtctctactaaaaatacaaaaaaaaaaaaaaattagccgggcgtggtggtgagtgcctgtaatcacagctacttgggaggctgagatgggagaatcacttgaacccgggagcagaggttgcagtgagccgagattgtgcccctgccatccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 628325 - DNA, 2642 bp, Homo sapiens
  misc_feature (978)..(978): n is a, c, g, or t
  misc_feature (1634)..(1634): n is a, c, g, or t
aaaacattcagagacagaaggtggatagacaaatctccaccttcagactgagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctntgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggntgaaaccctgtctctactaaaaatacaaaaaaaaaaaaaaattagccgggcgtggtggtgagtgcctgtaatcacagctacttgggaggctgagatgggagaatcacttgaacccgggagcagaggttgcagtgagccgagattgtgcccctgccatccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 628326 - DNA, 298 bp, Homo sapiens
cccccctggttttttaaaaggaggggggggcgggggccctttttttccccccccggtttttggggggggaaaaaaaaaaaaaaagcggggggggcccccccttttttttttttttttcccctttccaaaaaaaaggggcccccgtttttgggggaaatttttcccccgcccccccaaaaaaaaaaccccccggttttttttcccccgggcgggttccgggggcccgggggttttttttttccccccccccgtttggggtttttccccaaaagggtccccggttgtggggcccccccca

SEQ ID NO: 628327 - DNA, 2655 bp, Homo sapiens
  misc_feature (991)..(991): n is a, c, g, or t
  misc_feature (1647)..(1647): n is a, c, g, or t
atgtaccatttatcaccaaatttatctcataacctaagagctaccacttacaaatttgaagggaaaaattactacattgtaatactcaagccaacacaaagaatcctatcccagtttcttgagtggatgggcaagaatatggggaatttattatgcagtaaccttcatctctcttctacagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctntgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggntgaaaccctgtctctactaaaaatacaaaaaaaaaaaaaaattagccgggcgtggtggtgagtgcctgtaatcacagctacttgggaggctgagatgggagaatcacttgaacccgggagcagaggttgcagtgagccgagattgtgcccctgccatccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 628328 - DNA, 2628 bp, Homo sapiens
  misc_feature (964)..(964): n is a, c, g, or t
  misc_feature (1620)..(1620): n is a, c, g, or t
gacctggttctccttgctgagttctctaccttctgtcctgacttgcatgctctccctctggaacctgaagctgacccataatgcctgggagcatgagctcacccatacacctccagcccacccccagcacagctgagcactggattatccacagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctntgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggntgaaaccctgtctctactaaaaatacaaaaaaaaaaaaaaattagccgggcgtggtggtgagtgcctgtaatcacagctacttgggaggctgagatgggagaatcacttgaacccgggagcagaggttgcagtgagccgagattgtgcccctgccatccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttat

SEQ ID NO: 628329 - DNA, 1210 bp, Homo sapiens
cacccatttgctgtgagtgacgacaccacgtcctcatctccactgaatttatattcgttggctgacgggagtgcggggaaacaagacaataaagtcggctaaacagtacctaactaagtacaaacaagctctggacctgagtctacacgatctgtgcactgaactcgccgcagacaacactgaaccaactgcagccacactgcagcgtacgcacctacgtgcaggcgcggagtgacgtacgacttctcacgcccacgcagagcactgacgggcactacgccgtcatccacaggcaggctgcacactgtgcacttgaagaccgtgagccactgaggcagctctgagatgaacagctactattccaggcagaggaaacagcaggtgcaaaggcctgaagtcatgcatcagctcagctttcgtgtaggaaaacactctgacctcagctggcttaacaccaaataatcgttcataatctcatgatgtctgtgggatcagaggatccaggctgagccctacgccatgtgcctgtacggtgataggacaggctagcagaggataatcccagcccactgacaggcaataaacccaatcggcactcagagtgggcaagagtgcgcctaggtccaaccagagatccaggcacgcgatgtgccactgtggcgaaacagcggtcaccacgcagacggaccatccacagatcaaactaacacgcccttacaccaatatatcagactacctacttgctccctacctgaaaaccaagaaacacatgacccgagcactaacaggggcatgcaacagagacggaatccacaactcacatggatagccgaccgccgacgccaaccatgaaacagcaagacacaacccatcatccaaccacctcacacaagctcacggcgaaaccacatgagagcacacacacacacaagagggctacaaccacaaaaagagagcaacaacacataccaacaccacaagcacagcatcaaaccacgcaaatcaccccctcacacaacccccatcacaacgccaaccacacactgaccacagcggcgaacaacacgagaacacacgacacaccccaggcgccaccgccggcctaacgaaccaacaaccacagcgcaacacaacacacccaacaaacaaaaaacggcacaaacagacgacagccacaaaagaacaaaaaaacaacacacgcaggaacagt

SEQ ID NO: 628330 - DNA, 383 bp, Homo sapiens
tctacataaacgcttaatgtgtcactcatttaacccttaccagccaatcttgaacgttggacattcttctccccactatatatggataggaaactgaggcacagagtggttgaggaatgtgcccaagatcacaccactaggaagcaacgagccagggtgtacctactacaaaggctcccttgagaggtggtttccaaggacgggcccacgcacaggtacacagagagcctcagcatgcccagtgttctgcaaagcagccgggagtaagacgaagaaggctcagaattttcctgcattttccctgttccttgcccccggaagctgtgcctgaatataggcctttcactaggtagagtggtacactcagcccctcatcttacagt

SEQ ID NO: 628331 - DNA, 799 bp, Homo sapiens
  misc_feature (1)..(1): n is a, c, g, or t
  misc_feature (685)..(685): n is a, c, g, or t
  misc_feature (716)..(716): n is a, c, g, or t
  misc_feature (718)..(718): n is a, c, g, or t
  misc_feature (725)..(725): n is a, c, g, or t
  misc_feature (729)..(730): n is a, c, g, or t
  misc_feature (765)..(765): n is a, c, g, or t
naatttgcgttccttgggagaagccccagctctgtctgcagtggcgtaccaggggggaacaaggatcccttctctaagacccttcacaataccagaggctgcctgcctattgggtagaggtgcaaactttcccccactctgcccagcacagcaattgtctctgcaataggaaacttcccaccagtgaaaagatctgggactcaagccctgccattcagattcttttgttccacagggtattcccttgatgtgatgttcttccccttcctctaggaatgggacttcctggaagccagactacagtgctcttctgggtctagccacccagtgggcctaccagactctgggctggtgctagggaatgtctgcaagggatccagtggtgttacctgtcttcaagactcccagcagtgaataccagcaccatctctgacagaagtgggaggggagtgatgcaaactctgcaagattccttggttgtagatagacttagagtattgactttctcaaatgctggttataattatagtgaacttatcacgtggacagacgcaggacttctggttagccagggtgttgtaagcagtggtgatagctgagaatatgcagccgttttctccttcctgggtacagtgctattctgcctagaggtgagtttttgcctgtctcacagagtaggctgcancctgccacttctttcaaaagttctgtgatcngntcagctntccnntcagttccctgctgtcgccccaaacttttttctgncttggcgggagtgactttgtgggatgtggcagag

SEQ ID NO: 628332 - DNA, 1382 bp, Homo sapiens
taaatgtccagttccctttaaaaacccccatctccctgtgaaagggcaggtgtgcaggcagcttaggttgagtggcaaaaaatgtgtttcactttgaaaattctttgcccgtgattgtgaaggctttgtgcccacatgtgcgtggaagggcccccttcccagagaaaagttacttctcgaacccacggcgttctgtgggctcctccttcgcgctgtgccagggtatctccagtattctccgcacagtgtgtttatatgaccctcgataagttcacaccgtgtcacaatctcgtggaacttcaggcgagaaagggacaagctctctcgtgggtctctccgagaaagacccccaaacatctacacagaaaatatgggactgtctgagcttatatgtgtgtgggtttcccaagaaagaaggtatgagatccacttgaggcaaacaagtgcatttctatccctccagtcttggtccacatgtccgcgctgggagaacctatttccccagtgtgagaatgacaaaggatgtgcgcgactctctccattgagaaaggtgtctcttgcgaatgtgagagttttctccttacacggggagaaaccgcgagaataatctcctggagatgtaaccccacccagtgtggggaccccatcgcgcctgctcctctatatatttcacaaagtgttggctcccccccaaaaggaaactatttcattggggccaatggggcgccccacacacaagcacagactgtcgtgttgtgttccccctcccattttgggagggattgtttaaccttgtgcggcccgccttataaaattttgcacattatcccaagacacaaccacaaagggggaacctctctagggggggcccactggttgtatgcccagaacacggggtgttcccctttgggctctcttggggggtctttccagggcaaggctcatggcggccttgtgtttctcccccttttttcctatccctatttcttgccctgcccctcacacggggaagccctgggtgtcgccagggcccggcctcttattgatatcctctcgccgtcccgttatcgcgcgctcaggtcctgtgggggactcatttgagggcgtttctttcttttcccccggtttgtaaaccccccttctctcgttttccccggcgggaccgtcttgaccccctttacataaacgagaactggggcatcctctttgccacaccactttttttaacgcactttccacaccggtgggccaccattatctatctcaagcagcaaatttgtaccttactggtccccaagatactaggcccacaaaattgtagggcccttgataaacacgccataggttagaaaccccaactgctgtggtcactggtcacaccc

SEQ ID NO: 628333 - DNA, 410 bp, Homo sapiens
ttgcaagtaagtaagtttcttcaaagaagacctatatacaaaacctctccaatagacccaagggttgcgctggccggtggaaggcagccatctacagtgaggaccagcggggtgcattgacgtgcagcctacacaagggagcgtggttcctagtctgcagcggtaccctggtgaatgagcgcactgtggtggtggctgcccactgtgttactgacctgggggagggtcaccaatgatcaagacagcagacctgaaagtagtaggggggaaaattctaccgggatgatgaccgggatgagaagaccatccagagcctacagatttctgctatcattctgcatcccaactaatgaccccatcctgcttgattgctgacatcgccatcctgaagctcctagacaagccacggt

SEQ ID NO: 628334 - DNA, 110 bp, Homo sapiens
cgacatggtggtggtgggttttttggtttgtatttgggttttgtttttgttttagttttgtccattcagccactctatatctttgactggagggtgggtcagaacataag

SEQ ID NO: 628335 - DNA, 241 bp, Homo sapiens
caggtcaacatcacattctggatagagtgtagaaaagaggcgggcttcctaaatcctgacatgaaggcaagattctcgtaacagcctttccctatctgcacactggggaaggataaagttacaacgattccaggggcactcagccttacttgggtaccgtatttgtttgcgggtagggaacattcccttcctgcttgggtatcatggatccacagatgccatacctcaagatggtgagtta

SEQ ID NO: 628336 - DNA, 687 bp, Homo sapiens
gggggccaacaatcaacattcttaaagaaaagaattttcaatccagaattttatatccagccaaactaagctccatgagtgaaggagaaataaaatcttttacagacaagcaaatgctgacagatttgtcaccaccaggcctgccttacaagaggtcctgaaggaagcactaaatggaaaggaaaaactggtaccagccactgcaaaaacataccaaatgtaaagaccatcgacactatgaagaaatgcatcaactaatgggcaaaataaccagctagcatcataatgacaggatcaaattcacacataacaatattaaccttaaatgtaaatgggctaaatgccccaattaaaagatacagactggcagatggataaagagtcaatatccatcggtgtgctgtatttaggagacccatctcatgtgcgaacacatacataggcttaaaataaagggatggagaaatatttaccaagccaatggaaagccaaaagaaaaaagacaaaaaaaacaggggggggggtcacaaacccgaagctccgggtaaacccggttttcaccgcacaaagaaaaaagcaacacaaaaaaaactggtgggcgcggccgccacggaaaaaattaaacccaaacatgggcgggggcccaaatcatatacaacgcgccgaggagcctaaaacacgggccga

SEQ ID NO: 628337 - DNA, 87 bp, Homo sapiens
ctagaagattcagcaaagtacttttgtgctcttggggaccttctagtggtccttccgattaggatcagaggtcccgataaactcatc

SEQ ID NO: 628338 - DNA, 572 bp, Homo sapiens
  misc_feature (53)..(53): n is a, c, g, or t
  misc_feature (122)..(122): n is a, c, g, or t
  misc_feature (219)..(219): n is a, c, g, or t
  misc_feature (283)..(283): n is a, c, g, or t
  misc_feature (292)..(292): n is a, c, g, or t
  misc_feature (355)..(355): n is a, c, g, or t
  misc_feature (371)..(371): n is a, c, g, or t
  misc_feature (428)..(428): n is a, c, g, or t
  misc_feature (440)..(440): n is a, c, g, or t
  misc_feature (453)..(453): n is a, c, g, or t
  misc_feature (467)..(467): n is a, c, g, or t
  misc_feature (488)..(488): n is a, c, g, or t
  misc_feature (510)..(510): n is a, c, g, or t
  misc_feature (567)..(567): n is a, c, g, or t
  misc_feature (571)..(571): n is a, c, g, or t
aacaaatagactaacagactctgctagcaaagaagacaagtaaaatctaaaantgtaaggctggtcgtcaaagtttgggaactgtagaagcacaaagtaggagctctaccccccagtagtgnaagtaaagtcaaagaggagtaggtgaagtctagagaaccccttattcaaaggagcaggggctctggtcggtgtgtagttaaaatacttttcagaganttccacagaaagtataacttcttcacaatgtccagcagagagaacatggcaaagaaagctggtnagaacaggnagtctcagctgtagggagacgttgttttggttctcctgagtctggttaggcgtctcagaggtngcctctgtctcctctnttgcagccgcctgtctcctcctccaagtagttccttgtgatgaggcgtgtcccagtntgctgaactgcntcctgtctctgtnggagcaaaggtgcntctgactggagcctcttcggntcctccagtgcttcttcctccntagccctgtggctgccagttctgacaagccacaacacagtccaagtcttccactccncccng

SEQ ID NO: 628339 - DNA, 149 bp, Homo sapiens
tagagtatcactgcagctctcgatgcccaggctggtctcaaactcctgatctcaagtgatccgcccgacttcgcctcccatagtgctgggattacagacatgagccaccgcactcggtcctgtgaattccatttttaacgagaatacca

SEQ ID NO: 628340 - DNA, 273 bp, Homo sapiens
gactctacaggatcccagtcgacgaactctcctgtgttgtgttagatgaagtatacacaggaatccattttgttatgtactaagaaaaattcttttgcctttggatgctgttaatctataaccttaccctcagacccatgctctctgaaacatgtgctgtgtccactcagggttaaatggattaagggcggtgcaagatgtgcattatgttaaacatgatgcttgaatggctaagaccatgctctgttagagagtcatcactcattccctaaa

SEQ ID NO: 628341 - DNA, 522 bp, Homo sapiens
cacgcacgtgccataaggctggtcttcaaactaaagtcaagaccggcccttccttttctaagcgcccccattataggtcaagtcaactttaaatgcccagctgttgtccccgcccccctgagtcgtttatttagagcccagaaacagctagtgggccaggcaaaacaaaaacgtgtccggccatgacaagtaaagttcttctaatacccagtatggtttcgcaggcggtgtattaaaagggacctaataaatcgttgagaatccccccatgtcagagtttggttggacacctaagtctggcgtgccagcggcaatagtagaatgccttaagtgtgaaagcaaaaaaggttttcctaaaaaagcactggcattttgggaatcctgtaaacatttgttccaggtaccaagtgtcgctggacaaaaggaaagctaaaggggagagggcaaaagtccctgtattattccggccccccgttttttcggctatattgacaaaaaacccaccgccaaagatggaaaaac

SEQ ID NO: 628342 - DNA, 188 bp, Homo sapiens
tcgcgcagcatcggccagcccttcggatcgtggtagcgcaggaacgccttgtgcaggcggcgctgctcctcgctcttgacgatggtcacgccgtcgctcttgtaggtgaccttgcgcagcgggttcttgcccgagtggtacatggccgtggcggtggccatcggcgacgggtagaacgcctgcgcctg

SEQ ID NO: 628343 - DNA, 332 bp, Homo sapiens
ggaccggtttaagaatctgagattttggccaggcagggtggctcacgcctgtaatcccagcacttgggaggccgaggcgggtggatcacaaggtcaggagttcaagacccacctggctaatatggtgaaaccctgtctctactaaaaatacaaaaattagccgggcgtggtggtgcagcacctgtagtggcagctacctgggattacaggtgtgcaccaccatgcccgactaattttttttttttggatgtttggtagagatgggatttggccatgtggctcaggcgggtatctatttcttctggaatgaatttgggtgtcaggggagaaga

SEQ ID NO: 628344 - DNA, 119 bp, Homo sapiens
ttcactttctacactctcagcagtctgattcttatcaagccagttgataatttcattacacttgtccagaatcttctgtttgtcctcatctgttagtgtagaaatttgaacgggtacct

SEQ ID NO: 628345 - DNA, 257 bp, Homo sapiens
tttttttccaaatcaatacctcttttattgcatcatttaaatatcataagtaggtcttaagtgtcatctggcatctcctttctgtagccaggtaacctcttagatcttctcatcagcctgctgaacagttccttttttcagagacatagatccatccaaaaatttcctgatatcctgttttactgttgtggcttctgaatcaaagcgctgaatttaaacagctaatctacttccttaaggattaatcatcttctggg

SEQ ID NO: 628346 - DNA, 138 bp, Homo sapiens
gggaaccttttgggggccccccgggggctggacctattcaaggaggccccgttccccccccccttttgtttttggggccctgctcccctttgggggggggggggggggttttaattttttttatggaaaaatttgcca

SEQ ID NO: 628347 - DNA, 191 bp, Homo sapiens
aaatctacataaattatgctgagatgtcttcaacttaaagcttttttttgagacagaatctcactcggtcactcaagctgaagtagtgcagtggcataatcacagctcactggagcctcaacctcccaggcacaagcaatcctcccacttcagcctccacagtatatgggactatagataggcatgtgcca

SEQ ID NO: 628348 - DNA, 941 bp, Homo sapiens
gctctctctctctctctctctctctctctctctctctctgtctaacactccatgtgaccaagtcagtatcagccaaacagtgaacactttggcctgcccgtcctctccaacctggcgacctgatctggctacgcaacggggcccccgaaattgcctcggcctcctgccagtgctaccactgggactgttgtggtggtgcacccaacagctgggggacttccaatgctaggtcactaagaggagggcttccagcagctggtagccagctactgcccagaggtggtggaggacggggtggcatgaacaaacagatgagggtggcagtgtacccgtacattatacagcacatcgacgtgtgatgccaccagactgtgtggcaaggccatgctgtggtgcagacaggtcctactgtgaagtgagttcgctgtgtgattgtgcacgctctttgttgctggacgtgctgctcccagtcttatatgacttgactctaaaggacacggaacatcatgaaagtctatcactgaaacagagggaatgtagcacagcaatagcacacaaaggacctgcctgtggtgctgcccactgagacccgccaactcaacggcctaggcccctaagaacccggtcgattaagcgacggggagccaggtcatggtcaagcaggcccgcggggtgccgagtcttcagtgagtcagagaatatggccactcagcatcatgacagaacgcgcagggatccccagtgtgcccccggcccggtccgcctgctccggagaaccggaaactgcgggttcaaacctcacacacaggacgcgccggtaccgggaggaagacgaaacggcacggagacccacacgaacagcactaacgaacaacctctccgcttaacccgtgcagcgcaactcaccacaacggaccagccaacacacctggcacagtcac

SEQ ID NO: 628349 - DNA, 92 bp, Homo sapiens
cttgaatttttgtttttggaaaaaaaaggttttttttctttggtggaaacccccggttaccctggttggtaccctgataccgggtgtttcca

SEQ ID NO: 628350 - DNA, 257 bp, Homo sapiens
ccggcacttcctgtacccttaggagtttgtttgtttgttttgagacagagttatcagtgcaacctggccctgatagtcacgtaggttcttttctgttttccctaagcgttggctgggttgagaaataaagagacagagtacaaaagagagaaattttaaagctgggtgtcctggggagacatcacatgtaggtaggttccgtgatgccccacaagccgcaaaaccagcaagtttttattagggattttcaaaaggta

SEQ ID NO: 628351 - DNA, 125 bp, Homo sapiens
ccccccaaaaaagggggggggggggttggggggttaaaggccccccctttttttcccttggggtccggcccctttttggggggtcccccccccctttttttccaggggcctttttttttttttca

SEQ ID NO: 628352 - DNA, 280 bp, Homo sapiens
cagggcccccttaatgcaggttggaatgttatccctggggtgggcttggaccccccctgctttttttttttccggcccctccccaactttcactgtaatttatggacccggcccgccggggtgttgggtgtatgtcctggcccttttttcacaattgtttgggtgtgggagggggtggtttttccctgaaaaggggggtaccccaaaagcttttttgatgttcaatcaatcagtccctgtgtcccaaacatattcaataaacccagattgggccccccca

SEQ ID NO: 628353 - DNA, 82 bp, Homo sapiens
cgggactcagccatgtatcgctgtgccactttcatcggggcacagccccagcattttggtgatgggactcgactctccatcc

SEQ ID NO: 628354 - DNA, 726 bp, Homo sapiens
gaacttccatgatatggaaatggaacggagatatggatagagaaagattgaagaattaatggaagaaaaatatgactttggaaatggcacagaaacacaagtatggatgaatcaatacatcttggctgggaactggcacagatatcccgaactagtgaactttccgaagcccccccgaaatccctgggccctgaggtgaatgagttgacatcaagtagattattgaagctagagatggaaaatccaagtttgaccaaaaccgttgaagagcttcggactactgtggattctgtagaaggccatgcttcccaaatccctgaaaatgggaaaagaaaatccaaggctccagttaaaaggttgagattctttgaaaatgagattgttccaagaaaacgccaagtctttccagaattgtccagaatttaagccaggatcttaatgaaggagaaagctccagcttgaaaaacaccaatagaacaccctgagagaaaattcagagagcaccagattaagatactggacaccaggaaaatggacatctgaatccaaaccagtgtcttccttaaggcagcggtccccagataagtgccagaagccagagtgaaagaccattgaaaaagaaacaccaaaattctttcatgaatctatccaagaaaccagtagccagctaagcccagattgaatttgaaaaaagaccaaatttaaaaagaattgggaccattatta

SEQ ID NO: 628355 - DNA, 392 bp, Homo sapiens
  misc_feature (65)..(65): n is a, c, g, or t
cgctcggacccttgatgtagctctccaagcctccatattacattttgtgtgttctcctgcctcancctcccaagtagctaggattacaggcatgcgccactaggtctggctaatttttttgtatttttagtagagacggggtttcaccatgttggccaggctgatctcgaactcctgaacttgagtgatccgcccacctcagcctcccaacatgctggcattacaggtgtgagccatcacaccctgccccaagtgggatttatcccaggaatgcaaggttggttcaacatatgaaaatcagtcaatgtaacatatcatattagcagaataaaggacaaaagctacatcactgtctcaatagatgcagaaaaagcatttgacaaaatccaaca

SEQ ID NO: 628356 - DNA, 245 bp, Homo sapiens
  misc_feature (219)..(219): n is a, c, g, or t
  misc_feature (233)..(234): n is a, c, g, or t
gtaattcgacatgtggaaatctttcgtaaggaactaggaatgaggacaattatttatgtataggggtgttctttactgtacagagagaaagttggccatgtgccatgcccttagtagtagggaaatagttatgttttactggaaagccatcaaaaatcatctttgaaagacttttaattgtaataggaaaaagttcagcttcagacaaggaagagcctnacagcacatctggnnagagagggagt

SEQ ID NO: 628357 - DNA, 1185 bp, Homo sapiens
  misc_feature (197)..(197): n is a, c, g, or t
cagaagtgctgcaggcgctgaccgacgattccggatctcagttgccacgcgcccccgacgaccgcccgacgtgcattcccgacttccgttttggttccaagtccaatatggcaactctaaaggatcagctgacttatataatcttctaaaggaagaacagacgccgcgcgcagcaatacagattacagttgttgggngttggctggctgcttcggcgatggcactgttgccgtatccaagtcatctgtgaatggaagggacattggtgcgaggatcgaactatgctcttgttagatggtcatgcgacagaccgagattgacagggatgagatgagtggatcatccgaagcgatggcaagcacttttccttagaacaccaaagattgtctcctggacagaagagctcataaatgtagagctgcatagactcctaagactggctcattatcacggctggggcaacgtcaagcgaagagggagaaagccgtcttaatttaggtccagcgtaacgtgaacatcgtttaaagttcatcattcctaatgttgtaacataccaggccgaacgtgcaagtagcttatggtttcaaatccagtggatatcttgacctacgtgggcttggaacgataagtggtactcccaaaaaccgtgtaattggaagtggttgcaatctggattcaggcccgattccgttacctgatggcggaccacggctgggagttcaccacttacgctgctcttgggttgggtccttggggcgaaccgtggaggatttcccgtgttccctgttttggcactgcgctcgacatcgtccccggcccactctccaccctctgccgcccgcttcgcgctcctcacggctcgccccgtgcaccacgtccctgccgtcgtcccacagccccacacgcagcaccaacccccagggcacccacccggggcgactgaccacgtggcaagccttgggccgcgaccgcactggaaccccacacccggcgccccccgctccccgcgcacacggctaacgacccaccggacccacccaaccccgcaccaggatacccaataaatccgacgtagaacagctagtcgacgatgaaaagcgagcgcgcgacgagcgacactgcagcaccacagcaaccaacgccctcccaaccccaacaccacctgatacactaatgaacacgccc

SEQ ID NO: 628358 - DNA, 515 bp, Homo sapiens
  misc_feature (77)..(77): n is a, c, g, or t
ggctgacctagagtttcccgaaaagctcttttctttcttcctatcctactaaggtctgagggccttaggtgtagatnttggtgcagtgaataatacaccgtggttgtagagagttctaagaaaacattgtttgttttaagttggcctgttgagcttggcaagcctttttctaggaccagcctgactttggtggctctcagaatggagagcaagtgtggggtcctgagtcccacccaagtgacccccaacctggaaacgtgtgcttctgcttcagagggttcctgcagtagacacaaagcccttcatccattcattcatttaacaagtactgtgtcgttgggggctgagcctttgcagatcctgggctaagtaccaggggtgcagcactgaacaaaatgcatgaaccttcgcctcccaacatctcagagctggatgtgttgtgttcaaaatggtattttatcagagcagcttaatggtccacagaaggagtgcaggcccccacaaataaattttgt

SEQ ID NO: 628359 - DNA, 257 bp, Homo sapiens
ctataagtgactctttatgatctaactcctgcctgcctttcctattgcttgagtactaagttacagcgacactagtctcctttaatttgcttgaattcccccagcattttcccacccctgggctttcgaacattctgtaacctctgtttacagagtgttcttctgtgatctttacgacgtatatttcaagtatttaaagatctagcttacagccatctgtggattctcaattctgtttcaagagatggagtcttgct

SEQ ID NO: 628360 - DNA, 895 bp, Homo sapiens
gatgaagtccaccgccgaggaaaatccgggtgctatgtagtccatgcgtcaaccccatccgtgttctgtctgccatttggctccgtcgtaggggcagatggctcttgcggccagcgctcttcctttgagcttggttgctgctcgactatgggtccctgggtacctgctagagccatttgcgggctcttggcgtgttgggaggtgcctggatgcggtcataggggttcctgcatttgcacggcaagttgttccagggtttcagagtcgtcagggttgctgcgtttcaacacagtcgccattacatgggcatgtgcgtcgtctaacgctcctattcttattgagtgtagaccctctgtaagcatcagagactgacagtgcctgaaaggcataacgaggtccttgagcgatctttgtcccatgagtcatatgtcgtgtgaccccacctcacgaaaattggttccccagatatttttcattgtggctcctgtcctaaatacattgagcgtggtttgagatgtgactatgctatgtttggttgtgtggacactgtgtgcatagctctgcgtgatgtgtttgttggctggccttggtgggtcgctttgcgttccagggatattggctaaggagccagcgaagtactgcactcgaccatggagctgctcgggttggacagactctgaattatgtgttgagcgttgatcgttcccatgcattataccaccgcagatctattccgtagctgttagcttcatggacgaagaatcctcatctaaacccatatttgctcgtcagaaatccttagacatctctttgagagctctaccgctgcaggtttccccttatgcggtgtacattgtttttcccttgtgtccgcgtcccaatgacataacgcgga

SEQ ID NO: 628361 - DNA, 1381 bp, Homo sapiens
  misc_feature (193)..(193): n is a, c, g, or t
gcgcaggggatcttcgggaagctctttcacccccgcttctgccgggctgtaactgcaatggagcaggttgagatgaactcagtcagatggccccacggcccgctcctttcttagcagcccactaatgctccagaaccctcaggagaagagccaggcctacccccgccgccgccggcctggctgctacgcatancgtcagaaccccgaggccatcgcagccgcagctatgtacaccttcctgcccgacaacttctcacctgccaagcccaagccttccaaagagctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggccgacgggctgccgctgcacttcttcatccagactgtgcggcccaaggacacggtcatgtgctaccgcgtgcgctgggaggaggcagcgccgggccgggccgtggagcacgccatgttcttgggcgacgcggcggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgggtgcacccttttgtcaactacaactcgtcgcgcttcggcgagggcgtggagcgcgagctgttcgtgcgcgaacccacgggccggtta

SEQ ID NO: 628362 - DNA, 1348 bp, Homo sapiens
  misc_feature (193)..(193): n is a, c, g, or t
gcgcaggggatcttcgggaagctctttcacccccgcttctgccgggctgtaactgcaatggagcaggttgagatgaactcagtcagatggccccacggcccgctcctttcttagcagcccactaatgctccagaaccctcaggagaagagccaggcctacccccgccgccgccggcctggctgctacgcatancgtcagaaccccgaggccatcgcagccgcagctatgtacaccttcctgcccgacaacttctcacctgccaagcccaagccttccaaagagctgaagccgctgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggccgacgggctgccgctgcacttcttcatccagactgtgcggcccaaggacacggtcatgtgctaccgcgtgcgctgggaggaggcagcgccgggccgggccgtggagcacgccatgttcttgggcgacgcggcggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgggtgcacccttttgtcaactacaactcgtcgcgcttcggcgagggcgtggagcgcgagctgttcgtgcgcgaacccacgggccggtta

SEQ ID NO: 628363 - DNA, 1246 bp, Homo sapiens
  misc_feature (193)..(193): n is a, c, g, or t
gcgcaggggatcttcgggaagctctttcacccccgcttctgccgggctgtaactgcaatggagcaggttgagatgaactcagtcagatggccccacggcccgctcctttcttagcagcccactaatgctccagaaccctcaggagaagagccaggcctacccccgccgccgccggcctggctgctacgcatancgtcagaaccccgaggccatcgcagccgcagctatgtacaccttcctgcccgacaacttctcacctgccaagcccaagccttccaaagagctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgggtgcacccttttgtcaactacaactcgtcgcgcttcggcgagggcgtggagcgcgagctgttcgtgcgcgaacccacgggccggtta

SEQ ID NO: 628364 - DNA, 112 bp, Homo sapiens
agtcggtacctcttcttctccatatacagcagcaaccacagctccagagacacagatcaaggagaacaggccagcaatgatgcccacgatggggggataacacgttcgcgag

SEQ ID NO: 628365 - DNA, 305 bp, Homo sapiens
ggggaaagggcccccccctgggggtttttttgaaaggggggtttaacccccgtttttaacccgtttgggaaattgttgcagggggaaaaataattttttaaaacccggggggattcccaggtttttgaatccgcctttaaaaaaataaataattttcccctgtttaattgggggggaggggggggccccgcatatttttttagggggaagctttgcccccaaaaatttttaaaaagcttttttttccccggtttttttgtttttttttattgttttggggaaaaaaaatgtaaggggccccccca

SEQ ID NO: 628366 - DNA, 376 bp, Homo sapiens
  misc_feature (264)..(264): n is a, c, g, or t
  misc_feature (295)..(295): n is a, c, g, or t
taagttgagaactttcaccttttcatttaaaaggaagcactttgtggcttctctttggcatatccgaatcaccagcatcactactcctgctctctggggccactgttaagcaaagtgaggactacttgggcacaggcactgtgatgctgggatagttgatctgatcaccaagacggctactaagtcactagcagggtgggtggcttatacagcgtggatgtgctggaccaagggatgactcacatccccggccggctggagccnaccaggcgaggagatttcattcacgttactnagaagggcacacccatttgagacttaaaattctttatttctgggaattttcccattttaatatttttggaactgtcagttg

SEQ ID NO: 628367 - DNA, 712 bp, Homo sapiens
gagtccgggagcgcagttgggccgggcgctccgacctccgctttcccaccgcccgcagtgaagcacatcccgcagccgggcggactccgatcgccgcagttgccctctggcgccatgtcgcagaagcggagcgcccgggattgcaggaggagagcctgcaggggctcctgggtagaactgcacttcagcaataagtgggaacgggggcagcgttccagcctccggttttctatttatacatggagaccatggaaacaaataactgtggacgcacaagaattgagtctggaccggagtagctccaagagctctcactgtggacagcccacctcgctcgaagaacccaaagataccaaagagcttctgaaacagatacccatagcatgtggaggagaaaaacagctcaaagtcgtgaggaagatgatattcgaaagacaggaaagaaacgtgtgaaagcatctgtgaaagaaaaaacttcagatggggatatagggatggctcaagtcgcgcggaaaaattatctcccccccaaggggagttcctctttaaacacccgaaagcgcaggccaaccctcagctatgaggaacaccgagcgtcatgacgacaggggggcattattctcttgcagaatttctgagagtttccttccatctcttgggtctctcattgtgtggcatcgggagtggggctctatatgtggagggggtttgc

SEQ ID NO: 628368 - DNA, 743 bp, Homo sapiens
atatcatgtacaggaacccgagatctgagcaggagtacccttagccgatgtctctaacctcgcctttcataactaaagtcgagactacagtaaaacgttactaagcgagtgtgtttgtcgaccatggatctcaatcgatggtctgacgtgcaaaagcagatacagcatatgatggctttcatatgaacaagaagccactgagaaagcagaagaaatagatgtgaagggagaagaagagttgaaaaagtagagaagtggttcggattgtgcgaaaccaaagactaagagattgatggaatattatgagaagaaagagaaggcagattgagcggagcagtaagaagtaatccagatgttcaatggtgatgaatcaagcgagatcaaagaccgtctgagcaagagatgaccttatcagagatctactaaatgaagaataacagagactcagaacaggtaggtgaaagataggaccaggtaccaagtgcttgctggatggagtggttctcacaggggtagggtaacagttgttggaagcgagcgaaatgattgtacgtaaggagtgaaaaaagattttggggtcttggtaaagggttgagtgaagaaggcaagttcgtgatgtaccaatatgttgtagcagaaaagatgtgatgtgcggaattgagcagcgagtacttaccatgactgaaagacgatagatggtggagttgagatctgtgatgggggatagaaacaatatgggttaa

SEQ ID NO: 628369 - DNA, 260 bp, Homo sapiens
accgagtctgcgccacggcaactcagcctgggtgacagagcgagactccaactgaaaaaaaaaaaaaaattttggtttatcctgtgggcaagaaattttttcaaattttaggtccggtcttgccccacacagagacatttcagtcaatatgggatcacttatacaagggtggccccatatttttataatagagccgggcacaggggttcacatctgtacccccagcactttggggggccaggggggccagatcacttgag

SEQ ID NO: 628370 - DNA, 714 bp, Homo sapiens
ctattctttctctcccccccccaaggagaacagaaaaacagttatcctccactccccctccactcttttcttcctctctccctccctcttcctcttttcttcctcctccactttcaccccccgtctttctccccccctctcctcccccctctctgtttttctctctcttctctctttttcttccctcctgctctctttcttttcctctctcctctcctctttccctctcccgctgtctgggctcctcccctcctctcctctcctccttttttttatgttgcgtggtgtgtgttttctctcttttctcaatcgcagtttgttctgttatccatctccgccgccgccccctcccctctttgttttttgttttttgttcttctgggcgctgcgcgccctcctctctcgcgcgcgtttttgtgttgttgtgtgtttttttctgcttttttgtgtttgtgtcgcctctccctctctctccccgcgccctctccacccctctctctctctctcttgtttttgtgcccccctcctcctccgccccctcccctctctcgcgcgtgttcttctccacacccgcgctgttgtgttatttttttcggtttttttttttttttttttatccacccccctcctctctctcccctcctctcctcttaagaaaaaagagagagagagagttgtgttttttctttcccctcctctctcctctctcacaca

SEQ ID NO: 628371 - DNA, 541 bp, Homo sapiens
gcgacacgctcccacttcagattggtagagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatgga

SEQ ID NO: 628372 - DNA, 4363 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagca

SEQ ID NO: 628373 - DNA, 2207 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatgga

SEQ ID NO: 628374 - DNA, 3673 bp, Homo sapiens
tgggcaatcctttctttcagctggagtgctcctcaggccaagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagcttcaaaaatttcactattttgaatatccaggaagaacattaagggttcttcattcgtttgaccactaattttaatgggaatttttgaggaggcgattttttccctcagcccaataacccgtgataataccctacaacccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagca

SEQ ID NO: 628375 - DNA, 506 bp, Homo sapiens
  misc_feature (21)..(21): n is a, c, g, or t
  misc_feature (50)..(50): n is a, c, g, or t
  misc_feature (56)..(56): n is a, c, g, or t
  misc_feature (68)..(68): n is a, c, g, or t
  misc_feature (99)..(99): n is a, c, g, or t
  misc_feature (126)..(126): n is a, c, g, or t
  misc_feature (174)..(174): n is a, c, g, or t
  misc_feature (179)..(179): n is a, c, g, or t
aaactttaatgttcggggtcngtatgttgtggtggaaatggtgaaggggnataaanaaattcaacaanagggaaaacaggtaatgaccaatggattaangccaaaagctcggaaaattaaaccctnaactaaaaggggaaacaaaaaagtgggaagctcccaaccggggtgggnggccngctcctaagaactaaggggatcccccggggctgcagggaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatgga

SEQ ID NO: 628376 - DNA, 334 bp, Homo sapiens
tactatgctttatcggtcaatctgataagagcacgcattccaccacaaaggttcaaatcaacatttacttcgtctaaaaaccatacatatatgagaaagtgaagatatacttcttaaagaaaaaattaacttacgatgatcggataaaatctcagggaccatatactactatgcggccaccagaggctggcttgatcgctctgaagtaccaccacttgaaagctcctattcttagaaactaagtataaccacattgacatggttgaccgattaaaaaccgcagtcagctaattacactcactctcatcattcaccttagcagggtaccgagctc

SEQ ID NO: 628377 - DNA, 646 bp, Homo sapiens
ggtattaattcttccaatccatagcctggaatgtttttccatttgtttttgtcacctatgatttctttcggcagtgttttgcagttctccttgtagagacctttcatgtccttgggaagatgtactcctagatacttttctgtggcaatggtgaaggagattacattcttgatttcgttctcagcttacattggtgtacagatatactactgatttttctacattgattttgtatcctgaaactttactgaagttgtttatcaggtctaggagacttttggtggagtctttaagggttttctaggtatagcatcatattgccagagaagagagatactctgactaccttttttcctacttggaagccatttattccattctcttgcctgactgctttggctaggacttccagtactatgttgaataggagtggcaagagtgggcaaccttatcttcttccagttcttaaggggaatgcttctagcttttgcctgttcagtatgatgttggctgtgggtttgtcatagatgactcattgtgctagactgtaagttccttgggggcagggcctttgtctgtctcatctctgtattcccaaatgcctaacagtacagagccatgactcaataaatacatgttaaatgga

SEQ ID NO: 628378 - DNA, 132 bp, Homo sapiens
gcgtcgttatgactacacccggctcaagcccaagctgacccaggaattcctcaacaccgtcaacccgaccggcgcctataccgtcgatggcaaagacaagacctggaaccgcgtaacacccggctcaccaat

SEQ ID NO: 628379 - DNA, 190 bp, Homo sapiens
ctacgaatttgcacatacctgaatttctgccgttccttgcgtcctgacgacattctgactactcgtacctgcggcagcttttccggaatctgtgccatcgcccggcttcttctatgactacgtgttcgactggaacatgctcaaatttggtgccagccgggccgccgattacgccgatgcggggggtacg

SEQ ID NO: 628380 - DNA, 4697 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 628381 - DNA, 281 bp, Homo sapiens
cccccccccccccctttttttccggggggggagggggggttccaaaccgtttgttttccttggcccctttaggtttgggggaaaaaacggggttttatacccccagccctggtacccccctccagggagaaggggaatgttttggggccccccttggtttttttttttggggggggccggttttaggtttttgttttttaaacccgggctttttttgggggaccccctgcccccaaatttttccccgaatttttggccccccttaaaaaggtttttgggga

SEQ ID NO: 628382 - DNA, 289 bp, Homo sapiens
gccccggggcccccctttttttttggggggggggacccccccccggggggggtggttttcccccccccggggggggtgccccctttttttttccccccccccccgggggggggggggggtttttggggggggtttttttttggggccccgggccctgggggggccccccccacccccttttttttttttttgggggggggggggggcccccccggggtttttccccccccccccccggggggggggggggggtttgggcccaaaaaaaaaaacccctttttttttttga

SEQ ID NO: 628383 - DNA, 497 bp, Homo sapiens
tcacagaatataaaaacagccagtcatggtactcgtaaatgtaatcccagcattttgggaggctaaagtaggaggatcacttgaggccaggagtttgagaccagcatggtgcaacatagtgagaccccacctctacaaaaaaaaaaaaaaaaaaaaaggcggacctggggggcacttttttgtgtccctagggatccaaagggcgggggcaagaggtctcctttaaccccaagaaattcagggctaacagaagagctatgattggtcccattgcactcagcccttcggtgagagatgtgagcatttcctctcaaaaatttaaaaccaaaccaaaaaacaatctttttttcaggggctgtacaaaatggggccaccggctgtgaatttgggcccagaagcatatagtgggtctacccccattaaaataaccaacaaatggggcccgggtgtgggggtcacacacttgtattccccaccatttggggggcccagggggg

SEQ ID NO: 628384 - DNA, 170 bp, Homo sapiens
acgctgcacgagcggtcacagtgattcatctgcctcacactcccgagtagcgtgggattacagtcacccctcctcactatgcctgggtcaaatttttatattttatgtagagacggggtttcaccatacttgtggcaggctgggtctggaactcctgtacctcaggttga

SEQ ID NO: 628385 - DNA, 4355 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgccattctccctgaatttttgtttaatttcg

SEQ ID NO: 628386 - DNA, 365 bp, Homo sapiens
ttttttttttttgagacgtgtctccatctgttgcccatgcagatccaccactgcagatccgctagagtgcagtggcatgatctcagcacactgcagcctccacctcccgggttcaaaccattctgcctcagcctcccgagtagctgggattacaggcgcccaccaccatgcccggctaatttttttttttgtatttttagtaaagatagggtttcactgtgttaaccaggctggtcccgaactcctgaccttaggggatccaccagccttggcctcccaaagtgctgggattacaggcgtgacgaccgcacccagccaaattctgggcatttctctcaggcaaaagcacatacccatcacactta

SEQ ID NO: 628387 - DNA, 4643 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 628388 - DNA, 425 bp, Homo sapiens
  misc_feature (272)..(272): n is a, c, g, or t
ctacggcaggtgtactggaaaacaggaagtgtagggggggggtttctcctaagccaaaaccttcgggggccacacagttcactatctctattaataggagcattactattcaattatctggctattccagaaagctacgggttagaaaagaagaaggtattggtttcaggtacctcaaagaaaatctatttatttggaacaacgagatatatcaatggaatcctgcaggagagtaaataccctcccggtcaagaacagaggactcactagtncgggtttactccttcaacctcttttttctttggagaagcggaatctgggctcgggtcacccgagggcgggagttgcagggggtgctagtgtcgggctcagtgggaacctttcaccttccgaggtccaaggtgatcctcggggcttcagcaatc

SEQ ID NO: 628389 - DNA, 107 bp, Homo sapiens
cttctcatctgctgtcatacaccttcctgcatagtctactcaaatcttttgctctttttaattaggttgtttactttttttaatagagatggggtcttgctatgttg

SEQ ID NO: 628390 - DNA, 119 bp, Homo sapiens
gcttccgttgcatgtggtgcatcattatattagtttacatactttccaacaaggaaatcttcaacgcttaagaactaccccgccaacacttttttttttccttggccttctatggttgt

SEQ ID NO: 628391 - DNA, 4640 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccaccctttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 628392 - DNA, 6501 bp, Homo sapiens
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgccgtcagcatcctcaccatcaccatgaaggaacaagaaaaatcacaagagccttgtctcccttgcggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagggtgctcagggtcttcaagttagccaaatcctggccaactttgaacacactaattaagataatcggcaactctgtcggagcccttggaaacctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtacaatgatttctaccttggaaaatcaggagcacattcctttccctccgacgctcttcagaattgtccgcttggctcggattggccgaatcctgaggcttgtccgggctgcacgaggaatcaggactctcctctttgctctgatgatgtcgcttccttctctgttcaacattggtcttctactctttctgattatgtttatctatgccattctgggtatgaactggttttccaaagtgaatccagagtctggaatcgatgacatattcaacttcaagacttttgccagcagcatgctctgtctcttccagataagcacatcagcaggttgggattccctgctcagccccatgctgcgatcaaaagaatcatgtaactcttcctcagaaaactgccacctccctggcatagccacatcctactttgtcagttacattatcatctcctttctcattgttgtcaacatgtacattgctgtgattttagagaacttcaatacagccactgaagaaagtgaggaccctttgggtgaagatgactttgacatattttatgaagtgtgggaaaagtttgacccagaagcaacacaatttatcaaatattctgccctttctgactttgctgatgccttgcctgagcctttgcgtgtcgcaaagccaaataaatatcaatttctagtaatggacttgcccatggtgagtgaagatcgcctccactgcatggatattcttttcgccttcaccgctagggtactcggtggctctgatggcctagatagtatgaaagcaatgatggaagagaagttcatggaagccaatcctctcaagaagttgtatgaacccatagtcaccaccaccaagagaaaggaagaggaaagaggtgctgctattattcaaaaggcctttcgaaagtacatgatgaaggtgaccaagggtgaccaaggtgaccaaaatgacttggaaaacgggcctcattcaccactccagactctttgcaatggagacttgtctagctttggggtggccaagggcaaggtccactgtgactgagccctcacctccacgcctacctcatagcttcacagccttgccctcagcctctgagctccaggggtcagcagcttagtgtatcaacagggagtggattcaccaaattagccattccattttcttttctggctaaataaatgatatttcaatttcattttaaatgatacttacagagatataagataaggctacttgacaaccagcggtactattttaataaggaagaagacaccaggaaggactgtaaaaggacattccaattttaggattggaatagttcaagccgggcgcagtggctcatgcctggaatcccagcactttgagaggccaaggcaggtggatcacgaggtcaagagatcgagaccatcctggccaaccatgatgaaactccgtctctactaaaatacaaaaattagctgggcatggttgcgtgcgcctgtagtcccagctacttgggaggctgaggcaggagaatcgcttaaacctgggagacggaggttgcagtgagccaagatcgtgtcactgcactccagcctggtgacagagtgagactctgtttcaaaaaagaaaagaaaagaaacatggttcaaattatatctaaacaaaaaagaataagaaacaaaaaacacattaaaattttaagttgtattttctatgtttctagatacatcatttttgtttgatattttcctgatgcaagtatgtggtttatcacatgtagctcttttgcatgctaaatgaaaattcaagacttgccaataaatgaatagcttattgcagacattttttaccaacattaattattttgggtttgtttaaaacctagaggcacaatcttgacttgtcaattactaccctttcacaagctaccatctcagatatatatatatatataaattcaataaagctttctgtttgtgttccat

SEQ ID NO: 628393 - DNA, 5728 bp, Homo sapiens
  misc_feature (5632)..(5632): n is a, c, g, or t
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgccgtcagcatcctcaccatcaccatgaaggaacaagaaaaatcacaagagccttgtctcccttgcggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagggtgctcagggtcttcaagttagccaaatcctggccaactttgaacacactaattaagataatcggcaactctgtcggagcccttggaaacctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtaagtaaaatcagcagtcagagggactttaagaaccagaagtaagtttgtaaatcttatcattttttgaagtttgttcaaactatccacaaagcagaaaactgggccaagtgtactttctgaaagaatagacaggggtactaatgccattctctactgggaagttgctaggagatagagagtaatttctgttcccttaactcactacacaactgaaatagagttcaataatcatgcagctaatgtattcaatggaaatagacaaaattaaaatgactcagaagtttttgtggtggtaacctgatttattcagataattgagtcaaagttctacctttcctgcgcaactataagctctatgagcattttttagttttaaggatttactgcccatgttttttcctttgttcaaaatccacatgggtgccagatcacaattattgtgcccctgtggcactgctgtgccccctttcaacccctatacaaggccccatggcccactctagattgggctttcaagagtatatcattcagacaatcaaagctttttttctattctatatcccatgttaacttaaaccacagtgtgaactgtgcttgtctcagattctttgaccccgcttaccaaccagcctcattctctaatcagtatatttttcctaatcacacgcagggttaactaaaaggcttataaaagaatacaaaagaaaggaggttattaccatactccttcgttataaaacacacatacacacatcaactttaaaattaaattcttcatggctaagccataagtgcttactctgggtttttgaagtctggttttaattaaactgttaacttgacattttataattatgtaaaactgtccaggagcccttctcatagttcaaaacacaatgaagacaaagaaaactgattttccaaatggaagcttttttgcgatctcagaaagaatgcatcaaacagatatattggatcaagatattttggttcctaatgctactgcagcattgcagatgtttcagagaacaacaacaaatatgctacagttcatagtgtgttctggtttctaagctatgatgttaatgtagataaagcttatnaatagattcttccatgagtttacagttaagtagacctttaatttttattattcaattccaatcacaagtcttggtgaaattgacagcaggaaaaaa

SEQ ID NO: 628394 - DNA, 6332 bp, Homo sapiens
atctgctcaagccaggaatctcgggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgccgtcagcatcctcaccatcaccatgaaggaacaagaaaaatcacaagagccttgtctcccttgcggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagggtgctcagggtcttcaagttagccaaatcctggccaactttgaacacactaattaagataatcggcaactctgtcggagcccttggaaacctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtacaatgatttctaccttggaaaatcaggagcacattcctttccctccgacgctcttcagaattgtccgcttggctcggattggccgaatcctgaggcttgtccgggctgcacgaggaatcaggactctcctctttgctctgatgatgtcgcttccttctctgttcaacattggtcttctactctttctgattatgtttatctatgccattctgggtatgaactggttttccaaagtgaatccagagtctggaatcgatgacatattcaacttcaagacttttgccagcagcatgctctgtctcttccagataagcacatcagcaggttgggattccctgctcagccccatgctgcgatcaaaagaatcatgtaactcttcctcagaaaactgccacctccctggcatagccacatcctactttgtcagttacattatcatctcctttctcattgttgtcaacatgtacattgctgtgattttagagaacttcaatacagccactgaagaaagtgaggaccctttgggtgaagatgactttgacatattttatgaagtgtgggaaaagtttgacccagaagcaacacaatttatcaaatattctgccctttctgactttgctgatgccttgcctgagcctttgcgtgtcgcaaagccaaataaatatcaatttctagtaatggacttgcccatggtgagtgaagatcgcctccactgcatggatattcttttcgccttcaccgctagggtactcggtggctctgatggcctagatagtatgaaagcaatgatggaagagaagttcatggaagccaatcctctcaagaagttgtatgaacccatagtcaccaccaccaagagaaaggaagaggaaagaggtgctgctattattcaaaaggcctttcgaaagtacatgatgaaggtgaccaagggtgaccaaggtgaccaaaatgacttggaaaacgggcctcattcaccactccagactctttgcaatggagacttgtctagctttggggtggccaagggcaaggtccactgtgactgagccctcacctccacgcctacctcatagcttcacagccttgccctcagcctctgagctccaggggtcagcagcttagtgtatcaacagggagtggattcaccaaattagccattccattttcttttctggctaaataaatgatatttcaatttcattttaaatgatacttacagagatataagataaggctacttgacaaccagcggtactattttaataaggaagaagacaccaggaaggactgtaaaaggacattccaattttaggattggaatagttcaagccgggcgcagtggctcatgcctggaatcccagcactttgagaggccaaggcaggtggatcacgaggtcaagagatcgagaccatcctggccaaccatgatgaaactccgtctctactaaaatacaaaaattagctgggcatggttgcgtgcgcctgtagtcccagctacttgggaggctgaggcaggagaatcgcttaaacctgggagacggaggttgcagtgagccaagatcgtgtcactgcactccagcctggtgacagagtgagactctgtttcaaaaaagaaaagaaaagaaacatggttcaaattatatctaaacaaaaaagaataagaaacaaaaaacacattaaaattttaagttgtattttctatgtttctagatacatcatttttgtttgatattttcctgatgcaagtatgtggtttatcacatgtagctcttttgcatgctaaatgaaaattcaagacttgccaataaatgaatagcttattgcagacattttttaccaacattaattattttgggtttgtttaaaacctagaggcacaatcttgacttgtcaattactaccctttcacaagctaccatctcagatatatatatatatataaattcaataaagctttctgtttgtgttccat

SEQ ID NO: 628395 - DNA, 314 bp, Homo sapiens
gagaagccacagtgaagtccaggcgcggtggctcacgcctgtaatctcagaactttgggaggctgaggtggccagatcacttgaggtcaggagtttgaggccagctggccaacacggtgaaaccccatctctactaaaaatacaaaaatcagccgggcatggtggcacgtgcctgtagtcccagctacttgggaggctgaggcaggagaatcgcttgaacccaggaggcggagatgcaggagcccagatcacgccaggcaacagagtgagactgtatcccaaaaaaaaaacaacaaaagaaacaacaagacaaa

SEQ ID NO: 628396 - DNA, 4707 bp, Homo sapiens
  misc_feature (4611)..(4611): n is a, c, g, or t
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagctagagcaaaccaaacgactgtcccagaatctatcactggaccactttgatgagcatggagatcctctccaaaggcagagagcactgagtgccgtcagcatcctcaccatcaccatgaaggaacaagaaaaatcacaagagccttgtctcccttgcggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagggtgctcagggtcttcaagttagccaaatcctggccaactttgaacacactaattaagataatcggcaactctgtcggagcccttggaaacctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtaagtaaaatcagcagtcagagggactttaagaaccagaagtaagtttgtaaatcttatcattttttgaagtttgttcaaactatccacaaagcagaaaactgggccaagtgtactttctgaaagaatagacaggggtactaatgccattctctactgggaagttgctaggagatagagagtaatttctgttcccttaactcactacacaactgaaatagagttcaataatcatgcagctaatgtattcaatggaaatagacaaaattaaaatgactcagaagtttttgtggtggtaacctgatttattcagataattgagtcaaagttctacctttcctgcgcaactataagctctatgagcattttttagttttaaggatttactgcccatgttttttcctttgttcaaaatccacatgggtgccagatcacaattattgtgcccctgtggcactgctgtgccccctttcaacccctatacaaggccccatggcccactctagattgggctttcaagagtatatcattcagacaatcaaagctttttttctattctatatcccatgttaacttaaaccacagtgtgaactgtgcttgtctcagattctttgaccccgcttaccaaccagcctcattctctaatcagtatatttttcctaatcacacgcagggttaactaaaaggcttataaaagaatacaaaagaaaggaggttattaccatactccttcgttataaaacacacatacacacatcaactttaaaattaaattcttcatggctaagccataagtgcttactctgggtttttgaagtctggttttaattaaactgttaacttgacattttataattatgtaaaactgtccaggagcccttctcatagttcaaaacacaatgaagacaaagaaaactgattttccaaatggaagcttttttgcgatctcagaaagaatgcatcaaacagatatattggatcaagatattttggttcctaatgctactgcagcattgcagatgtttcagagaacaacaacaaatatgctacagttcatagtgtgttctggtttctaagctatgatgttaatgtagataaagcttatnaatagattcttccatgagtttacagttaagtagacctttaatttttattattcaattccaatcacaagtcttggtgaaattgacagcaggaaaaaa

SEQ ID NO: 628397 - DNA, 205 bp, Homo sapiens
tatgctgttggtcgtctcacaggatcccccttcatggggcctggtgttcagctggtcgagagctcaggccactgatcacgtaattacagtgcaaaatccatccctggatgtaggcggtcatgctgtatgccttatgaagtgatcttgcttgggcttcatggaatgtggttggtctcttgcctttcagctagaaatgaatagatca

SEQ ID NO: 628398 - DNA, 300 bp, Homo sapiens
  misc_feature (26)..(26): n is a, c, g, or t
  misc_feature (63)..(63): n is a, c, g, or t
  misc_feature (82)..(82): n is a, c, g, or t
  misc_feature (84)..(84): n is a, c, g, or t
  misc_feature (88)..(88): n is a, c, g, or t
  misc_feature (98)..(98): n is a, c, g, or t
  misc_feature (106)..(106): n is a, c, g, or t
  misc_feature (109)..(109): n is a, c, g, or t
  misc_feature (130)..(130): n is a, c, g, or t
  misc_feature (132)..(132): n is a, c, g, or t
  misc_feature (142)..(144): n is a, c, g, or t
  misc_feature (147)..(148): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (170)..(170): n is a, c, g, or t
  misc_feature (173)..(176): n is a, c, g, or t
  misc_feature (178)..(178): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (268)..(268): n is a, c, g, or t
  misc_feature (278)..(278): n is a, c, g, or t
  misc_feature (286)..(286): n is a, c, g, or t
  misc_feature (290)..(290): n is a, c, g, or t
  misc_feature (294)..(294): n is a, c, g, or t
  misc_feature (296)..(299): n is a, c, g, or t
ttatcacaggttaagcatgcagttanaaagtagttagaaatttctgaagggtgttagagtcanaaaaaaaaaaaaaggtgantnttanacatatattntctagganttnatggggacactactgttcaananggccatgggnnnatnngtgggcantnanagactgccgngannnntnatttncgnccnctgtaagtgaagctgggtgcagaatgcaaagcctctaaaaggagaggatacaaagtcaggtgagtaggggccattggcnatgctcaganccagccanactncaancnnnna

SEQ ID NO: 628399 - DNA, 639 bp, Homo sapiens
ctggattcctttaatttttttaaaatatattttttttttttatataattatttttaatttttaaaaattataattaaaatcacaagaaaaaaaaatttaattgatatcaccacaataaaatcagattttcaaaagaaaaagtaaaaaacaccactcccgttctctcaaattcacaaggggaacgggttctaggattgaaattaaaaaatcaaaaacctcctatataagaaaaaatatttctcacacccgcaaagaatgagcccctgccaataaaccaaaaaaaaccctgtgtttataaaaaaaaaaattaacagcccccccaaaaagggacccatttcgagtacccaaaaaaaagcctcccttcttaaaaaaaaaaaaacatacacacccaacatccctaattatgcataagctccatcaaaatactcccaccacgacaaagtgtccaaccatcaacatactaccccaacttctccttctggcgtcctctttacaaccaaaaacccccaaaaataactcaaagggaaacccccttacacttcaaactagcggatcctccaaaaaacaacaccctccaattcacttctctatttatcatcaaaccctcctgaagttcaccacccgggtctcctttcttcc

SEQ ID NO: 628400 - DNA, 1988 bp, Homo sapiens
  misc_feature (1254)..(1254): n is a, c, g, or t
attgagtggtgtatttgctttattcgagtgtgtttgtgtatggaggtgctgacatgtggttggtcttgttggttgttcgtttgtaatgtgtattgtgagatatgtggctagtaatattgtagtgtgagcggttgtgagtgtttgtgtggtgtggttgtgaagtttcgttgtagttgtcatgagaaggggttgcggcgatatataggtttatgagatgtatttctgtcttagtgtgtctgagttgatttggtgcactatgatagtgatgtattcggtcagagtagggagaggttattagtagcttgagcggcgtcttattatggcagagttctgtgtctgttctagccgtctcactttcacttgtctgcctgttcttggttggtctgtttgggtgctttgtcttctctttggttgtgtgtgggtggtgcgtgggcgtttgttgatttgagtgatgttattgagcttgttgtcttctgctgctgttgcctgctgtacactcttcctgcttttcgcattccttgtgttatgttttgtttcgctttatgttttcctcttatttttgctgttgtttcgtcttttaggttttaggtgcgtgtggtgtttagcaggctctgtgtagttgtgattcgtccgtctcttcttgttgtcctgtgcatacttgtctgcctctgtgtcgtgttcatcgtctcgtctcccgatcgtgtcgttcgcgtaccggttgcggcgctcttctatgcgtagctcttgctattgcttatgctgattcttatagcttgttcactttcatgttttatccgtgtttgctctgctcgctcttgtacttcccgtgccatcgacacatccatcgcccgatccctccccatccgcacctcgccttcgccaagtgtcatttagattcagtcgactgtgacggtgctatgtgactgtgtatgtcgtgggttagttgtgtctgtgtgttgtgtgtatacggcattaatagtattcaatgtgttagtatttgtgagtaattttgtagtgtgttgtgatggtatggtcagtctggttgtatgtgagtagtcttgtgtgatttggggagagcgataatgtcaagtgtaaacagaaaagaaaaaagaaaatccacaggggatatgtgcggtatgtgttgtctcagtgtgttccccctcctctcgcccctggcgccgtgcggaccacatgtgtgtcctggccagatggcccccccgggttgtttgttggcacccgttgcaagttctgaangcagagatttccgggatttcgggcccacctttaggtcttaacgaccctaccggctactaaggctttttcacatcacgggtcgtctccggccagatgggcagatcaccagtagcaatggaaagtacatgtggaacccttagacttataggtgagccagcatcttagagagaggttaatcacactatagaggcataagtggtgatccggtgttcagagtggtgctaaatgtgttaaactgtgtgtttataccccggtttgccagtcattgggtgttagcttgagatggttaaagggtggtttggggagggacttcgttgtaatgggtttgctgtaaaaaatgtttcccactcccctgaaatgttgctgaaaagcactggtgctggtaacacgttccaccatccgctggctgctcatttcttgcctactttactctccccctggagcacggttagcgttgaaggtggtatgggaaagcctgcatgcctcggtccatttcttttgtttcttctccttccccctccccctacctccttcccctcactcctcccctcccttcggctcgctccacctcttttgttccagtatgtgtaacttggtagagctaatttgtactactggatatctgactggaacccccagataccagaatctgtattgttctttactgaaaccccgcctgggattaaccagttctaacctttaatataaaccaacccttaatttaaaatgcccca

SEQ ID NO: 628401 - DNA, 376 bp, Homo sapiens
  misc_feature (32)..(32): n is a, c, g, or t
tcgcatcatgatgaatcagatggaacatgatnactaactaagaccagactttatcagatatctttagttcactaatgtccttatctgttccagtgtcctatccaggatcccatatgatatttagttttcttctctccctccgtaggttcctcctggctgtaagtactcagatcattttggatttgatgatcttgacagttaagaggagtgccagtcaagcattatttggactgtccctcagatgggatttctttctcaacgaacctagcctgaggttctgcttctagaggatggccgtcgcggcaaactgactcattcgctgcgtcataccaactatcatatcatatcatactaccgacatgactttcatcgctgc

SEQ ID NO: 628402 - DNA, 197 bp, Homo sapiens
gtccttgctgatgatgaatgctttctgagtggttactgaaaagaggaacctgcccttctgcaagccctgtgccttcctcgtaccatagcagaggaatgtatgcgtgccgagtttagcaactgcagttcttcttgtgtagcactgggctgcttctccacaacctgcgagagtccctggtttgcctgtatattcttgga

SEQ ID NO: 628403 - DNA, 116 bp, Homo sapiens
ctagcctggtcctattctgcatgactcccagactccttctgcttctcaggctctattccgacaccctccaacatggaggaaacgcaacagagaggggctggagcagcagagagggg

SEQ ID NO: 628404 - DNA, 197 bp, Homo sapiens
acacgtagcacttttataaaacacaatcctcaaaagctcacataatgtagcacatcttacaggcacagacattctatattagcaccgtctaattgtcacagctatataaaaacagacccttggccgggcgcagtgggctcacgcctgtacatcccaaaactttgggtgcactgaggcgggtggatcacaaggtcagg

SEQ ID NO: 628405 - DNA, 308 bp, Homo sapiens
cacccatccttccctcttttacgaagaacttgtcaacagcattgtctaataaaatcaactattccactagctccttatgagggacgacaaaaaactcctgtgcacattccctttcattttcttcacggggggtaatcacatagcacagggtgcaacacattttcagttccatctcactatttaaaacaccccatgtgctgcctcttgttcctttggcgagagccccgtaatttctgggcacaaaccactcgtgatactgtttctgaaggggggacatctccaccctccgaatatgttccactttatca

SEQ ID NO: 628406 - DNA, 335 bp, Homo sapiens
tcacttaacgaagcaggctggaaagtttggccggcagagctgccctccggtgtcgcgctgcctacaggatcagatacagtcagttgtgcagtcatggattagtcccattccttgtaaatgctctctctaaggtagattttaagacacaaaaggaagctgtgtgggacgtgaactagaatacccttggtggacacagttgaacagattgtgtaccttgtacactgtggcataatagaaccgttgatgaacctctataatagcaaagataacaagattatactggtaatcctggatgccatatcaaaaatctaacaggatgaagagaaaaataagtg

SEQ ID NO: 628407 - DNA, 983 bp, Homo sapiens
  misc_feature (932)..(932): n is a, c, g, or t
gactcacgtgaaaataagcgtgccgcaccacgggatgtactagcagctgcttggataatctcctccgggagccctttcaagtacggattcccagatgttgagcacacatttactccacattgtgcttaatcacaagggcgtatcttgtccccacgcgccttgttaaagttccccgccgccgtcttctaatagcgtgtggagccggctgctacaaagagaatcctatcaaggccggtcctcaaaccaggaaaaaagaaagtgcgccctctctataaaacgtccaaccaaacacgccgtcggtgcgttcgtcccagcggcccgaccgttggggcgccccaccagcccccccctggtcagaaaaggcggtgcataaaaaccccctcaggcaccccacctcggctgggagaaagcacggcgggccccccaacaacttctcgagccccacgaaatgcgcccccgaagtgttaaaacctagaaaaagaggggttccctgttccactccatcaaggcgaatacaacgatgtgggccgacacatctttccacaacactaagcctaaatagagtccatggacgatcaagatcccacagcactgcattttggggacgaccggcgagctcactccgtgtgtcatgacggcgataagaggccactcatgcttttgaggccgaggcaagcttctcacgccatactatgttgaagggcgaccgaagaatagcaacaggtgtgaaaaggccgtggtagccacaaacaagccctcggtactcaccgccacgcccagaccacaccatacatcttttttatgcggagactcaaggactttttgcggggagatacaatgcgatagtgcaccgcagtttttctaatatggttgaaatacaggaagtgtacgacatcaataactggcgagttcttttgtgtggcctcttaaantataaacaagaataaaacctgtttttttaaccagtgccgacatagacacac

SEQ ID NO: 628408 - DNA, 643 bp, Homo sapiens
  misc_feature (593)..(593): n is a, c, g, or t
tgggaaaaagggtctcactgtcgcccaggctggagtgcagtggcgtgatctcagttcactgctgctttccctcctgggctcaagcagttctcccacctcagcctctcaaataacagggactataatctgtgcagaccatgccgagctaattttatttttggtagagatgagctctcactatgtccacccaggttcgtctcaaactcctgaaccctagtaattctcctatctcagcctcccaaagtgctagggttacagactaatgagccactgtgcctgtctagacttgtacttctcaactgcccatttctcccgtgtctgctcccagtggcgccacctcataaaaaacacagaagtgcttcccaattttattcatctttccaagccgtgtagctctgggtatactccacgtgctgtgcaagtcagaagcttgattctcatccatgggagtgctttttctccacgtttcacatctcactcatcaccaagtcatgtgggtgtaaatttctgattaacccttgaattaccgtcttctcatcctctgtacaaaagcctcaagtgagggtcaaattcaacattatcctgatctaganagcccccattctcaatccacccttttccaagttgattgccaaggaaatta

SEQ ID NO: 628409 - DNA, 156 bp, Homo sapiens
ggtttccccccccccccccaaaaaccggggggggccaaaaattttttttttttcccccgggggaaaaaagggggaaatttccccccttcccccaaggtggttttttaaaagttaaaagggggattttttttggaaaaaaaggggggccctttggga

SEQ ID NO: 628410 - DNA, 858 bp, Homo sapiens
agtccttatcctttatactctgttcttgggtttgtattcgtcttgttttataccaggcaaattgcttagtagcaaagggaccaaactgaaaaggtgacaatctctaacttctaaaagcagacacccatcggatgctcattagaggttcaatgcaagatgccattcttggtggcctctgcacccaaattgcatctggcaaagaactagggtctcattcagaatgtccaacaggaaattcttaagagcttaaattcagactttgtgtctcattaactgccgtgaacacacttcaaaaccacaccagcattccttggcaggacggctcactggaactacccagtgtctgcatgagaccctatatctagcttcaccggttctcggacggtctaacacacactggatgatacacctaggaatgaaacatcacaatgcaacgtagacggaacctctccaaatcaggccagttgggttatcctggcattggcactctggtgtgaaaccataggtcttaacactctggagcagacacattgctgtggactatgtccaggcgacaccttacagcatatgagcttcaccaggcataccagcatgaaggaccacgaacttgctacaccaatagcaacacaacatcccaaacaaagactagaatcaccgcaagtgcgcccagaactagaggcgaacaaatcgaacgataccagactcgcaagctgggaaaacaaatcacccataacacaaaaccacaaaaacacaagatgaacaaactaaaacatctaaactacgtaaaccaatcaacacatggagacaacaacgaaaataccacgaaactaaaagaaacataagacaataacataaaac

SEQ ID NO: 628411 - DNA, 1042 bp, Homo sapiens
ccggagccagagctgtccccatcacgtgagggatctgaggccagggcaggcccccttgctcctgccccaccaggctcccattccacccccggcccgtcccagagcagcccacacagagccgcccgtgagagcatggagatgcgcatctgtgctgcggaagtgctgggctcccctcgcaaggcccggcggcgcggccctcaagcctctggtgctcctctctggacgcggcgctgacccggggagctggaggtggtgcacgcatggcgtgtgcatggagatgaacgagctcctgaggcctatgcccgaacgagggaaggtgcatcactggcttgctcaacggccatctgcggcgccgacttacgtctatcgtggatttcctcactcaccgctgggtgccgaattgtaaactcccccgaggacgcctcgggctggtcatcccttgcactgtgcgcgagtcgtgcctcggacacatgtcatctgcacttggcgcctggtgctgcgccgggcgctgccactctttcgccgccacgctcagcgacggcggccaccgcttcgagtagttgcgacccttaccgcggagggttattgctgtctgcgccgacctatctggcactacctcgagtcagagtctggggctgtgctcaagcggggcccagtgtaccctctctgggactacgcgcgagctcggggggccagcctggccgtccgcgaggggacttggtccccgtgcctgcggaatggccgggcccgtgggaaaacttctgctgttggccgtctcttcccaggccgcggagggcatagatgccgccggaactcacttgggctgtccccaggaggttaccccaaggatagagttccccgaatcggcggtcttcggcccgaaagggctactgctcacaacgtccctgtgggctacgactgcaccgtggagtttgcggcaattctctgcgcggcgagggcccctagcaccctcagacgggatgagaactcaagatcggctcaccaacccggaggcaatatttgtagctaaataagtataggc

SEQ ID NO: 628412 - DNA, 133 bp, Homo sapiens
gtcacgtgaaagatgcacatggcacagcttgccactcgactttccaacattttgttattggcagggcagaaaccatggattgctcttccccgaggaaagggtatcgagctcaccattgctgtaagagagagac

SEQ ID NO: 628413 - DNA, 153 bp, Homo sapiens
gccccaacttaagtttagaaattacagccacccctcaggcgcaggaccaggtgcagggtcgactctttctggatgtagtattcagaaagagtggagcctgcactagccgggcttgaagtggctctgctgggtcggtggggcgctgcctgtgtt

SEQ ID NO: 628414 - DNA, 156 bp, Homo sapiens
atacccagaaaaagccagcaaatagtagcctagctctaccctgatgagcatctagtctactcaggaccacctcagcctgaaatctagaaactctctcagcatacaggcactgcaacttaaaatccaattcaaagtcaatgctcaacaagcagccta

SEQ ID NO: 628415 - DNA, 511 bp, Homo sapiens
  misc_feature (1)..(1): n is a, c, g, or t
nccccactcgtccacggttggctagtctgttatgttaaggctttctgggaagttatctcactctgcgcaggagtgaaacatgaaggggttttctgaggacctgttttggtgggcccgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaaccgtggactagt

SEQ ID NO: 628416 - DNA, 374 bp, Homo sapiens
gagccagtgtagctatggaattatcttaggaactcaagcttctaaaactatccatgtagtcaaatctaggggaaaaagcaaataaaaatagtagggccaggcacagtggctcatgcctgtagtcccagcacttagggaggccaaggcagggggattgcttgaccaggagtttaagaccagcttgagaaacacagggataccctgtctctacaaaaataaaaaaaagttggctagatgtggtggcacgtgcctgtggtcccggctacttgggaggctgaggtgggaggatctcgggcccaggaggtcgaggctgcagtgagtcgtggtcatgctgccgcactccagcctgcacaacagagtgagaccctatctga

SEQ ID NO: 628417 - DNA, 520 bp, Homo sapiens
tctatcaggatcccctgcccgcgtgctgaactatgtcgcagatgtagcgaaggctattcgtttgaatagtccatataacggtaagtacaaggaccttgccccgcacgaagtcgggcttgatgtgatgcagcttgccaactcgctgcactgtcttggccgtttgggggatgctatcaagaacgcagacaacagcaaaattgtagatgcgtgtgatgcgttgatgagctactacgccatgtttaccgaaggggggcggggcgaggggatgaagggcgacccgaaagcctcctttgatcggcattgccacatttgcaatcctcaacaagcaatttctgtctttgccggaattcgcgataaggctttggctaaatgtctggagaagcgagcatgaggaggggggtgagagccaaaaggcgaatgacccccaccgaatttgaggccgttcggccgtttctgaatatctctgatgaacgcatcaaggccgcaagagcggcccttgacgaaggtcatacgtttcaat

SEQ ID NO: 628418 - DNA, 923 bp, Homo sapiens
ggtgtcgccccacccgggtttggtgcgggcgcggcccgccccagttgtggggcggctggggtggtatgggcccctgcggcccccctggttgttgcgttgtgtgggcgccgcagcccgcggtttggcatgggcggccctacgccctgggccgtgttctctgctcgcgagccgagatcgtgttgtcctttgccaggcgcaacatgtggtagcgacgccccgtgtctgggctttggcgccggggtgcgtgggtctggcgcgccgtccttgctagtgtggttgcacaaacgccgcggttggggcgccacctggctgtgggggtggaataggcccctgcgcgtcgatagagttgttcggtggtgagatgtgactctgtgctcgccgacgcgaggcgggcctcccgagaactcctcatagggcccgcgcggggtgcgcccactcgttcggatgccgtctgtgctggggggcgtctcgacagcctcgggccttgttctgtgccgcagggcggtcccgccatccatgccgctgccagcgctggtatgtgttcctgcgtgacatccgtccgccggtaatgtgcggtttctcctcttccgcgacagcgcccgcctccgcggagctacccttcggtgcgtgacggccctccccggcgcgtcgcactgtggcttgcgccgggtcgacccgtgtggacaccccgttctggggtgacgagaactcggagtgcccgtctgtccaggaacttcctctctgcacttattgctttactggttattgagaataattctttctttctggtgtgccccggaccacttttctcgcggtccccatttcttctttctaacattttggggtgtatttccagtacgcagcaggtcttctgcttcttaggacgtcacaaacaaaagaaccatcaactggcccaaaaaaca

SEQ ID NO: 628419 - DNA, 211 bp, Homo sapiens
gaccagtccacactgataaggagttcctagcagggcttccttgatgggtaccaagggacaactctgccccatagcaaagaatgctcaagtccagaggggggcccatggctgtttttggaattttgggagaggttgggattcatttacaagactttagggctcttatgtaacatcacatgatttggagaaattagacacaatctcttatttt

SEQ ID NO: 628420 - DNA, 129 bp, Homo sapiens
catagcacatgaaagcggtggggattaacttagccaggctgccacgccagcacacgataacaaggtccgcggtgagatgaagaaagacgctgtgtatgactgcgcactccgcagagtcacatgcacgaa

SEQ ID NO: 628421 - DNA, 393 bp, Homo sapiens
tttgtataaagtcgtctggtgtaataccgtgtccattaaagtgatggggcagaaaagccaggtggggaagagagaattccataagaattccataggtctggagcccaggggtggctgaggtagcagtagaggtgggaactcaggcctgctttctctccctacttactccttccctccctcactccctccttttctccctcattggttcatccatgcaggcgagggccctagtgccagcccctcctgtcccgacatggggagagccctggggaggggcaggcagagtggaggccactccagccaggaagggctgcagtgtggcgggggctgtggtctgaggctggatcctttccgagcctctccacccacgtgggcctgcagcctttgtcgcgg

SEQ ID NO: 628422 - DNA, 938 bp, Homo sapiens
tctggcaaacaagtaaacctttaatttaaaacccaaaaatattcagcagggggccacaactatccaggttctcattaaaatcacttaaaacctaggtacaaaagcaccactgattaatggctctaaaaaaagcgtgcttgaaaatattcaaatatgcacagtaaaaacaccacaagttagtgcacgggataaacatttaaaagcagggtgcagggaatgtctgaatcattcttacacacgagcttccaatattaaacggatattaatttaactgtgaggatgatgtaaatttccaaaaagcatgactatgagacgataaaatgtccatccttatatattccggttatgccaactagttagagtcctaaaaaattagcttttaccaaaatatctgggtaaaaatagctttcaaaagttggtcccaagagatacataaaatcacccccaattttccatgacaatcacattccccctccgtatcctacagatcagtttcggggccgtgtgaaacacgacgcggaaacacaacacttattcgcttcttacggaactactaaatagcaagggaatttccccaccaacacacacgttttgaacattggttcctcttttgttcacagctttcggagaacctatttccacttccggtggaaaacacggcggaattattacccacccttgttgcccttatgggtctcgcgtttacccccaaaagcttcctgcccgactcttaaaacaactgactcagcatagaacagtcaattcacatcacaacaaacaaaagggccgcgctaatacatcagggaccacgacaccattttagacgtcccaaggtaataagagccgcgctacacgacaaccaccgtgtggccctggttgatgaacccaaccgaattagtgggctcgctgataacaaacgcgcggcttacagacaatag

SEQ ID NO: 628423 - DNA, 354 bp, Homo sapiens
  misc_feature (55)..(55): n is a, c, g, or t
  misc_feature (294)..(294): n is a, c, g, or t
  misc_feature (297)..(297): n is a, c, g, or t
  misc_feature (319)..(319): n is a, c, g, or t
  misc_feature (336)..(336): n is a, c, g, or t
  misc_feature (338)..(338): n is a, c, g, or t
  misc_feature (341)..(341): n is a, c, g, or t
  misc_feature (349)..(349): n is a, c, g, or t
atgccagcccagagcccgtatgtggggcatacgctgtgtttcaaaaccatttttngaaaatctgttgaaaattgtttaagtatgtcagaaaacacaccaagcgtcaatggttcctgcttcatggccccactgagcacagggctagtggcctcttcttaactttttggtcctgcgctgccacccactgcagtatccgcatacccaagcctcactagttgtgacaactaactcagtcacaaccactggcttagtaattctgtgaaggcgaaagtaagacaaagtcaaatctgagantcngaggcacagaatacaggagagnttgggacaagactgtgnangtnaagtagtnaggtg

SEQ ID NO: 628424 - DNA, 314 bp, Homo sapiens
tggtgctctgagctccgtccagtgtctcctactccgtagagtaagctgcaagtgtgaatacagtgtgagcactggcgcataatcatgatttaaagcaataatattctcagaatgaaagagtaatataatttaaatggccatgcattaaggccactttgttgaatgacccatgcactggagataagacccctggcaatgctggagagaaactaggctgattttgtcactctgtgcctgccttctaacgctgaagatcattctgtgattcagtaataacagtgttttttcttagaataactaaaaatgcttcagta

SEQ ID NO: 628425 - DNA, 115 bp, Homo sapiens
cagcagtttcgccacccggaggtagttattaagcactctacctgctttcatccacctcgatatctgccacatagttctcaaacactgtgagcacatacacctctgggaactggtc

SEQ ID NO: 628426 - DNA, 234 bp, Homo sapiens
cgggacaggtagctgtgcaaacaagtagctgctagaactgtctgatttctgatgctggagcatgtggtgagacctcagtgtgaccagtgaagaaaacagcctgtacacacaaaacgaaagatcatggagttcaggatcaaattttggttctgaacaaaaaaacttctggcatcatacacaaatttggttcagccaaagactcagaacacaacgagaagtatgaggatacctgtt

SEQ ID NO: 628427 - DNA, 575 bp, Homo sapiens
tggataaatatattagcaaataaatatatttcttaacatagtgcctgattcaagcgtctgtctggttcagatataaatacccatgtgggtacctaggtgctagtctccccactaactgagggaaaaaggttcccaggtggggtcctctgcccactttgccaccacattcacattccaaatgggataatgcctgaggggccaagagtggtcaggctgccctggggtgaatgtcaccctgatgaggcccatcagctcttgtccactcagtgaggccagacttgtgctctaatccactctcctgtgggtccctggcctgtatggcttatactggggagctgggcctttgggctgtccaaaaccaaagggtacactttgcttttccctttgttggccccaaatttccatccttgttctaagaaaaaaactttttccaaaaaaaaaaactttttgttggcccccgctcaactggaaatttttgcctctttctacccttaattcccatcctttcctcttgccccagaataaaggcccagcagaaaaattcctccttttttaacctctttgggaattttggg

SEQ ID NO: 628428 - DNA, 229 bp, Homo sapiens
ctaaagatctgacattgcaggagaagcccaatttttgttgacctcattacacagaaacgaggggcgcgtctataaagagccttgcatcaattaagactgaatgcatttacagccgagcaagccaaccgcttacacctcggagcagggtacagcccactgtgttcagtccaaagacataagataagataggagactgagacctatgtctggtacttgccaaccctggcag

SEQ ID NO: 628429 - DNA, 263 bp, Homo sapiens
aatgtctgccctctacatggaccttccagaatcttctgcaatgtgatcatgctctgagatgatggcagaaaggaggcattgggtggattaaggcaggctggctgggctctttttccagccagctttaggaggctgatcgaacccagcttttaatgtaatatttaggcagtctgatttcatcaatgccacactcagatcctgacctatgaaggtcttccttttgaagatatcattattggaagtgctgcaggagttgcttcgtc

SEQ ID NO: 628430 - DNA, 100 bp, Homo sapiens
cggtccatacaagcataaactattacatgcatacaactattcacatgccatcaactattacatgcataaactattgacttgtgtgttactctgtgtgagt

SEQ ID NO: 628431 - DNA, 250 bp, Homo sapiens
ctctagtatggtgagaattgtccacccatttgtgtgtgtgcttgtgcacgcacacacacacacagaggtgagaaaaagaatgcgtaggggtgcgtagtaaaatgtacttatggtcgcaatttttttttttggatacagggtctcgttgtgtggccccaggttgaattgcagtggcactgatcacagtacagcttcgtgtgaagtgcacacgccaccagtgccaagcatattccttttttttttttttttt

SEQ ID NO: 628432 - DNA, 165 bp, Homo sapiens
  misc_feature (85)..(85): n is a, c, g, or t
  misc_feature (150)..(150): n is a, c, g, or t
ctgcgtgagaagccatgagcagcaaagtctctgcggacaccctgtacgaggcgatgcgggaagtcctgcactggaaccagcgcanccgcaagttcctggagacggtggagttgcagatcagcttgaagaactatgatccccagaaggatnaaaacttctcgaaca

SEQ ID NO: 628433 - DNA, 492 bp, Homo sapiens
gtttctatttttttgtaacaccctgaaaactttaattcggcacaccggaatgggggaaccacgtttgcaaactgcctgggtgaggcgcctcttacgaacccaaaggggagccttgatgaaaagggccataaagctctccagatgaagcagaaagcctggaaagatgacccaaaacgcgcgttaagccttttgaagccgggggctacaaaaaatggtgggcctgacatgccactggaaaaggtgaacgccgacttgcaccattagggcgcttgggggcgggtacaagcgatacccacaaaaactgtaataaggcggccaaaagattactcggttgcggttacatggccacacactatggcgagctcatgcgataccaatggcctgagctagaaaagcagatgtgtcaatgcgtgggacctccatgtgatagattagggcgaagcgggttcaccttcaggggcatgaacattaggggcaaagggccttgctctg

SEQ ID NO: 628434 - DNA, 121 bp, Homo sapiens
aggactcatccccttcaagcagtatgctggcacatacgtcctctttgtcactgtggccagctactgaggcctgatgggccagtcacattgaactgcaatgcactcacaggaagcagcttgc

SEQ ID NO: 628435 - DNA, 176 bp, Homo sapiens
ctgggccggctagagcggctaccactgcctaccacctcccatttcatgttcaacaatacactgtactcttatacttttatgcctttatgcatgattttttgccagtggggaatgagacctgactacttgcttggtgaagtgattcattctggaagactcagctcagacactgcctc

SEQ ID NO: 628436 - DNA, 423 bp, Homo sapiens
tggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctgggcctgtttgtttgtttgtttaaaacatttctccattcattcattccaggtcccagagcaaattttttttgttttgggagcctgttgacaatggctatg

SEQ ID NO: 628437 - DNA, 328 bp, Homo sapiens
cccccccccccttttcccaaaggggggggggggggggggggggggggggtttttttacccggccttttttttttacccccccgtttccctgggggccccccccccccgtttttttcccccttttaaaaccccgggggggttcccccccccgggttttttcttggggcggggggggggtttcatttttccccgggggcccccttttcccctttggccctttttgggggcccctttaacccgtttttttccaaaaaccgggggggggcggggcggggttttccggggttttttgggcccccggggccgttttttccccccttttttgtta

SEQ ID NO: 628438 - DNA, 325 bp, Homo sapiens
atggtgacatgtcgcacgtctctgatgagggagcctttctgaatctgcatcagccacagcagcttcttggctctcatggctttgcggcatttgtgccaggagacccaggtgcattttgttataccttctagggcaaagactggtaacatatggctccactcttaaggcaggtaacgggatcgcctataccaccaaaaacacctggaagaggcatcaggaatatgaagaggaacgagaagaggagatacaagaccctcatggctgatggctgggagcttcaccaggagatgagtctggggaggacatcaagccttccaccttataa

SEQ ID NO: 628439 - DNA, 661 bp, Homo sapiens
ggagaagctttgttcaggacagcggtggatcgacttcttgaagtgtgccctgcacgccggtcctggcgagcatgcgagctcccggggtgtgcgggagccccactcctccgtggtgtgttccatttgcttcccacatctggatggagctgacgatgccatgcgctcctcccagcaccagtccagggtactggcgatggcagtgatgcctggtcaatggctaccatggtgcaaaatgtccggacagctgtactggcaagactgtcatagatgccatgttggcgtcctgtgccatgctcatggtgtcttgatcttttacggtgaccaacctgagatcgtgtcccagagcatggtccgacggaactgcccctccttgtgactcgagggtgttactgacagtgcctcactggtcggtgtgcatcatgcgcatggaactggcgaagtgtgcgcacgttctatgctcactcgggtggaaggacccgaggtacaatccatggcaccagagtccaggggcatgcacacccagatgtgcacacacaggaacagcactgaggaagtgggcgctggaaagcgcagtgcaccgtagaggggagcttggaaccatccaaggcaataccctcaacagttgcacggccagccgtagctgtccctagatgcgccgtac

SEQ ID NO: 628440 - DNA, 559 bp, Homo sapiens
tagggggcagcgatatgaacccgggaggcagagctgcagtgagccgagatcacaccactgcactccagccggggcaacagagcgagactccatctcaaaaaaaaaacaaaaaacaaaaaacaaaaacaagaaaaggtgcagccactctagaaaacagccgggcagttcctcagaaacttacacatagaattaccatatgacccagcaatccaacacctaggtatataccctaaaaaccggaaaacagggacacaaatacttctaccggtatttcatagtagcacttaacaatagccaaaaggagggaaacaacctaaaggtccaccaaatgatgaacggataaacaaaaggtaaacgtagcctagccatacaaggaaatattactgggccataaaagggaatgaagttaagccaacaggggtgggcagggaactgtagtctcagctactcaggaggctgaggcgagaagatggctggagccggggaggtcaaggctgcagtgagcggtgatttacaccatggcactccagccggggtaccagagtgagactctgtctca

SEQ ID NO: 628441 - DNA, 368 bp, Homo sapiens
tcataaaagggagccaggtacttccagagagtacacccagctgcccttttcgcacccaggtagtgcatttcatccccggccatggagtaactgctccagaagaagctaccgggagaagtggagaactatcaacagctacagaaggacttaagtaaatccatgtcggggaggcagaaacttgaagcacaactaacagaaaatagtatcgtgaaagaggaactggccctcgtggattgaatacaacgtggtctttaaacttctgggtccggtgctagtcaaacaggagctgggggaggctcgggccacagtaggagaagaggctggactatatcacagctgaaattaagcgatacgaatcccagcttcgg

SEQ ID NO: 628442 - DNA, 338 bp, Homo sapiens
cagacaggagaacagagcacaccagcgcgagctacagagaacgtcgtccactctgtgaccaggacgcgctggcgcccacgtcgtaccggcagatcgtggccaacgcgggacacggacaggcgtcccagagccggcgccgcctcgtaccgccgctctcacgacacgaagaagtagatttagtcgtcgtcgagggttctcgctctccgtggatccaaaagtaacttgacgatacttgtggctcatttgagccagcgggagttctgtgtggctctagttcggagtacttggactgattgccgctagggcgtgcagacaagatggtaacagtcgtcgtccgc

SEQ ID NO: 628443 - DNA, 139 bp, Homo sapiens
gccccctctatccctccaaccacctcatgttcctccttgtgcatcttctggctttggggaaggaagtgttgagtgaaggtggtgagaagtgtggttttctgcgtagagcgaagggccgctgtggtgcccacttgcttag

SEQ ID NO: 628444 - DNA, 223 bp, Homo sapiens
acatcgtcaaaagatacaatcaaaaagttttagagcaggaatgaaaggaagcaaagtacacttggaagagggtcaagtgggcaacataagagacccaagtgccctgttcagccttgggctatggggttttatacatttggcatggttccggggtttgtgtttttcttcccttaattttccccttggagcaggctgtctgcatgcacaagtgacctgcccagca

SEQ ID NO: 628445 - DNA, 159 bp, Homo sapiens
ggaggtaccatgtgtgaaccctgtgccagtgcagtatcataaagagagggagttatagaaagagtgaagcgcaatcagcatgaaaagtcttggatggaccaccagcgtgaactgtgtgatccattactacacctcgtaaagcttgacacacacgtggag

SEQ ID NO: 628446 - DNA, 1094 bp, Homo sapiens
  misc_feature (717)..(717): n is a, c, g, or t
  misc_feature (719)..(719): n is a, c, g, or t
  misc_feature (824)..(824): n is a, c, g, or t
  misc_feature (859)..(859): n is a, c, g, or t
  misc_feature (861)..(861): n is a, c, g, or t
  misc_feature (873)..(873): n is a, c, g, or t
  misc_feature (886)..(886): n is a, c, g, or t
  misc_feature (899)..(899): n is a, c, g, or t
  misc_feature (917)..(917): n is a, c, g, or t
  misc_feature (966)..(966): n is a, c, g, or t
  misc_feature (972)..(972): n is a, c, g, or t
  misc_feature (1051)..(1051): n is a, c, g, or t
agcctcgccttgattggatggcaaacagtgccctgtatctccgtgggactgcttgtgccatatttgtccactgtgatctctcctcttggctgtacagaaataacagcaaggcaatatgaacccaatagatagtagtccgggcgatatgtcgcgctccaggaagcacacacggcaatagagatgtctttctcggcaagctcggatgcaaaaggccgtagtatcttacctccagtggataaccaacggaagaatggatccagcgtaactctagaagaacccaaggaattctaaaagggagtctgtcgtctagaatttatcggacccctgtgcttgctcttagaagaagcgtacactgtcttcatggtggccgatttggactgatggaggatttgtaggacttgagacgatggcggccttagtttacaacacttttaattaatggttacacgaacataaggactatactctctgttgtcaacacttaagtgacttaggtctcgtcggggtacacggggggggaaacgctcttgaaacttcgttgtcttactaagagaggtctaaacactcggtaccagctatgctaacgaaccgacatagcgcggcacggaagagcgacgtttgagtacactatggcgaggcgcaagggacgtctactaaggtcgcaagttggttggctaggacacaacctctcgcagttaaaagacatggactagtagncntgtgaaggagccgacatagggcgcttttacgtctctttgcaactgtacatagtcatgagacgacggtagtgactggcaacttgtcacttacagatgctctcgttncacgagatacaatacctaaggtaacgagaactgangnacatatgcgacncgtcggtgagatnacgcgcgggaagnaagctcacaaggggcagngtaccgaaaaagagctcaacataacatctcgtactatcaagcgaagagncgttanaatacgccaagcggttgtatagctaatgacgacaggaataggacgcggctcggtgactaacgtgtatgcaatgcgtttntcactccagttgatgatagctctgcgtaattggctcattacaa

SEQ ID NO: 628447 - DNA, 146 bp, Homo sapiens
actctagaggtatccccttccaggctttattgaggcagtttcccacattaggggaaatcgcagagtgtcagcacatcccgggttgcaactgcgataagtctcgccccgggaaaaccaccttcgtgtcctgcaatcgacgcctggaa

SEQ ID NO: 628448 - DNA, 1564 bp, Homo sapiens
  misc_feature (787)..(787): n is a, c, g, or t
  misc_feature (1290)..(1290): n is a, c, g, or t
tgtgcgtttgccagagtgtgtgctgtgtgtcagtgttttgattttgctatgttggcgctttttgtgtttttgcgcgtcgtggtgtcagtcgtctgttttctccttgtgtttccccgatcggttgttgtgtggttgtgtcgtctttcgtttctctccttgcggtatagcttttttgccggtttggcggttgggttttctcgcgggggcctgtgtgtgtgccgggctgttgtgctgttgtggaggcgataggcgggtttggctgcccttttttttttgttcgcgccgatctctttggtgaggacgcgtgatgatgggcgtgttttgttatagtgctcagctctttgtcatccactgtgttccttgttcctcttagcggtttgtccatccggggaggttgttttctcggcggtggtgcgttttgtgggggtgtctatagattatccccgcaccaaggtagatcctggtgggtgtatttataaggtgagttataaaggtgtgtgttcgtgggggggggctgtggggaagggtgtgacagagagttttttttgctgggattaaaactaacggccccacgggggatttataaaaatcccaacgtggcacaattgttcttttgcccgtttcacaaaaagttatgacccgaatgtggcccggccacaacttgtcccacgaagccaccgggggtggggtgaaaaaggaggtagttagtgcccgcccccccctagagtactccggctctgtttggacacgggtgcctcttagattgttcgtcttcctggtttaagancccgcttatgggtgataacctcttgtgtccactcatagggtgtttcacgctctctcttgtttataggtggtatacttagagagatccccccgcgaaaactctattagtagttattaattgcgcccctcggccgcttaaatagattggttctctgtgagacctgtagaacacactctggggtgtttctcacgcaaagaagagattttcctctatggctatctccctcaagagagatgtgtagcccacgcttctctggtgttacacatggggcacaacacactgggaatataatggggccttctgtgtggaggaatttttagaaaaaattttttgttatgcgggcctcggttaacccacgcaaagatgccccacaattgagatgggtttaaatgtgtgttgtctgtgcgtttcacaaagaattataggtgattaagaaaattataatattggtataaggagagggcccacctcttctcttccactcggttaaaataactctcggnggtgggagaggggaggaataagggagaacctctctttcttataaaagatgtagaaaatataattatactcggctattttaaaaatttcttgagtcacttgagaatgtgagagcccctctaaacactgagatttgagagaagctgtaaccaagtataggcacgagttaattttcccgtcttacacttttttttttgtctttggggagaaaaaattggtaggtgtctaattactgtttacttcattgttatattgccagtaaaagtttttaaacca

SEQ ID NO: 628449 - DNA, 1035 bp, Homo sapiens
aagcggggtattgtgttgaccgaccgccccaagttgtgttgttaacaattttttattgtgtctcgcgcgggcccccccggttatttttgtgtgggcccgtctcaacacacggagggtggttgagatctccccgccgcgccccctctttgttggtgggcccccccatcgtcgctggggtgggagcgcgtggttatcccccctcgcagagagctctttgtagtgaggggtcctttatggtgagacccccccccctctcggggagagaaacaaatataagtgggagagccctccctgtctgtctacacacacaacacaaatatttgtttttttaagaatatattataccccaacgcgcgtttgtgggcccctgcgccacacacacgtggggcactcacacgcgcgctgcgcgtagaaatacttctcatggcacactctcttggggagaggaccacagcagcgtgtgcggcgggaagtttcacacgcagcgtgtctcacagcgagagtgtttcgagagaccccactctctctcgcggctcaaacacacacgcgcggagaaacacccacgctgtttgtcttgtcgtctcagataatagtgtcacacacaaattagtatgggccgcagcgccactatgcgtgtggacagcgcgtccctctcctctggcgtgtctccgcgctatatctctcgcggagagagtctctagaggccacagagagaataatagggcctgtgtacacctcgcggagagagtgtgagagctctccccactctggagaccccagagagtttgcaccccctcgcacactcccaccctgggcggagcacagaagccataatcaattttttccacaaaaaaaaaaaaattaagccacggggtggtataacgtgcgcctgttatagtccacgctaataccacaggaaggagaggttgagaggctgttatagtgagaccctgattgcccaccctgcccccccgtttgggggaccagaaccagaccctgtttcccgagttaattaattatttttacctttaaaaa

SEQ ID NO: 628450 - DNA, 1120 bp, Homo sapiens
ttttaaatgacaggaggattagcacaggaaggccttaccaagaaggtaatttattttttagagacaggtctcactccagcctgggtgacagagcgagagtctgtctccaaaaaaaaaaagaaaaaaaaaagcagccccagccaactgccaggaagcgttgagaggtgtgggaacggcacgtggttcgagccccaggaggttgcaaggtttgcagtgagcgagtgaatcaggcccacagtaccccagcccgtgggctgacagaggtgagaacctgtgctctcaaaaaaacaacaaaaaaaaaaaagaaaaaagaaaaaatatttaccagcgcgtttctatttacagattgttgtgtgagagaaacaatctcgtgggtttctcccattttctcgccccataataaaagagtgtgtttatgtcggcgcgagacattctattcaaaaaagcgctctttttattattgtgtgggcgttatttctactatatagaggtatcttctcctcctttatagacaaactatatatagtggtgagaaaaattgtgggggaatatgtggggaaaatatattagaatcccccactgtatgtgtttacatttgttgctcataaatttctgtggagaagatggtgggggaacagcctcctaacaatatatttatttacaaaaatatctccccgcgggggggagcctatctatacaaaaaagataactgacatatggtctttatataacaggaggtggccaaactacattatgcttgcctttggaaaaaactttgtggggaggggttaggaaacgtgttattttcccctctttttattagagggacagagacaccacaagagaatttctctcaacacaagtggcacccactttttgtagaaagactatctcacgcccctattttttctatctctgtgttgataaacaccaacaaagattctctcagggagcgcaagtttaacaccacactttataacagcgggggggaggggggcacaaacattgttcttgacaatagcggtggaggtaagaccaaattttggggtgaaaacaacgtcgagagagctgcctaataaacatttctctcccattacatgggcagtcagtgcagaactgc

SEQ ID NO: 628451 - DNA, 408 bp, Homo sapiens
tagggcacacagctcctgcatacggagaggctgagattataccaggtgcgacttaggacgcggcatggtctggtccagcgagggctggctgtccccggaagccaggtctgttcgtgtgtagtcacggctcttgtcatagtagtacttgacgttgagtgctggtgagcttggaaaagtcgatgcgcagcgtgcagcaggcgttgtagatgtactgcccgtccttttacagattggaggtgctgggcgctcaccgggtccgcatactgcagcagggcctggaactggttgtacttggtgacggtgatgatcttcaaaactgtgccgaacttggagaaaatctggtgcagcacatccagggtcacaggttagaagacgatctccacgatgatactcctctctgcgtatgga

SEQ ID NO: 628452 - DNA, 705 bp, Homo sapiens
ctcttgccacatggaatggtggagtacggaagggtggaaagggttcggtaggtaaaccctgcaagatgcttctaacacacgtgctgttctcccatctcacgtatgacgactctcccacaggtaaccaaaaccacatttctctctgcttagggaattcaagatcatatctaacttcgaattccaggggtaatgacacggcttctattctccaaagtccagctgtctctcagggcactaatctccctctttcagctcccactcacaattccattttgaaattctacaacctgtagattaactggtaaaattaaccatattcaaccaaaattgtataacccagcaagaatggaagaatgggtaaagtctacagtccatttctagaactggtcatgagaactcatgtctatcgatgatggacttccgatctggctgccccggaccctccaccctctccgcctctgacaccctcacttagccggccctacctgctctcccccgcctctactattggactggcagtcccaggacaaactccaggaatccccccatgtccatctctactcctgccctcttctgacgtagcagcaatcatatcttcccttgatagggttcatcattctagatactccgatgacttcttcatactgagcctgaagtgccctggtggctgctcagctccagctcactcgcatacctctacgtcta

SEQ ID NO: 628453 - DNA, 482 bp, Homo sapiens
agcacgctcgcaagtacaggtagggttaccaactaactagaatgaatcctttcgattcatagtaatctgccacgccttccttccccatggcgttagattataactatttatctcggttttcatcacattcctgtaagaggtggaactttgaagaattcactggtcgttttgtatcacaggtacaactagagcgtacacttaacttttcaactgttctatcatctcgtcatagcttgttcctctctgttcaaaattatgtgaattatccactttataaaaaacagctgcccggaatttcctggcattggtgaagtggcagatggctaatgagcaggcgtttcttcatttttctttgcaagtttgttctatatgctcgtatggcctgaatgcttttactgcttcctcagttctttccatcctccttctaaaggcaaaacacagaacaaccaccaaaagaaaaagggaagcattggatattgttt

SEQ ID NO: 628454 - DNA, 1495 bp, Homo sapiens
  misc_feature (1085)..(1085): n is a, c, g, or t
  misc_feature (1456)..(1456): n is a, c, g, or t
gtctgcaaaccatttattcctgtcccaggtggggaggggcagggactccaggtgtggccgtgagggcacagggccttacgttgtaccacattgaagccgttggcttggcttggaaagccttcctctgtggtggtgcgcagcccgttacagctctccccgaactcaaggggggcaacccaaggcgggtattggtggtggaaacacgagaactctccccacaccttctccagatcggagcaacgttcctttaagtgaagatgaagtggcctctccctctcttcacaggtttcctacccgaaaagcaactcgtgacagagaggtcctcgcggcttcggattcccgtagccgtgttaacaaggtggccaacaaggcgccgaagtgcgaaagacccctcacagagttccttcgaattgtggtagaggcgccctgcccgccatcaacggttcacccaacctctccatttatgtgtcctcacaagagtgcacccgtaaaacatctcagggggttttcacagatctcgcctatatgtgggccccaggaacagtggcgtgtatacgcccccgaaacgagactcctctcgaacccgccccggagacaaggtatcctccccgaatctgtgtataagtctgcgacaatgtggggccccccaatatagcgcccccccccgcgtgcgtcgacacaaggagcacagtgtactcacgtgcaccatctacaacccttgtgtggaaacagcccgctgaggcaactataagcacttctcactaaaacaactccggcgaacagcgcgggcacccgaccttctctctagacaggtactaactcccccccttacgaaacgagtggaggcccccaccacgaagcctctatatacgcccagtatcaccccacagacggcattctcccgtgtgtgtaaccaacaacaggtgtggagctcccccccataaaataacgactgagcagatttccgcctaactcaccacattacaaggcccataagtcgcacacctgtggagaccggggctcccgagctctttaacaccaacacccggtcttccagtgctgcaacctgtcggtgcggcaaaacncaccaccgtgcatctaaagccccacttatcgccgcggaaacccctacttcgtgtacgaacaacgctagacaccgccctttataaccaatttatcctagtgagagatcgttggtactgacacaccacatataaatgtttgcgcggcaacactaacacaaaccaataaacccccaattaacaggcaacgcgcaatattttctacaaacaaagccactccattacaccgcggtgctcacaccgactagttaacaccacatagtcttactcacacgcacatgccactatacaacaggctcgcgtattaaaacacacaactgccgctggcctaatacttgtcgaagtggagccgactctatgaaacaacagacatntcgggcgcatccacccgtggagcagcaacgtatcagctt

SEQ ID NO: 628455 - DNA, 179 bp, Homo sapiens
gcccgggccgatgaagagaaagaggaaggctaacaggattgtgtgtattgccaagggttgggctctaatttttgtctttcttttctctctttccttctttctttctttctttctttctttctttctttctttctttctttctttccttcttccttttccttccttctttctctttcttt

SEQ ID NO: 628456 - DNA, 331 bp, Homo sapiens
  misc_feature (64)..(64): n is a, c, g, or t
  misc_feature (156)..(156): n is a, c, g, or t
  misc_feature (165)..(165): n is a, c, g, or t
caacacaccctcaccaccttcttgaaaatataaagtgatgggacagggtgcggtggctcaagtntgtaatcctagtgctttgggaggctgaggcagatggttcacttgagaccaggagtttgagaccagtgtggtgaacatggtgaaacccttctntactaaaantacaaaaactagccaggtgtggtggcacatgcctataatctgtaatcccagcgacttgagtggctgaggcatgagaattgcttgaacccgggaggcagatgttatagtgagctgagatcatgccacagcactccagcctgggatacagagtgagactcttgtttcc

SEQ ID NO: 628457 - DNA, 120 bp, Homo sapiens
tgcaccatttcctcctcatctagctcttcatgacttctggacagtctaacttccatcccaaggctccactctatagccctatactccatgtacatctactactattactaccccaaacta

SEQ ID NO: 628458 - DNA, 117 bp, Homo sapiens
agcggagggggcggccccaggcggggcggggctgaaggcctggggtgatccgagccccgcctgctccgctggaggtctggagccggccttatcaggaagtggatgaaaagcccggga

SEQ ID NO: 628459 - DNA, 743 bp, Homo sapiens
cccgttttaatcaacacctgtgatgaaaatttccataaaacccctaatatctcaagcctgttccttcacttttccacggggtggagaaagggggggcagtaactctgttattctggtgaacccaaaaattttgccaatgggccctgcttctacctttgtacgtaaaagacgtgggtttagggcatttgtctatccttaaaggccaatacccccaataattgtccttataaatagtcggtcttctccccacaagtttgacccttcggcacatgtcctctaaagggcgtctgccacagtttgattcttgctcattataccctcaaaccataggcaggagaaatttttgactttgatcggagcactgagagccttttggtgaatcttatggtagccaaccacatgcctttccggcaaaggtatatcctgaaccctggtatttacgaaggacaagcgtttgtgcacaagttcttttatctcgccatgagccaagaatgttttagcactttcacataataagatcgattccgcgcttcaagacccctcacgaaatgttcttgacctgcttgaaggtcttaaggcccatctttgtaaagcgttccttgatgaccattaaaagctcaacccccagttttggggtccctttgggccccccctacctgggggtaaaataaacggtttcaaagttgggaaataaaaaaagaaataaaactttgaaataatgaataaaagtttgtcactgacaa

SEQ ID NO: 628460 - DNA, 878 bp, Homo sapiens
ttggcgcgcactctcttggataaatatgcgtgttagaaatagtatggcgcccacccgcgttgtttatggagagatgtattagggctttattctcctcccccgcgtggtttctcacgagagcggccctctaaagagggggattataaacagagtttctgttctccttacccggacgcgccccccacggtgtttatctcacgcgcgagatatatgaagagaggagagagatgatagataagagataggtgctacgcggtcttttgtccccgcctctctggccagcccacactgacgtccacacacacactgttagaggagggctttttccccactcgcgagagagagtttgggtgagacgatcaggtgcgcttcgcaccctctgtgccaccaccgccttggcgagagtctagtcttcttctctctctctagactctcctcttcgtctcgggtgtttgtatctcgtgttgagaaaattggcccctacctcctctccacgccccttatctggggttttctcttgtgaagagtggcccctcactctccttctccacgtgtttcgctctttctgaatcctctgctgctttcgtgtgtgctgtgctagtgtgtgtgtgtgtgtttccctactgactactggccacgctggcccactaattttcccccccgagagaagcttgtggtcccaccatgcatcgaagaatgaatttcccagatatttgcccatggaaacggagccgaggctatgcccagagtgatttagtagtgcacatttcagagccattatctactgccagtaattaacttggaaatatcagccataaaacaaaaataaaaaattatactcgagcattacgtcggtcgagaagagtattccttctcca

SEQ ID NO: 628461 - DNA, 117 bp, Homo sapiens
gcatggctttatagagaacttttcttacctaatgtcttttaaaaaccacgtgtctccctttgtacttaggtgaattctaaatctttacttcactttcaaactacagggcatcgactt

SEQ ID NO: 628462 - DNA, 164 bp, Homo sapiens
tgatgaaacgtgcttgtcctacacaaagacaaatggatcttctattcccagagaaccagggacaccaaaacctccctcttcagaatggaggtagacagataacaaattgagacggggcttgatgtgtcacatgacaatcgtgaaattaataattaggggctcac

SEQ ID NO: 628463 - DNA, 322 bp, Homo sapiens
ggttcgttagtctcaacgattaaagtcctacgtgtatctgagttcagatcggagcaatccaggtcggtttctatctattataaatttctcccagtacagaaaggaccagagaactgggatcgacctcacaaacgcgtctcagagatcattaatgatatatatcttaacctaattaactacataatatatccagccctagaacaggacacattagggtgccagataccggtaattgcctcatatttaaacctttattaccagagtgttcaactgcctctccctaatagcatgtatcataattaacattctaagcctaaatcga

SEQ ID NO: 628464 - DNA, 766 bp, Homo sapiens
ctaaagaccacttccaacgcttaaccgtgtcaacgctattccctctgcactagaccattttcccgccccgtaccaatctttatccttcccgcctttgatccttccggacccggcaaagggttttatccccgccccccccctccgctttgtccctctgtaccccagtcaacttgtgtcaagttcaaagagccaattggtcagccttcaatcacaagggtcttggatcacaacacgagatttccaaatgatgcggtgacccccgtaaaatattttcggttgcggggtatagctctgtttaaataagggtcaatctcggacttttcttattttgacggcccaggtcccaggaatattaccgtcttctgcagactctagttaaatcttatcccatctccgacatcctgattattaccattattcatcctccgagattctcagtacctctcccaactctccccagagattatatggaatcccccttcaaaattctcagaatatattccacaggacttaacgacttttaacaacactaaccccatcaccacgcccctgtaccaggcaccttcagtgcaccacgttcatagcctgcagcaacacgattggttcagactatatgaaccacgactctacaccttcctgaagtgaaatgaaccacgaattcgcataactgacccacgtgaacttctattggcacttcacttatcaaccactttctctatattcgcgaaaacacggtctccacttatcccggtggaaacccatttcc

SEQ ID NO: 628465 - DNA, 753 bp, Homo sapiens
caaaagactggcagcattttgcttctgccatagagatctgtggaacttggaacttgagaaagatgatttaggcatccggtggaagaaatttttaaatagcaaggcattcaagatgtgacttgggtgtgttaaaagcattcagttttctgtattcacaaagatatggtttggaatcagaacttatgcttaaaagggaagcagagcataaaaatttagaaaatttgcaggctgatgatgcaatagaaaagaaaaacccattttctgaggagaaattcaagcctgctgcagaaatttgcgtaaataatgaggagaaaaatgttaatcaccaagaaaatgcagaaaatgtctccagggtatcgcagagagatttgcagcagcccctcccatcacaggcctagaggcctaggaggaaaaaatggtttcgtgggctgggcccatggcctcgctgctctgtgcagcctagggacttggtgctctgtgtcccagccactctagctgtggctaaaagaggacaaggtacagctcaggctgtggcttcagagggtggaagccccaagccttggcagcttccatgtggtgttgagcttgtgggtgcacagaagttaggaattgaggttggaaaacctctgcctagtttcagaagaagtatggaagcacctggatgtccaggcagaagtttgccgtagggggtagggtcctcatggagaacctctgctagggctgtgtgaaagagcaatgtggggtggggtcccc

SEQ ID NO: 628466 - DNA, 398 bp, Homo sapiens
gccgctctggcgctgctccgcaaagagatgaatttgcagtggtgtgctgcttctttcaaaggatgtgtaaattcttttggcttgcctgacatgttcctgtggtggtccttggagcaaaagtccatgatacagctggtcatgccacagatagtgaagaagaataaaactgtgaaaaataaaggatgtatttagaatgccacattctgctgaaaatcaaactgacagacactagggcaggccctgagttaaggtggatacaaaggaacccaaggcatgcctctcccagcaccagacttctgaacaggctgggagagtgaggcataaacacatgaaattttaataccagacagacatagataagtataaaacataagataataaaaaacagggtaatggca

SEQ ID NO: 628467 - DNA, 354 bp, Homo sapiens
  misc_feature (169)..(169): n is a, c, g, or t
gtgtcagttgtggagacggtgggaaaccggggttcgtgagagtccgggacggtcgacgatccggatcttcctgtgtcaccggttaacggtttccatctccagagatttctggtgttggtcaaaaatctcaccctgtcacaccgagcttggtcttggtcactgatagcanacactgggactcagttcccgtcatctgtctgggagactcccagatgggtcgtcgatgggaatctgaggggctctggtccccagaggaaaatctcggattgtgtgactatgagactgccccagtcgaccacctgacctcgacctcggttgtcatcttgatcgaaacgtttggagtcttttccgtgg

SEQ ID NO: 628468 - DNA, 163 bp, Homo sapiens
aaacaccgttgatgggagagcacagggacatctagtcgtggatatttctacacagagatcatgtgatctacaaagcctaaagtattatgccatctggctccttagagagaatatttgcccactcctgagccaggaactttaccttgcaccaggtaacttttgg

SEQ ID NO: 628469 - DNA, 777 bp, Homo sapiens
tttttattttttttttgggagacagagtcttgcacggtcgcccaggctggagtgcacagggcacaatctcggctcacggcaacctccgcctgaagggagattttcaaagcaatcattgcctctatcataggtagtcttccaatggtaatactgggcaccaagcaagagaaccgagtctaaattaaaatctaccctcaaaatggtacatcacagctggatggtgcacagcaggaaggacgatgtcacaaaaatggcaacagatctggttcctatggcacattccacctttcccacgtactggcttggcagcccagaatacaccaaaacatctttttatagagtggtcgtggtctttaaagaaggagcttactacactagtgccacacacattacgacacgacactagcacaccacgacgacttacaccctactacgacgacacgacaacaacacaaacctctcaaagacgcgggggttattacttcaaaggagacttggtggtggtaatcagaaggtcacacccccatcagcgttgggccacaagaaacattcaataaagtggggtccaactaattcaaggggcaaacatgtaagcacccccaaacatgacatgtgctacacccaggggcagacgaaacgacactcatagcggggggcaagggcgctcggggcacaactacgtgggagcactggagacaacctgcacatagtcgcaatataattgtgggcagaaccatcaacttccctcccaaaggtgttgggggcccaagcaaacat

SEQ ID NO: 628470 - DNA, 274 bp, Homo sapiens
aacgtcggccgtcctcagtgctcctttctctgggctgtgtcacagcagcactcagaagacataacagcgtgcaaccttgtcccagaaaaacaggtaagattggctaaactcgagattcttcaatatttaactttgtcatgaatggaagcctcataacattcagacaagataagatccagcatcgccctgagctcttctggttggtgattggcttgcgctcctggggcacggcgtgtggtaacacatgctgcgcgctcgggaccgtggcccggtt

SEQ ID NO: 628471 - DNA, 117 bp, Homo sapiens
cacatttcagttcacatctgttatcatggaacttaaaataaccgtcatgctctggagagagatgttccatgtcagtccgtagcacatctgataccaggtgaaaaagtgatataactc

SEQ ID NO: 628472 - DNA, 163 bp, Homo sapiens
gattcggacgaggggtaaagtgctagtggggagttttagccaggatgagccaggagaaggaaaaacaaggagttaattaaagacaagcagccgggccaggccttaaccaggcctggccttcttgcttaaccagtagttaaaatcaactcttaactttgagact

SEQ ID NO: 628473 - DNA, 322 bp, Homo sapiens
accccgggggggtttcttccttttttttttttggccaaaagcccttttaaaaggggccaaccaaggggttccctcccccccccccaaattgggcctggttttttttttccggggagggggggggccccccccccccccccccccccctttttttttcccgccggggccccccaaaagggggttttttgggggggggcccctttttgaaaggggggccaaggggggtgtttggggcccccttttttttttttttgtttagggggggggttttttgtttccccccccccctttttaatttcctttaccggtcctttttttttga

SEQ ID NO: 628474 - DNA, 233 bp, Homo sapiens
aagaggctgaagcaggagaatcgcttgaacctcggaggcggaggttgcaatgagccgagatcgtgccactgcactgcagcctgggcaacgaagcaagactctgtctcaaaaaaaaaaaaaaaattcgaaaagaggcccttccagttttattttgctaaaagtagttttaacggggcccgtggggttttttaaacacggatgttgggttttattagactaaacctagcttttaa

SEQ ID NO: 628475 - DNA, 148 bp, Homo sapiens
ccatttttcccccccccagggcctgagcacgccctcatttgttttggtcaatgaagctcaaggaagcattgccctttggcttccgctttaagttttgtatgttgatatgtatcccatgttttctaccaataaagggctatttccctgc

SEQ ID NO: 628476 - DNA, 464 bp, Homo sapiens
atctgcctgactcggcctcccaaagtgatgggattacacgcatgagccaccgcacccggcccagatgaaaggaggttagaagatataaatgaggccaattggattggctactcctagcctgggggaaatgatgcagggagttagagagtgttcctgggaaacccctctcacctgacaatttggtacttgttagtgattctttgaccctcatttctttcctgaagggtctcttgacgcccagactccattaggggtggccagtggatgaaagtatttgagctcgccagaaccatgtaagcaatctggccagttgtttttttttcttttttttgtggcttgcattgtggcatctgctgggagatgctaattacagcaattaagtaaaatgaggatgtaatattgcttagcaacccagttacctaatatgtaattttactaatttggctgaatctgtgtgctgtaac

SEQ ID NO: 628477 - DNA, 511 bp, Homo sapiens
agagaaacgaagattctgatatacataagtgaatctaaataaaaattcacaaggggtggctgaaatcctgtcaactttcaggccaactagcaatataatatccgcagttataatgcataaacaattcgaaattagagtttatgatggaaatgtcaacaagtcataactactacacattactactgatgggttccactatacttcaacctggcacagcagatgtgcacatctgatagacagactgcttagaacattagagctatcagagctataaatcaaggaatacataaatatgaacatagcaatgccaaagcgattagagctgttaaagacaaagtgaataagcatgtgcatgtaaaccacatctgatagttctctctgtgagccactttccacggagtttataaagctagtggttttataattcttttaaaaagtaaaatttttctacactgctgcatgcagtaatttcattgtacattctcaactacaatgcaatcttcaaaccctc

SEQ ID NO: 628478 - DNA, 1062 bp, Homo sapiens
ggagatctctggatccatgaccatccttttccttttaagagcatggcatcgtctttggtcgcaatgacctctgcaacttttcctaagtcatgaggatgaacgtcttcagagattcagggtcaatccctcttctccaaacactgcaccaccagtagccatagccagtatcttaaagctggttctttctattgtcaccaaaccctggagccttgcatgcacaaccagaagaccaacctttagcccgttattcagaagacgagtgtacatttagacggcatactccatcagcatcttcagcgattatgaccaaaggcttaccgggagccatggcagaatacacaaaggagccggtcacaatggcactgcatactagcagcatgggctacagacacgccaacggaaacataggcatccatggaatgccacaattactgaacataagaacgtattacagtcaagcatggaaaaatatagacacagaaacagcaacctatcatggcagtgcatctacatcagctcaaatggcaccgatgccaggatagaccacaacccacagaagggcgatgaaccaccctacctggccgactcacacagtagcgtcggaaagaccgcaaatccgacgcggaccagcagaacaaacaaaacggagagaacacagcacccaacacggccccacacatccaccacgaagggccacaaccgaacaaaaagcgacggacaaggacggagaccaacgcacaacggaccaaccacggcgcggcaatccccagcagccaaaagagaagaccacagcgcgtacacttgaacacaaagcacacaagtataaaggactcgaagacaagcgctggcacgaagacacgccagcacacaacaacacacaaaacacacagccacagcagcacacccccagcaacacaccaagcacaacaacgcacaaccagacacataagacatatcacccatcagccaagaaaccaccacaaagacccaacaacagcacacaagaacccgaaacccacggaccagaccacacgaccaccacgcaggatagagaagcaaaca

SEQ ID NO: 628479 - DNA, 1035 bp, Homo sapiens
  misc_feature (53)..(53): n is a, c, g, or t
  misc_feature (67)..(67): n is a, c, g, or t
  misc_feature (70)..(70): n is a, c, g, or t
  misc_feature (72)..(73): n is a, c, g, or t
  misc_feature (78)..(78): n is a, c, g, or t
  misc_feature (80)..(81): n is a, c, g, or t
  misc_feature (113)..(113): n is a, c, g, or t
  misc_feature (123)..(123): n is a, c, g, or t
  misc_feature (127)..(127): n is a, c, g, or t
  misc_feature (130)..(130): n is a, c, g, or t
  misc_feature (132)..(132): n is a, c, g, or t
  misc_feature (137)..(138): n is a, c, g, or t
  misc_feature (140)..(142): n is a, c, g, or t
  misc_feature (148)..(148): n is a, c, g, or t
  misc_feature (160)..(160): n is a, c, g, or t
  misc_feature (162)..(162): n is a, c, g, or t
  misc_feature (164)..(165): n is a, c, g, or t
  misc_feature (169)..(170): n is a, c, g, or t
  misc_feature (173)..(173): n is a, c, g, or t
  misc_feature (181)..(181): n is a, c, g, or t
  misc_feature (183)..(183): n is a, c, g, or t
  misc_feature (187)..(189): n is a, c, g, or t
  misc_feature (191)..(191): n is a, c, g, or t
  misc_feature (202)..(203): n is a, c, g, or t
  misc_feature (207)..(207): n is a, c, g, or t
  misc_feature (209)..(210): n is a, c, g, or t
  misc_feature (212)..(213): n is a, c, g, or t
  misc_feature (227)..(227): n is a, c, g, or t
  misc_feature (231)..(231): n is a, c, g, or t
  misc_feature (237)..(237): n is a, c, g, or t
  misc_feature (241)..(241): n is a, c, g, or t
  misc_feature (247)..(247): n is a, c, g, or t
  misc_feature (258)..(258): n is a, c, g, or t
  misc_feature (260)..(261): n is a, c, g, or t
  misc_feature (278)..(278): n is a, c, g, or t
  misc_feature (280)..(280): n is a, c, g, or t
  misc_feature (286)..(286): n is a, c, g, or t
  misc_feature (289)..(289): n is a, c, g, or t
  misc_feature (304)..(304): n is a, c, g, or t
  misc_feature (307)..(307): n is a, c, g, or t
  misc_feature (309)..(310): n is a, c, g, or t
  misc_feature (312)..(312): n is a, c, g, or t
  misc_feature (316)..(316): n is a, c, g, or t
  misc_feature (336)..(337): n is a, c, g, or t
  misc_feature (341)..(341): n is a, c, g, or t
  misc_feature (361)..(361): n is a, c, g, or t
  misc_feature (369)..(369): n is a, c, g, or t
  misc_feature (374)..(374): n is a, c, g, or t
  misc_feature (408)..(409): n is a, c, g, or t
  misc_feature (413)..(414): n is a, c, g, or t
  misc_feature (418)..(418): n is a, c, g, or t
  misc_feature (428)..(428): n is a, c, g, or t
  misc_feature (430)..(430): n is a, c, g, or t
  misc_feature (442)..(442): n is a, c, g, or t
  misc_feature (451)..(451): n is a, c, g, or t
  misc_feature (453)..(453): n is a, c, g, or t
  misc_feature (455)..(455): n is a, c, g, or t
  misc_feature (457)..(457): n is a, c, g, or t
  misc_feature (464)..(464): n is a, c, g, or t
  misc_feature (468)..(468): n is a, c, g, or t
  misc_feature (485)..(486): n is a, c, g, or t
  misc_feature (490)..(490): n is a, c, g, or t
  misc_feature (496)..(496): n is a, c, g, or t
  misc_feature (500)..(500): n is a, c, g, or t
  misc_feature (502)..(502): n is a, c, g, or t
  misc_feature (506)..(507): n is a, c, g, or t
  misc_feature (509)..(509): n is a, c, g, or t
  misc_feature (518)..(518): n is a, c, g, or t
  misc_feature (522)..(522): n is a, c, g, or t
  misc_feature (534)..(534): n is a, c, g, or t
  misc_feature (558)..(558): n is a, c, g, or t
  misc_feature (702)..(703): n is a, c, g, or t
  misc_feature (708)..(710): n is a, c, g, or t
  misc_feature (714)..(714): n is a, c, g, or t
  misc_feature (725)..(725): n is a, c, g, or t
  misc_feature (750)..(750): n is a, c, g, or t
  misc_feature (752)..(753): n is a, c, g, or t
  misc_feature (779)..(779): n is a, c, g, or t
  misc_feature (853)..(853): n is a, c, g, or t
  misc_feature (880)..(880): n is a, c, g, or t
  misc_feature (955)..(955): n is a, c, g, or t
  misc_feature (965)..(965): n is a, c, g, or t
  misc_feature (990)..(990): n is a, c, g, or t
gggggggaggggggggggaggggggggggggggggcggggggggggggggganggggaggggggagncgngnncccgngnngcgcgcccgcccggggccgcagacagcgcgcnaggcccagcngagnggngnggggnngnnncccgcncggggggggggngngnngagnngcngggggggngngggnnngngacccccgcanncagngnngnnggaccggggggggngggngggcgngggngggcangggcaggaggngnngggggcgggggggggcngngggggnggngaggggagggggggnggnannanccangaacaaggggggaggggggnnaganaagagggcggggggggaagnaagaagangaggnagaggggggggcacagggggggggaggccaaggnnaggnngaanagggggggcngnggagagggggtnagcgacagngngngnaagaggngggnagagggcagagaggggnngggngagggngagngngggnngngagggcagngcangggggagattgngaggggggaggggccgggggaggngggggggcccagggtggacaagctggtggagaagatcctgcactgtagctgccaggcctgcggcaaggagcctagtcacgaggggctgagcgtctatgtgcagggcgaggacgggccgggatcccagcccggcacccaccctcnnccccnnncccncccccatcctngcgggcagacccctgaacccgaggngnncctggggcccccacacagaggaaganggggctgaggactgaggccccccaactcttcctcccctctcatccccctgtggaatgttgggtctcactctctnggggaagtcaggggagaagctgaagcnccctttggcactggatggacttggcttcaaatcggacttgaatgctgcccggttgccatggagatctgaaggggnggggttagancaagctgcacaatttatatattcanagtggggggaggaacaaagtcttcaggctcttttttgggggggtg

SEQ ID NO: 628480 - DNA, 613 bp, Homo sapiens
ccacatccagaatttgttgaatgcttatatgttaacttcgactttgatggggctcagacaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaacccagatgttggccctggaattttaatactcccccttttcagaatagcaggtcaaaggctccgacccgggcaagtctagattctggcttcgtttgaagaaccataaagaaaatatgaaaaaagcaactatcaaagaaagatgaaataatagatctattatataaagcggtcactcacacttttggaatcaacatatcaggtataaattttgaagaattggaatacctctgattcatttta

SEQ ID NO: 628481 - DNA, 244 bp, Homo sapiens
aacataccttacacacaaaacattctactacatttgatccatcatcttgacagacttgctaaccacaaggaataaaaagtaggcctcatcatacggtcaggtaatagatccacaacatacaatcacaccccatacctagttagtcattctcagctgtgtcatgcgtcacggcataaggcttagagaagaccccaatcttagggcaactgctcagaaatctagccccaggtacaacagacattat

SEQ ID NO: 628482 - DNA, 130 bp, Homo sapiens
ggtcataacagaactgccttacaggactgacttgatgagaagccagtgagtcacatgtccttatatttcccttgccgagggagagcagtgtctctatgggctcctctttgccctgtaacctctcaagtaa

SEQ ID NO: 628483 - DNA, 789 bp, Homo sapiens
gttcagtcacatctgaataaatcagttgagagactgcttatagcatcatctgcaccatgtgtggcatccgggcgctgtatggccgtcgatgattgccttatcttgctgcagctgtactggcaggtgtctatgaaggattgcggcagcaaggagtgtccatgatgacattcgcgcttgtgagactgtcaataggatacagccgaacttgctgaatttggaattgcactcggcttgagcggctagtgtagaccctgctggtgtggaactgcgagccaaataacgcatgtgaagcaacaagtatccgtatagagtgagctctgtaacaataggttgaagatcatatagaacataaagaaagatgcgacacgagcaatttgtgaaattgtgaatacgcagagccaaaagtggatggttgagataagtcctatcatacttggatagacgaaaggaggaagttgagcaaagcaagtatgaactgttggcacatggcgaggacaagcgagtagaagacagaacgagagaccaactgcgcaaatacagaaaaagagataccgaggagataaacgagacacaaaaggaaatcaagaagaacacgcgaaacaacccaaaagacaagccacaaaaggaaaaaagacaagcaagaggaaaacaaaagcaaagcagcggacaaaaacaaaagtacgaaggcgaaacgacaagatcaacaaaaaaaagagaagaaacaaaaacaaccggagaaaagaaaaaaagaaaagaagaaaagaggaagaaaggaacaggagacagaac

SEQ ID NO: 628484 - DNA, 105 bp, Homo sapiens
gtaactactgactatcaaacagcagacacccactacctaccacctatatgacgctaggggctaggcatagccctacaagcgaccactatagtacacaggctcata

SEQ ID NO: 628485 - DNA, 666 bp, Homo sapiens
  misc_feature (181)..(181): n is a, c, g, or t
  misc_feature (420)..(420): n is a, c, g, or t
  misc_feature (442)..(442): n is a, c, g, or t
  misc_feature (452)..(452): n is a, c, g, or t
atatatatatatatatagtcaagagcgcagaaagacaagatactccatgatctcgcttatatattaagaatgctgaaaaagtcaaactcatagcagaggaaagtagacatgagtggttacctagtaggagtggcgagccgaggacacaggtaatggtggagtgtagttggatcagaagggntacgaaaggtttcacaattggacagagaggcagtcaagtttggtgacactttaatggccacagctatttgcacatatatatgttaatcaatatatcgatagttggcatattcttcaacaattcgtctagagacagagtacactttgcgacatacttcctggagccagagaagaaatcggttagtgtagactggtaggatggggcttatcgtatgagattcaagtcccaataattgtcanttacccagtctaatgggccatntacaatgatntatccagaaagacgacatggttatatggtcactaaatggactcaaaggtcggtgaatacaaacgtgtgtatggtgtacactctcatccagagtcagtatatcaaagcgaacattgaaaagaaccgatagtttaagagacaataagatagaatatacaagagacatcggggcgagagggccacgaggatacgcctggttctgaccgcttctcgtt

SEQ ID NO: 628486 - DNA, 1218 bp, Homo sapiens
tcgtcctccgtgtgggtctctatgaccctctgtgagacagaacgtctgttggtcgtagtgtttgaccccctgaagatggtgtttggggacggactccatatttgtaggttgtttacataccccggctgttgtttttgaggcgcgcggagttgtggaagaggctgtgttttaaccaccccccctttctgaggaggtgccgccgcctccttttgtttgtcgggcaccccctccgcggttggacccgccccccctgcagagggttggggaaggtccgttttttttctccttgggtttgcccagagttcaaacaacatgtcgtggcgcaccatggggaacctgatttagaagaggggaaaaccttccgggaaagcccccgagatactggacacaaatggaatttcttggtttttggggggaaaacccccagaatatctggacccagatggatttctaaatgtggacttgtgacctggtggagggttttcccctagtgacacgtagttttatagaaggtgtacccacaggttttaaagttattttagagaaattaccagtgtatactagatgtgtaagaatattggcgtgtttataccccaatatgagcgttttcccgtccccgccaccgtgtttgtccctcttgggaagacccctcgcctgactgcttttctcctggttctccgagtcatatcttcgtgcccttagagctcgcccctcttcggtggtcccactaagagggccttcttctggatgcccctttctgaaagagaacccacctgcttttttacccatggccccccaccccccacccccgccccacttgagaccacgggttctccacactatgtggccccacggctgggttctccaagactttctggccctctaagtgagtgctccctcgttccctggcctccccaaggtgctgggattaccacggtgtgagccacctgcaccccacgcccacctttttttttaacttctgaagtgatttccacggtcaataatgtgtgtgtaacctgcactcctatgagaagagcacccaatattgctgttccactgttctccacctttcacttttcccctacacaatgaaaagccatttttgagactgaatctgttgctattttataaggttatttcgtgggagaaactgaggctaaaggagttagccatctcttatttttgtatccaaaataaaggttattttgaaattaaata

SEQ ID NO: 628487 - DNA, 470 bp, Homo sapiens
  misc_feature (21)..(21): n is a, c, g, or t
  misc_feature (93)..(93): n is a, c, g, or t
agtgaaaaaatagactatggnattaacgcccctgtcgtgtgacattttctgactatggaaatgatattagacaaaaagcaacttaagtggttnttcttatttgagttcaaaatgggtcataacgcagcagagataacttgaaacatgaacagcgcatttggcccaggaactactaacgaacatacagggcagctgtgattcaagaagttttgcaaagcagactagagccttgaatatgaggaacacagtggccagccattggatgcttcacttcttgaagcatcttgacagctttttgcaggtgaaatgcttccacaccagcaggatgcagaaaaatgctttccaagagtttgttgaatccagaagcatggatgtttatgctgcaggaataaacaaatttatttctcgttggcaaaaaagtgttgattgtaatggttcctattttgattaataaagatgtgtttgagcct

SEQ ID NO: 628488 - DNA, 446 bp, Homo sapiens
cgggcagcagttcatcactccgttccaacgtctcatcgccgttccaagatctcatggctcgtgccaacatctcatttctccttccaacatctcatgacttcttccaacatctcatcgccttccaacatctcatgtctccttccaacatctcatcgctccttccaacatctcatccccccttccaacatctcatcactccttccaacatctcatcgccttcccacatctcatgtctccatccaacatctcattgcccccttccaccatctcatggcaccttccaaaatctcatcactccttccaacatctcctcactccttccaacatctcatgcaccttccaacatctcattgcaccttccaacatctcatgactccattccaacatctcattcctccaaccaaaaactcataactccttctaacatcatcatagctccttccaaa

SEQ ID NO: 628489 - DNA, 164 bp, Homo sapiens
gtcagcaaaccaacatggcatgtatacctatgtaacaaacctgcacattgtcacatgtaccctagaacttaaagtatatatatatatatatatatatatagggcgctcaataaaggatgttaagaagaaaaaaagtaggcgtgagaggagacgcatgggatatg

SEQ ID NO: 628490 - DNA, 331 bp, Homo sapiens
  misc_feature (1)..(1): n is a, c, g, or t
  misc_feature (194)..(194): n is a, c, g, or t
  misc_feature (231)..(231): n is a, c, g, or t
  misc_feature (261)..(261): n is a, c, g, or t
  misc_feature (298)..(298): n is a, c, g, or t
ntttttttcaaagaagaaatacaaatttatttcaaagaagatatacaaatggccaaaaagcacatgaaaaggtgctcaacatcattagccactggggaaatgcaaatcaaaaccacattgaaataccacttcgtacccaacaggatgactaaaataaaagagtcacaaatgctcataaagatgtgggaaacagnccaagtgtgggtgggcttcacacctgttaatcccagncattttggggagggccgagggtgaggcagnttcaccttaaggttcagggagtttcaaggaccaggcntgggcccaacacagccaaaacccccttctctta

SEQ ID NO: 628491 - DNA, 749 bp, Homo sapiens
gctgcccgactgtagtgtcatgcgactggacgtggctcgacataagagactcgaccgcgtcgacaatccagcgaacagccgtattagacgattcacccaccatctgtgcaggcaagactatgagagtaccatacactcatacatatctacagacgtactctgtccactatggtacaagaacgcatatctccgcaacacacgaaacaggtacatacaacagcatgacttggcaaataagctatcatgaaacatcacccaacacagaacatggtaccatgaaacgacgcacacatgaacccaggagatatatcaagacgaacgtgccagaaaaatccccatcagtggatgaatgcccgaacaaatgcggcaacacacgaacgaaggatgataacacaaagattccccattacatgtgacccaccaaccattaacaaggggcaatcaccacgacacatgagcgcaaactgtaggcaacagcagataagactttggacacagtatgtaaaccatgataactactccctgattcaacaactcacttcctcggcacacactgggagcatgtcacagtctatcaccccttaatataacattcacaagatataacaaaccacaataacccacttaccagaacaccatcataaatatgaaccgcacaggggagttgtacccccatggatcatatcatcaaagggagagaaaacctaatagaactcagcaagaggaaaaatcactcagcacgatcacat

SEQ ID NO: 628492 - DNA, 153 bp, Homo sapiens
gaccaattgctccaaagcttgatctctgagcctggaacaaagggctttgtttgtcaggtgaaagccttactgcagccctagagccagcccaaagagctcccggtaagatgctctgcttgaaaccctactatcctggagaagctgtgaccggcg

SEQ ID NO: 628493 - DNA, 710 bp, Homo sapiens
  misc_feature (1)..(1): n is a, c, g, or t
  misc_feature (74)..(74): n is a, c, g, or t
  misc_feature (93)..(93): n is a, c, g, or t
  misc_feature (98)..(98): n is a, c, g, or t
  misc_feature (128)..(128): n is a, c, g, or t
  misc_feature (130)..(130): n is a, c, g, or t
  misc_feature (135)..(135): n is a, c, g, or t
  misc_feature (142)..(142): n is a, c, g, or t
  misc_feature (146)..(146): n is a, c, g, or t
  misc_feature (159)..(159): n is a, c, g, or t
  misc_feature (165)..(166): n is a, c, g, or t
  misc_feature (168)..(168): n is a, c, g, or t
  misc_feature (200)..(200): n is a, c, g, or t
  misc_feature (207)..(207): n is a, c, g, or t
  misc_feature (251)..(251): n is a, c, g, or t
  misc_feature (254)..(254): n is a, c, g, or t
  misc_feature (262)..(264): n is a, c, g, or t
  misc_feature (267)..(267): n is a, c, g, or t
  misc_feature (269)..(269): n is a, c, g, or t
  misc_feature (274)..(274): n is a, c, g, or t
  misc_feature (276)..(276): n is a, c, g, or t
  misc_feature (283)..(283): n is a, c, g, or t
  misc_feature (286)..(286): n is a, c, g, or t
  misc_feature (289)..(290): n is a, c, g, or t
  misc_feature (296)..(297): n is a, c, g, or t
  misc_feature (299)..(300): n is a, c, g, or t
  misc_feature (302)..(304): n is a, c, g, or t
  misc_feature (307)..(308): n is a, c, g, or t
  misc_feature (311)..(312): n is a, c, g, or t
  misc_feature (321)..(322): n is a, c, g, or t
  misc_feature (326)..(330): n is a, c, g, or t
  misc_feature (333)..(333): n is a, c, g, or t
  misc_feature (336)..(336): n is a, c, g, or t
  misc_feature (358)..(358): n is a, c, g, or t
  misc_feature (364)..(364): n is a, c, g, or t
  misc_feature (369)..(369): n is a, c, g, or t
  misc_feature (385)..(385): n is a, c, g, or t
  misc_feature (388)..(388): n is a, c, g, or t
  misc_feature (395)..(395): n is a, c, g, or t
  misc_feature (414)..(414): n is a, c, g, or t
  misc_feature (425)..(427): n is a, c, g, or t
  misc_feature (429)..(430): n is a, c, g, or t
  misc_feature (438)..(438): n is a, c, g, or t
  misc_feature (444)..(444): n is a, c, g, or t
  misc_feature (448)..(448): n is a, c, g, or t
  misc_feature (461)..(461): n is a, c, g, or t
  misc_feature (470)..(471): n is a, c, g, or t
  misc_feature (480)..(480): n is a, c, g, or t
  misc_feature (486)..(487): n is a, c, g, or t
  misc_feature (489)..(489): n is a, c, g, or t
  misc_feature (499)..(499): n is a, c, g, or t
  misc_feature (511)..(511): n is a, c, g, or t
  misc_feature (516)..(516): n is a, c, g, or t
  misc_feature (530)..(530): n is a, c, g, or t
  misc_feature (567)..(567): n is a, c, g, or t
  misc_feature (621)..(622): n is a, c, g, or t
  misc_feature (644)..(644): n is a, c, g, or t
  misc_feature (674)..(674): n is a, c, g, or t
nacacgggtaaatatcttgacagaaagtaaacaaaacagcatttaggactaaaaaattattcttatatctttantctcttcctctggacaagnaacanggcccaactacatacacctaaaccagaaangncgtangaatganaaanaaaaggcctattncccatnncncgcattgcagcttcttgctccatatattcttncttttanatcaaagcagacaacaaaaacaacactaaggcatagatcttgtnggngtttgacnnngangngatancncctcatngcnttnnactaanngnntnnnggnnatnnggggaaagnnattnnnnnggncangatatagggcaccatgcctggncagagnccttnatagaaaacctaaggnctngggcccncgttgagtcaacaaaagcnttaagcaaggnnngnncaggggcnaaagtnaggngacagactcatgngaccaagannggcaatggncccttnncngcctgcggcnccacaacttcgnggggnaaggacttggtacnggggagacctggccctttatgaggcaggaagtaaagnctgtggattcactgacactgattagcatgctggtccttcccagggtctcactgnnttcctaggatctaggaattttnctgaggcacccccttcctgatctacttcanttacttctgctgagaaccagaaagaggttcagaaac

SEQ ID NO: 628494 - DNA, 948 bp, Homo sapiens
gctccacaatcagtctgttttcttaccattcctatcagaaccgaccacctcccatgacccaccccaagccctgaaccccttcatggacagatcccccacagcctggggcaggaagaggcgtcgagggcgccagaagtggcggcagcagcagccgcagcagccaaagagaggccagagaaagacgaaaaagccgcggcgccgtggattggcgaaacctgggcgtcccggaagagctgtgtccccgtgtttacagctcggtccccgtggtctgaattgtcacaggccatagccccagcgctcataggcccagggcgctgaggtctggtgggggactagccgcacgagggcattgcccccccccaaattgctgcaccgcctgcaaacgcagtcacacaactagcggggtgagtggaacaaggacagggggggccaccaccaagaggaccactataaaccaaccgaagataactcacgctatccgctgtgcagaccaaaaccccgacagcgcgagttccaaccacctttacctaagagagccccccgaagcgccgcacaccactctggacccacaaccccccgcgcaactgggcacagcccgcgccaacacactccacacaccgcgagcgcgccatgcgcgcaacgcggcacccagcatacgaccgcccgacacctcacccatacccaacaaatgacaagtacatgaaactcatctgctctgtcccacacacgcgcccgcacaccaacttccactatactctcagtaccacatcagcgctacccctctccaccacgcgcctcaccgtcacacgagacggcctcgccgcctcccacacacccactacacaagtcgagccaatcccaccaaccaacccctccgacggaacaccagacaagaccgggccgcccccccaactacaagtacgcacccccttccgacagcgccagccc

SEQ ID NO: 628495 - DNA, 247 bp, Homo sapiens
cacctggtgggtgggactacttgttgcggtgatgacggttgcgacctgatgtgacgcacggactcactgccacctgtactccaacctgggtgacccgagtgagatcttgtctcacaaacaacaaagcgagaacgctttatggcatttggctatttagggcccccctatttaaggtttacccccccagtggtaacgcttttaactaacattttcataacaaccacaaaaccggagccgtagattcagg

SEQ ID NO: 628496 - DNA, 802 bp, Homo sapiens
  misc_feature (797)..(797): n is a, c, g, or t
ggacgcgtgggtcgacccacgcgtcgcccacgcgtccgaaaaaaaaaaaaaaaaaaaaaaaaaaaaaaaaaaaaaaaaaaaaaaaaaaaaaaaaaaaaaaaaaacaaaaaaaaaaaaaaaacaaaaaaaacaaaaaaaaaaaaaaaaccagaagagcgagaaagacacaaaaataagaaaaaagaagagggagacaagataaaaacgatgagactgtgtacaagaagagcgagcaggaccaataaggaaaagtcctgtgcatagagagagcagagacagaaggccaggggggcggcgaccagtaacagggaccaccaaccgacgccagaaaaacaatataaaagggggaacaaagggggaagaacgaggaagcagaaatacaactactgaaggattatatagggaggatttgaccctgaggaagacagcaacaacaagggattaaggagcacgcgaatgaaaaagaagatttggtggagttatacactcactatcgcgaaggcaacggagcggacgaacgattgtaagtctcaagaggaaggggagacagacggaaataggaaaaataaagagaaaagacggagcggcacggagaacgtcacggaagaagagagcgagaggaaggtgagcgcaccaacacgacgcggggagtatacagtagtggcaaggtagtggtcaccgccacatatggactaccagacagcaacagaagacaagcgcgcggggacacgaagtcgaagacccgacgcacgaccgatataacacacagggccggcgaccggggacaagcgccgcgnagggc

SEQ ID NO: 628497 - DNA, 1809 bp, Homo sapiens
  misc_feature (550)..(550): n is a, c, g, or t
  misc_feature (882)..(882): n is a, c, g, or t
  misc_feature (1336)..(1336): n is a, c, g, or t
  misc_feature (1598)..(1598): n is a, c, g, or t
tttttgttccttgtttttgagaaaaagtcaggggggccatggggtgggtttgaaaccagtcttgggggggtctcgattccttcctttttgggtcttaaattttaatggttattacgggtttcttcgaatgtggtggtggataggggtggggggcatctccattattagttcactccgagggttaagtgggagggtctctctcataactatataggaacctttcgcgcctctcgaaagcgcgagaggggttttctctcaaaatctcgatgtgaaaaaattatattataaatatattatagcgtggcgtgtgtatagagagaaaatgtgatatgtggagcctatacgagagatgtgtatatagcggtgtgtgttcaacagtggtgagcgtgtgataagtgccatctgcgcgggggatattgctcccgagagagataaaccgtgctgcgggggcggccattctcacgggagatatagggcgcgcccgaggagaacacgtgtttgtgtgtgtggcgacgacaacacgacaaaagtgttctacagatttctatancgccgcgcgagaagttgaggaccatactatttgctgatcatcagctgtgggacacatctgcggggaacatcttatgtgccggcgcgatgataaccaggagcttcttggggcggctctaataagaggcggggttatgataaaccgccccttgttgagaagaacataatcaggggggggaggagaaattctccaaccgggaggacaatttatgaggagcgccgctcttcctattataatatgaggtggtggggcgcaaaaattatacacaaggggctcttccccataatattgtggggacatgacgggggacccccatattatggtggtgtcgncaccaaggtggttaggggaggccctataataaccaaaaggccggtgttttaagattatacgccgcgggtgttcttccggcgggtgtaataacgctcttaacgcgaggaaggtggccttcctaacaaggggttggtaaaattgagacgctctctgggggcgataaaaatatttatcccacatggtgggcccccaagtgcttccgagggggcggcccaccacctattaaaacgcggcgggggtcggcaacaacaggctggacaagaccggctgggttggacaatcttcccccataaaaggggccgcccttcatacaagaaaagtggaccttcttcttgtgcgactgcgaaaggattctctccagtttgtgcaacaattaatatggggggtactccccccgcggggggggcacactttctgtttggctgggcaacgaagctcccaacgggcgttatnaacacaattacccccttttgttggaagaacgacgccccccgcgggttgtgggggcggacaaaatatccgcgcgcagcgttacacattacatatcgggcggcacaaccccagcgggagagggcgcttggtagacaaccacatatattttgtgtccccgcctcggctggggtgtgtggtactacagacagcggctcttatattaaattatcccccacgtcgcgtggtgggttgcgaccgaacatctacttattctgggggggcnggggtggttgggcgtccacactaccgcgcgcatgagtatattattaaagtccactcccttctttgttgggagagtgcggcccccctcccttgtgtgtgtgataattctctactgatgcgtcgtcggctgctgcagcaacgacactaccctcccctctttgttatcatctctcccacacgggtgggggtccgctcttcattacgcaccgggg

SEQ ID NO: 628498 - DNA, 202 bp, Homo sapiens
  misc_feature (38)..(38): n is a, c, g, or t
  misc_feature (77)..(77): n is a, c, g, or t
  misc_feature (162)..(162): n is a, c, g, or t
  misc_feature (169)..(169): n is a, c, g, or t
  misc_feature (180)..(180): n is a, c, g, or t
  misc_feature (185)..(185): n is a, c, g, or t
  misc_feature (199)..(199): n is a, c, g, or t
ggcccttatttccttctttattgcagaagagaatgganaatttgacatcattttggtatagaccaagaccaatcttngttgatcaccttctttatgaaatttaaagtcagattgtgggtttgaaaaagttttttgggggattttttttttttggaaataaantctggcncggccccccantcggncaaaaaagcgaaantct

SEQ ID NO: 628499 - DNA, 304 bp, Homo sapiens
gctgatggtgattgtgtgtctgtagtgcactagaagcataacatataggagctgaggtttgtaatgtctatctcgaataggattggagagagtgggtgctgcttctcggcagagtgtgcccttaacaggagagcaggttgtcaccatgcagcggtacagccctgggtctgagacctgagtctggtccgttcgatagcggaactcatcctacctggacttttgctaataacaactgccatccacccttgatgcatctttccaattctccagtttcaccacagaatcctggggcccgagagatgat

SEQ ID NO: 628500 - DNA, 162 bp, Homo sapiens
ggtggacagtggagagcaacacacaaaactaccgttggtgcatggttaaagaccgtggtgattatatagcatcctgggcatttcacatccatgaagtaggaatgtggctctgcacaaggcgttgcttcttgtgttgcctcttctcctcttctggagagggat

SEQ ID NO: 628501 - DNA, 327 bp, Homo sapiens
ttggcagggaaaggaccgggcaaggtgtacaggggcttgaagactggagggaagacctgggctttgacccatacgaaagggggaaccatggagggctgtacgcaaaacagggatgggccctgactcaggtgctcacaggcgtcctctggctgccgtcggtccaataaatgacatacaattatccgtcatgatcccgatattcagataaggtaactgaggctcagggaggtgaagtgatcaggggtttaactgaaagcagaatccacggacacctgcactgctccctggggtctccctgaatctccaccttgtctctcaacctgagtg

SEQ ID NO: 628502 - DNA, 301 bp, Homo sapiens
acattctgcacgtgcatctggagcttaaagtaaaatttaaaaaaaaaaaaaaaaaagggaaaagaaaagtttctgggaatccagaaagcaggtttatttattttagccactttttacctcaggcagggtagatgcttaacaattggttttcaaatgaatgaaagagagcgggtccctttatggaaaatactggccatctctacctctattttcatctggttaaaaggtattcatctggggttacatattacgggggggtcaccggagctacgaattcggaaatctagggtctatagctggt

SEQ ID NO: 628503 - DNA, 1002 bp, Homo sapiens
  misc_feature (12)..(12): n is a, c, g, or t
  misc_feature (468)..(468): n is a, c, g, or t
  misc_feature (586)..(586): n is a, c, g, or t
gttcttcgtgtngcagattagactatattcacataatctcactcactagctctaaccaaagacagataatagctaaaagagaaaagagttagttaactctatatgtttctaatgaactctttattatcgaccttttgtccacattgttactgagacattttgatgtcttctataaattgtggtgcagacttcccacaaagcttgcgcccttcgctatatatctgtttcaagcgcccgtattctgcccaaatttgtagcatcctttcgcctgtatcaaggttcttcaaccgcacgtcccctagtgggtatcttcaaccccccgctctgggtgatcccaagcctcttttgtaaagttcacgaccactgccatgtgtccgaactttgtgttgcctgtattttctatcacaacccctctgctgcctctcccatgttgtcccaaaagaatttggaactgactcttggtgcgcnaaccataaaagcgcccacccttgttccgttgccgccacaaaatgttgttgatatctgcggtaacccccccgtcttcttgtttaaaagcaacttccaccaggcgagtttgtaagtttcnctcatggcaagggacgcacctgtgttcaccctgcacaccagccatgtagtcgccttctttccattgatccttgtagaacttcgaccccaactttagtcgctgccctctttatgaagtaaactccctctccccagatgttctgtttatcaccacagaatctgcagagatttttccaccactgttccgtcggcataacaagacttactaccaccgaccggttacaacatcttctttgttgtacaatcaaaaaagatgagagtctttttatatcttgatgcaaaataggtccccacaccaaccaaaattgccccaagatcataataatggattatctggactcttgaagtcttaaatatacaaatagcggtcaaaaggggtttcacctcctcctctccaaaaaaaaaaccaaaaaacat

SEQ ID NO: 628504 - DNA, 1115 bp, Homo sapiens
  misc_feature (531)..(531): n is a, c, g, or t
  misc_feature (614)..(614): n is a, c, g, or t
  misc_feature (660)..(660): n is a, c, g, or t
  misc_feature (1115)..(1115): n is a, c, g, or t
gcgaaggtcacaggccttgggccagtggtgggacactggagcaggaagtcggcctgtggccggccatgttcatgagggcgcgtcccttggcacccctgtagccgctatgtttcccacgcccgtggcaggcctgagagattatgtttgcggggggtgctttttttgtagcttctgtgttcgccatatttgaaaggggcagacggccatgttcgtgaacggcgcttcccttggtgcacctgtggccgccatgtttgagcgagcgtctctgaattgggatgcatctgacagcaagtgtggcatccgggctgcagttgccgttgtctgctcacatgtgaattaaaaaaacaatctcagcatatgaaatctctaatcgcgtatgaacttggtggttattcctggtgccgtgtggataactgcagcctcaacaccccagtccacaaaccacgtacggaccaactgaggaaggagtaggggttcttgttgttgcagaaaaccctccctcaacttgctctagaagataccagcattcanacttggagtgggcatcagcagcttggaagacacagcagtgggcccctcttagcaggagtgccccatctcatggctccgacgangaccagagggtgatgctgcgtagggctcacggacattggactctangtcagagatgctcaggtgaaggggggctctgatggtgaggacattcagaattaaccgagattggctgggtaacggggggtcacacctgttaatccaagacttgtggaggaagcgaagcacgtggtcacctgaagttcagctgccacttgtggaacccgtctttatagtgataatttggggggggtgggagagtgtttgtgatcacgaaaacgggggggggtgaaggggacaagttgtcaccgttggaggagagtggttggacaccaagtgtcgcgactcgccctggtggacacgaacatctgtgtctcagaggagaaaaagaacgagacaataatgatgctcgggtgatgaagaggaggccgacaaaaaaagagagggctgcggggggacagctggatgtaagaggtggcgcgcagagtctcttctttcttttgtccttcttttttcgctagtgn

SEQ ID NO: 628505 - DNA, 819 bp, Homo sapiens
  misc_feature (496)..(496): n is a, c, g, or t
  misc_feature (542)..(542): n is a, c, g, or t
  misc_feature (573)..(573): n is a, c, g, or t
  misc_feature (805)..(805): n is a, c, g, or t
cataagttggatacttgaatatctgtttgctttcacctaaagcctgaaagaatggtaactctaatacacttatttattttggtctactgtttcaagagttggattactttccagcataattccttctctttggataaagagttctatgattcatattttgcttcaatatgttcacgtctgtagaagcctgggaagcactacatttttttttaataccacaaaaacagtacttacaataaatagcccatttaatggaggaattgtaatggagattcagaagttatcttgagaattctacaacactatgtgactagtctgctttccttcctaacctgtcgcacagcttaaaaattcaggaaatccctcaagggacaacattatctagtatctgacttagttctctgtaactccattctcatcttgatgacggctacctcaaatccttactgcttagcagccataaccctgttttctgtctctctagccctatgagatngctaaaattactgatgccttctccacttcctagcactggccctgtncctcttcgtgactcttgccctgtgccatgtntctgcgatttcccccagggaagagcagctcagagaatgtcagcttaggccaggcatggtagctcatgcctgtaatcccagcactttgagaggctaaggcgagcagatcacctgaggtcaggagttcgagaccagcctggccaacatggtgaaaccccatctctactaaaaattagccaggcatggggggcgggtgcctgtaatcccagctacttgggaggctgaggcagganaatcgtttaacctg

SEQ ID NO: 628506 - DNA, 948 bp, Homo sapiens
gcgaaggtcacaggccttgggccagtggtgggacactggagcaggaagtcggcctgtggccggccatgttcatgagggcgcgtcccttggcacccctgtagccgctatgtttcccacgcccgtggcaggcctgagagattatgtttgcggggggtgctttttttgtagcttctgtgttcgccatatttgaaaggggcagacggccatgttcgtgaacggcgcttcccttggtgcacctgtggccgccatgtttgagcgaggaccccgtggcaggccaggaccgtttctccggtgctatcccagagcatggcgcatccactcattcactcaagggaaaggcctgaaagtaaaattgtatcaacattaggtttggctaatgttgccattaggcaaacctaattttaatgaagccaggaggttctcgtttgggccttgactggacaggtttgagctagaaaccacttgaagtattgatcatccatctgatcatcaagttttttttttttttggagtgggagtctcactctgttgctcacgctggagttgcagtggcacgatctcagtccctgaacctccacctcccgggttctcctgcctcagccttccaagtagctgggattataagcgtgtggccccatgcctggtaacttttaatatttcggttgagatggggttcaccggtggcaggtgggtctcaactcctgacctcaagtgatccgctgctcggcctcccaagtggctgggattaccggggtgagccgcatcccagcttggtcacccaagtttattgacatctatatgtcccgatgaggagaccctgggtcacgagaaatctgccggatctcgagagcgcagcactgagatgatagaccaattcgagaaacaggttgttgggttttgacacaacaccaatagtccgtccaggtgagcctgttggcccggaacaaa

SEQ ID NO: 628507 - DNA, 655 bp, Homo sapiens
  misc_feature (448)..(448): n is a, c, g, or t
  misc_feature (450)..(451): n is a, c, g, or t
  misc_feature (474)..(474): n is a, c, g, or t
  misc_feature (483)..(483): n is a, c, g, or t
  misc_feature (504)..(504): n is a, c, g, or t
gcgaaggtcacaggccttgggccagtggtgggacactggagcaggaagtcggcctgtggccggccatgttcatgagggcgcgtcccttggcacccctgtagccgctatgtttcccacgcccgtggcaggcctgagagattatgtttgcggggggtgctttttttgtagcttctgtgttcgccatatttgaaaggggcagacggccatgttcgtgaacggcgcttcccttggtgcacctgtggccgccatgtttgagcgaggaccccgtggcaggccaggaccgtttctccggtgctatcccagagcatggcgcatccactcattcactcaagcccaccctctcctatcctctcggtccacccgacttagctgggcaaaaataaccctgtggtaggacagccgtctgctgttggaaagtatcgcagctcctcccgtggtcttgcccccncnngttgcaacattgttgccaagggntccctgggncctttgaatgaacggacacangcggagaaggactgtaggctctgagcctgctagggtgcctgagagactcacaggactacccctggggcagttggaagatgcccagaaacttcagggagccaccagcatggggcagagggtctcttctggagttggtggcatcagaatcagg

SEQ ID NO: 628508 - DNA, 420 bp, Homo sapiens
gcgaaggtcacaggccttgggccagtggtgggacactggagcaggaagtcggcctgtggccggccatgttcatgagggcgcgtcccttggcacccctgtagccgctatgtttcccacgcccgtggcaggcctgagagattatgtttgcggggggtgctttttttgtagcttctgtgttcgccatatttgaaaggggcagacggccatgttcgtgaacggcgcttcccttggtgcacctgtggccgccatgtttgagcgaggtgggcaactatgttcttgaggggggagcaaccatggtcttgaggggctcttcccttgaagcctctttggccaccatgtctgagaggggcagacggccatgtttgtaaggggcgcttctcctggtgcccctgtggccgctatgtatgagatgggcacggc

SEQ ID NO: 628509 - DNA, 627 bp, Homo sapiens
tgcggtagctcacacctgtaatcctagcactttgggaggccgaggcaggcagatcacctgaggtcaggagttcgagaccagcctggccagtgtggtaaaaccctgtctctactaaaaatacaaaaatcagttgggcttggtggcacacatttgtgtaatccctaaggctaccttgggagactgaggcgggagaatttgcttgagacgcgcagggaggcaggaggaggtagctgggatgggattcgactgatttgctgtcctgtcgtgacgtgatatgaatcgaatgtatcgtttggcaaataaagaataacaagttaagaaaggaatgattagggggtgacgcacaaattgcttggctaataaactacctttttgccgtgggctcccgccaccgtttaaaatagagagggggaactctcaccaacgttgacacagagctgggtcctcagaactccatggggcgcaagcctactcatttacaaaataaggacctcccaagaagagcatgcgatttacggcgtgcacacacctgagacgtagcgctcatcccggttgcgattcacagctggaggggctgaccccgtccattgaaatctaccatggccggccctacacatatcactccac

SEQ ID NO: 628510 - DNA, 349 bp, Homo sapiens
ctaagctacgatccagatgcagagccgaaacaagaagtgggctcaggtactgactgcattgcagaaagacagccgggaaatggagaagggaagtccgtccctccgtacactgatggctgcagcggagaattcgcactcgtgcaccaattcagagccccactgccgcgtgccctctctgattgtttcagaactgacacccggtgcagcctgagaagaacagacgctcgtttaatgtttggacttcctaactactggatgttgagcctttaacataaacaaacacaataaacttttaagagaattaaaccaaggccttcagccttaagccagctcacgtggagaggatgag

SEQ ID NO: 628511 - DNA, 488 bp, Homo sapiens
tctctagttgatgactcaacccttcactttcttgcaccagctgcctctgcttcccaacccacatgacagaaaatgcggtcaaatcttcatgagcctttcttccaacaacatcagccactcctggaagttctaaaactctatcactagtatggaccagtggtcactctttggacccgtgtgccttggccacaggagcaggatcatctggaacctggcagcactctctgtagtcacacaggagaagtgagaatttccagaagaattgccgtgctgggcagtcagaaccacagatgcccgtgcccagctccagccctgggggaatgacgaccaaatgttgctagaccttcatacctttcaagagaagttggaagtgctgctttttacatgacatctcctgatgttcaacagttggcaaccgatttagttctcaaaaaccaccatattagccaaacaaaataaatgtgtggtcaaattggcctacagacaaa

SEQ ID NO: 628512 - DNA, 145 bp, Homo sapiens
tcgggccgggtgacggtccgctgaattgggttgacctgggctgagctgggttcggctgggctaggctgacctgggctgggctgagctgagctgagctgtacctcacccgtagctgtacctcacccgtagctgtacctcacccgta

SEQ ID NO: 628513 - DNA, 324 bp, Homo sapiens
ggagatctctggatccatgaccatccttttccttcagctcagcaaacttgcatgcaatggtgagccgtgatggtagatccaatagaggggcatagccgcgaagcacacacgcggctgagatggacgcgagcgaatgacgagcatgaatcagagaactcagctagcggcgcaccagcgttgggacaccgaaagcatgcgtacgcgcgtaacggctgggccacatcgatcgtgtacatctagagccggcgcgcccctttgagtgaacgcatccagaacacccagttgtccctgcaactggaggactcgcacaagaccacggacaaa

SEQ ID NO: 628514 - DNA, 785 bp, Homo sapiens
tctctagttgatgactcaacccttcactttcttgcaccagctgcctctgcttcccaacccacatgacagaaaatgcggtcaaatcttcatgagcctttcttccaacaacatcagccactcctggaagttctaaaactctatcactagtatggaccagtggtcactctttggacccgtgtgccttggccacaggagcaggatcatctggaacctggcagcactctctgtagtcacacaggagaagtgagaatttccagaagaattgccgtgctgggcagtcagaaccacagatgcccgtgccagaagctcaccgccacatctctgccctcagtacatctttatcttgcacgacccaagacagacaagagcaagagagagccacttaagcccacctttcccagctttcttctctctccactttaccccttttgcccctgccataaccagcacccacaggacacacagactatgcacccagatgtccacagtgactgggcagggcatgaaattaacgaagcagggtgaaccccaggcaacagggcctggtggggactgcagtgagctttgtctgcacccttcagaggaagtagctgctgcccagctccagccctgggggaatgacgaccaaatgttgctagaccttcatacctttcaagagaagttggaagtgctgctttttacatgacatctcctgatgttcaacagttggcaaccgatttagttctcaaaaaccaccatattagccaaacaaaataaatgtgtggtcaaattggcctacagacaaa

SEQ ID NO: 628515 - DNA, 298 bp, Homo sapiens
gtgaacatatttttgaaaagaaacaaaattgacaatcctttagccaaactagaaaacagagaaaaagcaaatacaatcagaaatgaaaaaggagacattacaaccaatactgtagaaatcaaaggatcattagtggctattatgaatgagtatatgccaattgattggattatttagaaaaatgagataaattcctagacacatacaacctaccaaaattgaagaaggaggaaattcaaaacctgaacatacccataacaaataccaagatctaaagcataatagaaagaatcctagc

SEQ ID NO: 628516 - DNA, 190 bp, Homo sapiens
cggcgcgctcagcgcaatagcacgcggcagcgactcggtgaaacgcttgtgcgtctggaagcccaccacgcgggcctccggcagttccttgccaccgggttcgaagaacatgatccccggcgggccgaacaggcggaagcgcttgagcagcgcgcgatcgtcggcattgttggcggtcacgttggcctgc

SEQ ID NO: 628517 - DNA, 575 bp, Homo sapiens
ttcgcaaatacagcagctatccaagggacgtgtgtacatatgtaaatgagaatagagacgtgtcaacagatgcattcatttctcttgtgaatgtgtattgtttctattttgcgaaacaaaacaaaacaaaaaaaaaagctgggaactccatcacggggaaaaactagatccggtgggttatagcattggtgagttctccacgtcggtctctctcgctcatgtaatatactcggaccctgagtgggaaaggggttttggttctggtttttattttacctacatgtactatttagcttcagtggtactagtcctggccaccggtgtatttttaggggtggctagggaaataatggaaaagaaagggggatttcagaagaaaatggtaaccaaattcatacttggtataattttggatatcatgatcacaggtgattcacaggtacacacataaacacacccaccagtgcagccggaagtaactcccagagaaaccatcatcgtcttggtacatcgtatgtacaatgcaatcatttcatactttaaagtggtcaaagaaactaattgtgatttctagt

SEQ ID NO: 628518 - DNA, 180 bp, Homo sapiens
atcccccatcatccccttaatcacctgctcgagttgccactcagttctgacttcagggtctgggcatctcccatggcattgaatcctgaagcagctttgccagaccctccttgggttgccatggccatgactctaggccaagatcagagttcagccacccaagcagaagttcttcgaggc

SEQ ID NO: 628519 - DNA, 179 bp, Homo sapiens
ctacccgatcgctttctaatctatcagtgggccacatgtgtgttagatgtattatcctagatctcttttcctgaactctagaagtatgttactggctcttaaaagatttcacaaaaatacgctttgaggagaatcacagcgtttctgtgattagatatctcacaaggcacttacatgca

SEQ ID NO: 628520 - DNA, 1498 bp, Homo sapiens
  misc_feature (1073)..(1073): n is a, c, g, or t
tggaaacggagtttcactccggttggtccaggatggagtgcaagggcgcaatctcggctcaccacaacctcgcgcctcccagggttcaagcgcaattctcctggcgttatagccctcccgagtatgctgggagattacagggccttgcaccaccacggcccgggctaaatttggtattttatatgtaagaagacgggggtttctccatggtgagaggctgggtctcagaactcctggaccctcaggtggatccggcccggtcttcgggcctcccaaatgtgctgggagattacagggcgggagacgccaccggcgcgccgggcctgagaaggtgattctacatctttaggtgaatcacagaaaagggtgcggctcaaatatttcacaaagatgtgggatatggaaagcacattgggtgctaagtttatggagcaagtggcattatggtgagggggagaagattaatttttgggggcacactggttatatttctccaacgggggaaaaaaaaaagtataaggtgaaacacattcccagtgaaaaagaagtgtccccgcggggtcaaccccagagccttttcgtggtgggacggcgcccaaattcagcggggacaacacgtgggggctctacaaaaaacccctttacagaaggcctgggggggggatatactagaagcgcgcacaccacccaagataagggggcgtttaaaactctttaaaagtctcccccaagtgtggcacactgtgggccaacacacacgcagtcaagtcattacaacacggcgcaatcctatggggaaataggaactttaaaaaccccccgggtggccctccaggacatatctcttctattcccttcgggaaaaaaacttacaacggggttttccccattttgtgggggaccaaatatattgttcattgtcccacaagtctcacggagatcttctagatgatcatccaattccataacgagtcttacaaagaaaccgcctgtggtggggggggggtgtgatacaccaccccctgcttattagtcggagatgaagacatgcatattgcaacacgacaatcatnttgttgtgagtagacaagcgggccgcagtgatgatgcacccgggaagaacagcggcacggagagaaacacacctgaacacaggggggggggaacaaacagggggggggcccctcttcgataaaaccacccaaacagcgcccccctgagattggagtgtaaggagaaacaccccccccgcgggtgaaaacccacaccggaggaagcaccacagacggagaaagaccaaaaaaacgcgctccccgaaaaagagagggcgacgcagcgagaacaagagaaggaacgacgaagcaacacaacaccaagaaggagcgcaggaagcacaaccacatgtgagagacaacagaacgagcaagcaacagaaaacgacgacgcaacagaatgaactaaaccacgcgaacggaacaaaagagacaacgatggagaa

SEQ ID NO: 628521 - DNA, 212 bp, Homo sapiens
tgccaaaaggaatcgcactcagcaaggagtgtagaccggtcgacgggggccaagggccaatggcaaccagggtcaccgcgatattgtagcacggttggggggggggaaaagagcaatagaacgggggccgaaggggacgaagggaaaataaccaaggtcttacaacggaatataattggttgcctaaaggaagatccaggtgcagacaagtg

SEQ ID NO: 628522 - DNA, 280 bp, Homo sapiens
aataggaaagacagaaataatgtttcttttcttcttttattattataataatgagttcttgtcttattaatcatcaaagccaatatatgaatttccttttgaatatcattatgaagttaagaagtttctttatgaatattattatgatgttaacatatatctatatctgtatatctatatcaagatatatattttgatctattgctgtcatcttttattacactatttgtttcacgtttggcaaatgatgttaggaaataaacttttttttagaaaaaat

SEQ ID NO: 628523 - DNA, 202 bp, Homo sapiens
ctttaaatggacagccctctcctgttctcctggacggacccgggctctttcccatcctgaggtcgtctcgcattgctcggttctcgttagtccctatcctacgctctccctataaccatcctctggtctcagcttcaatactgcaagctccctgcagtccactcgaatgccaggaggaacacagtctagggcacttaccacg

SEQ ID NO: 628524 - DNA, 131 bp, Homo sapiens
tagaggatccctccgattctattgatcgtccccccgaggagagtctacctttccagaatgcagctccctgaatggagtttggagcggagcatgagatgtggtctcggtgcagagctcccaagctggctccg

SEQ ID NO: 628525 - DNA, 539 bp, Homo sapiens
  misc_feature (15)..(15): n is a, c, g, or t
  misc_feature (51)..(51): n is a, c, g, or t
  misc_feature (121)..(121): n is a, c, g, or t
  misc_feature (243)..(243): n is a, c, g, or t
  misc_feature (275)..(275): n is a, c, g, or t
  misc_feature (476)..(476): n is a, c, g, or t
  misc_feature (509)..(509): n is a, c, g, or t
ggccccggcgagcancaggtggcttcccgctgagccacaacctcacggacntccacgaggcgctggagaccacacaatacctgaactccttctcgcacgtgggcgcaggcgtggtgcaccnatcaatgccatcgtgcgcagccagcgtggcggccccggagcacgcagactgtccttcgtgttcctcacggacggcgtcacgggcaacgacagtctgcacgagtcggcgcactccatgccaanagatacgtggtacccaccgtgctggccttggnagcgacgtggacatggacgtgctcaccacgctcagcctgggtgaccgcgccgccgtgttccacgagaaggactatgacagcctggcgcaacccggcttcttcgaccgcttcatccgctggatctgctaagcgccgccgcccgggccccgcagtcgagggtcgtgagcccaccccgtccatggtgctaagcgggcccgggtnccacacggccagcaccgtgctcactcggacgangccctgggcctgcacctatccagctcctcc

SEQ ID NO: 628526 - DNA, 397 bp, Homo sapiens
tgagatggaatatcgctctgtcacccaggctggagtgcagtggcacgatctcggctcactgtagctccacctcccaggttcaggcaattctcgcgcctcagcctcccaaaatgctgggattatagcctggctaatttttgtatttttagtagagacggggttttactatgttggtgaggctggtctcgaacctcctgacctcagttgatctacctgccttggcctcccaaagtgctgggattacagacgtgagccactgcacctggccgcatatatatattttatttttttaagatgaagtcccaccacgccctacccagggtacctttaggtatcatgtcacgttgagggaagaattcgtttttattctgaattctaccagtttcacgggtaaaat

SEQ ID NO: 628527 - DNA, 535 bp, Homo sapiens
aacttagtcaatctcccaaaatagaaaagaatgagaaaaaacagtaacaaaacttcagttaaagattacaggaaaaaagtacaaagaatgcaagtgggtggttgggtagttttaacttaccagaagatactatcagagcatattaaaaaaaaaacagaagtattacttaggcttaaaaatgaaggaaattctgacataatgctacatgggtgaaccttgaggacattatgctaagtgaaataaggcaatctcaaaaagacaaataagtgctgtatgattatatgagatgcttggagtggtcgaaattatagagacaaagcttccagaggcgaagggaagggagcaatggggagtcagagtttaatggatacagaatttgttttacacaatggaaggagttttggaaacgggtggtggtgatggttacacaatatgaatgtattcggtaccactgaactgtatacttaaaaatggttaacgtggtaaattttgtgttccgtgtattttgccacaataaaaaaataaaacactaaaa

SEQ ID NO: 628528 - DNA, 430 bp, Homo sapiens
  misc_feature (428)..(429): n is a, c, g, or t
cgcaattgtcacagagatatccgccaagtccacgcatactcgtgcgctcccatctattcgcaagttggtcacggtggttccccgctatactttgactggctttcacctgctctttctggtattgtgtctcaattatgtctcactcatgggggtcatttctgtcagtggccagtttgtgcagttccccgctcattgacttattcacatttttttccatatcttatgctacactccgattgcattctgcccgctctccctgtcctcatagtctggtttctcgatatcctaaaggcacgattcggccacctcgttggttctgcagcttcatcgggcttcgagctcatcttctgtatcttagtcctagctttttcctgtgttcacagccctggctaccctggcggctcgtgatggaaacccccttgaggggnnt

SEQ ID NO: 628529 - DNA, 219 bp, Homo sapiens
tggccgagaaccgccattcctaggaggtttatcgagtgacatgttgagtgttctatatctcagtgcagcttatgtcatgaggcaactcctgcaaaggcaatcgtgttagattagggaagttacttacagtatgtgtgttataacctcaaagttgatgtattgtggccctctggcaggttggtttttagcatgcttcatttaagtaaaaactgaagaata

SEQ ID NO: 628530 - DNA, 85 bp, Homo sapiens
attttttcccccccccccccccccccccctgggctttattttggtaatggtggggggggatggataaataaaggggatcttttga

SEQ ID NO: 628531 - DNA, 148 bp, Homo sapiens
tcctttcactaatgtatctcccttcctactgagcatgaggttttaacgtttgtttcaattccccccactttcttgatcagtgattctcaaccatgtaggaattaatgacaccaattctgtatcaccactgcaaccaagaaagtgacag

SEQ ID NO: 628532 - DNA, 456 bp, Homo sapiens
  misc_feature (134)..(134): n is a, c, g, or t
catgttctcatttatttatgggatctaaaaataaaatcaattgacctcatgggcatacagagtagaagaatggttaccagtggctggtaagggtactgacggttgcagggggaggtggggatggttaatgggtncaaaaacaaattagataaaaagaatgatttaatatctgatagcacaattgagtgactataatcaataataacttacttgtatatttttaaatgatctaaagaatgtaattggattatctgtaattcaaaggaaaaatgcttgaggggatggattcctcattctccatgatacacgtatttcacattgcttgcctgtgtcaaaacatctcacataccccgtaaatatttacatgttctatgtacccacaaaattgttacaaaattaattgagacatttttatttaagaacttgagaacttttctaaataaaggtttttccatg

SEQ ID NO: 628533 - DNA, 140 bp, Homo sapiens
tgaatctgattagtggatcacgtatctacttccctgtcgcgtcaattcactatttccccagaagcttggggcagagtgtcctagcaggagatgatgaattctcgtggctctcgtgccttctcagagaaataaatgctttg

SEQ ID NO: 628534 - DNA, 529 bp, Homo sapiens
  misc_feature (359)..(359): n is a, c, g, or t
ctcactgcaagctccatctcccggtttcaagagattatcatgcctcagcctccaagtagctgggactacaggtgtgcaccaccacacccagctaatttttttttttagttgagatgggagtttcaccatgtttggccaggctggtctctaactccgtgacctcaaggtgatccgccgtgccttcagccttcccaaaggtgctgggatttacagggtttgagccaccagtgcctggccaattagtttatttccaatgtgcatctatttaattgtgattcttttcatatttgacaacccttttccaattattctcttgtgcttccaaatgtggaatttatgttttttcccaagtttcccanattgcccaaggttagaccactgggcaaatttattatcaaggttctttggacatcttggaacttcagtatcagaggatggagttcttctctcattggccttgagcaagggcttataaccagagccacattaagaactcagatcatgctccctaattgaggacacttagcaa

SEQ ID NO: 628535 - DNA, 263 bp, Homo sapiens
actggcacaggagaggagaggggcacagcgagtgtgtggcccactttggccccccatcgcctcccaacaggaggtggacctggagctggaagaacaggaactccttattctacttagaggacaggttcaaagtgcagaaatttctcttatacaaatcctcttccctccatgctctgccccttgctgaagaccagccccctgcgcaggatgtccgtgcagctgtggcaagacaaggtcaaggggaagggcgtaaggccaaagca

SEQ ID NO: 628536 - DNA, 336 bp, Homo sapiens
caaggattttaggtattctatggcagaaaatggagatgaacaccaaatagaaggccgggcacagtggctcacgcttgtaatcccaacactttgggagaccaaggtgggtgatcacctgaggtcaggagtttgagaccagcctggccaacttagtgaaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctca

SEQ ID NO: 628537 - DNA, 1343 bp, Homo sapiens
ggtactgctgagtgtgcctgtggcctccagtcttgtccctgtgatgtgcctctgagtgaagtggatgcttgatgccctgcctgtgctcccagcctggagcagaaagagacagtgagctgacatgtatgcccttgtgtgcatgccgtgtgctgttgcttgtgcttgtgtgtgctggtgctgacgcgtgtgttggccactgtgtacaagtgcagtgtgcagtctgcctgtgcaccgtgcttggccgtgtacgggtgcttggacttgggccggcctacgagatttgccagacttcctacacttgagtgagtgcttgtgccgcataaccatacattgccctggcaacgaagggctcccattggactctgtaccttgcaatcacattcttcaaccctttgaatttaacatgggttgaacttccctttgcaggccttccgcaagggaagcggactgactttgaggggaagaccgccagaggatcccccagtatgtgtgcacctttctcagaaaataagtgcaacgacggttacgcgcagcatgacaaagcaagcccagtacttgagcagcaaagagcgcgcacacaaggctggccgttgggcatgacactggacaaccttgcgagttgcgaagttacccgttgactagggtgtgacaaacacaacgcatggtacaacgaggataatcacatggcgttgatgtaccccaaggcaatttagcaatagtggccacaaggcctcgaacaagacgatagacacccaaagcagccagaattcacgcaggcagtttggcgcgcttttacgacggctgacattcggggccccactcggtggcccatatatcacacaatcagccgagagaacaggaagacccccagacgacctttttgggcaattagttggcccgattctacctgagtggcgctttcggcatgccacaaagttccaactatgagcaacgacgttagcgatgaatgagttccgtcactggtatgcaacctccggcacactcaagcggccacgactttgtagggttagggccgtcaggttctgatgaagcacgcagggcagtgtgcaacacaagattaaccacaccgcatatggcaccatacgggacaacagccacgaacacctatggcgattaagggataggaggacaacgtggaaaatcatcacgggactaaataaaacccggtaatagcccgtatgaggataacagcaatatgtcgttcagtgctcgtgaaagacgtgggggtacgaccgcctgtggaaactaccctgtgcgcccacccacacagttaccccgattggccataaggcggaccacgaggggagctcattcacacgcag

SEQ ID NO: 628538 - DNA, 1172 bp, Homo sapiens
ggtttgccatgagtataaaattgtccctatgcacgccccatgcatggtgagctgtccgtggggctctctgagtgtcatgcttaggagtgcccagaacgagtattcctcgctagttggtcctgggccagctgctgctgtcgcgtatccgagccctgacggagagcgtcgctgagacgacgtgctctcgttgtggacgcattctctcctcgagagcttgtctcctgtactacgtgtgatgccgtccatcttctgcgcgcactctgggcatggcatggtcctgcgcttgtatgcgagctatcaggaatattcatccccatggacgtgtgtacgaagtaacgttaccctcgacctcattcgagtttttgggttcgatatcgttatcctctatggctatcatcggtcataggtcttgatcgaaaggtggccaacgtcgccatgacatctcgcgaaagcacgaggaggatcccttcaacattacgatcgagccttgcacttgcatgtgttcgtatagaccattgagttcggttgtcccccatgatctcagcgaagatccccaagcgctttacatggtctcgtttacaagcgtataacgggggaccattcgacggtggtaacgaatgcttcaaaagaccatgaaagagtcgccactttgagaaatgttcacctaccaagctttcacggctgccttaaaagcgacttatgacataccatgcgaaggcggacggattttctatgtggctttactccggggttgttgcgcagaggggaacctgtgggttggacccttgtcccaaggaggtcagcacgtgtggttcccaccccgaagttccgagtggtgccatggggtcctcctgtttggcgaaccctgttgcccagcgagggtgcccgtccgtgttgggccttgcacggggtagactccgtcaggggtcatccaaggctgccgaccttctgagtttcccagagggcttcagttagcgccccttttgagagctgttcgtgagaatcgcttcggagggtggccacttgcgcggtagccgtgcgtgagcgtggcactaattctgtcgattgcaagtggtggaactcacgggataaatctgaaacttggaaattctgcgagacccccttttttcacccaaggctcgatttccagaaaccctgttggaaaaccccac

SEQ ID NO: 628539 - DNA, 445 bp, Homo sapiens
aggcgtggcggcgcgggctgcaatcgcaggcattcggcagactgaggcaggagaatcaggcagggaggttgcagtgagccgagatggcagcagtacagtccagcttcggctccgcatgagagggagaccgtggggagacggagacggagacggagacggagacggagacggagacggagagggagactttttaaagaaactgccatttgtattgatataatatggtggaggcccaggttccccacgtggtccccgctgatcttgttactggtctgcagggatgaaattcctggataccctacttggctttctgtctccaccttggaaggggtattgagtgcttaattacagctttgagaggttggaaatctaggctccccacttggcctttgctagaacgggtaggttttaaaccacagtattttcttggtgtttggctggggta

SEQ ID NO: 628540 - DNA, 449 bp, Homo sapiens
  misc_feature (220)..(220): n is a, c, g, or t
aaaggcagaggatgaagctgtcatgttttttttttttccttcaaaagaaaataaattatattttgacatacaatcagagcccatttcaaatacacagtgaagcatttctcatgaattcaagcaatgtgatccgattgccttttagcaatactttttttttttaatccagtcatgactcatgttttatcattatcactgtggatttgatgatgtgaaaganaataatggtgtgtttttttacaagcattataatatccactcacacatactggatttggatggatcagtgctttatcttacacagtcccgaaaaagaagagcacataatgtagccaatgtaataatgctccctcaaatgaatggttcacattccctaaatacatgtggtcagtgaaacatacaagagcagcattgtatgttgaataaaagttgttgttttttttatatca

SEQ ID NO: 628541 - DNA, 444 bp, Homo sapiens
ccgacgtaacgtaaacgaggcgagaaagctgtagaccgagagacgcctagagcgaagttgaacggtggaggggacctgtgtggaccggcttgatctgtgctgcggacacgctgctaccaatgcggtagtttcagcaaggaagtggaggagcggagtagagaacggccctcccagcctgaggggctgcgcaagggttttaggcctcaacggaggatcgggacctgtgggcggggatgctgtgaagcggagaaaggtggccctacccccagtgagcccccatgaaggggggctctctcttgaggggggagttagagaagaaatccaaggctatcattgagggaaatatctccattcttcatgacgtgaaaggaaggcagtccagtgcgtagaggagctgggctcaccctccttgctcttcatctttctacggcttccggcggtccg

SEQ ID NO: 628542 - DNA, 968 bp, Homo sapiens
gactgcgcggcgttgggcgtgcagagtgcgccagatcggcggacgaggggccccgggaggttgctggactgagacatgagcctccaaactggtgtggttgggcatcggtagacacatacgggggacttgggtgtgcgcccacagatggtttggcgcctgacagatgagccaggagcagctcgctaagtccgccaccatggtgaaattgctagtggccagaaatcctgtgcatggtgggcgtgtgcttcttcgatgcgtgctcggctcgcctgctccccgtgaagatcatctgatgacagatttgagaaggcgcatcgctcgaagaaagatcctctctcgtcgtgcaacaccgtttggaggaggggtgtctctggccacgtgcttcaacgctctgctgggccgctgtgagggaacaagctccagaaggtcctgagcctcggccacatcagcaccgactacccgctggccgaaaccatcctcctgctgggcttcttcatgaccagtcattcctggagcagctggatcctgaccttccgcaaggagaagccgtccttcatcgagctggagaccttcaaacgccggagtcggacgtgggcagcagactctggagtatgagagccccgttcatgggtgggcgctgcggggccacgcgctgtacgtggagccccacgggcacggcccagtctgagcgtgcagggcctctcgctgcgccagcccgtgcgcctgctcaggctggccttcgcgctgtcggccactcgggtctttgagggcctggcctggggcctgcaggaggagggggagaaaagtggtgaacctgtacgtgggggtggccgtccacgagacactggtggcgtggccctgggcatcagcatggccggagtgccatgccctgcgggacggcggcaagcttggggtcaccgtgagcggcatgatcccctgggacattcggcctgggctgggcatcgaac

SEQ ID NO: 628543 - DNA, 179 bp, Homo sapiens
catcctacccaggatcatctacatccaagataagatgacaggcacactcgagaaccagttcacctgcccattctgcaaccacgagaaatcctgtgatgtgaaaatggaccgtgcccgcaacacctggagtcatctcttgtaccggtggggtacggaggtgggtaccgacgctcgaactt

SEQ ID NO: 628544 - DNA, 437 bp, Homo sapiens
ggatcgtgtgatagtaaactaatcaggtcaggatcgtgtgatatgtaaactaataaggtcaggttcgtgtgatatgtaaactagtcaggtcaggatcgtgtgatagataaactaatcaggtcagggtcgtgtgatagtaaactattcaggtcagggtcgtgtgatatgaaactagtcaggtcagggtcgtgtgattgtaaccctagtcaggtcaggatcgtgtgattgtaacctagtcaggtcaggatcgtgtgattgtaaccctagtcaggtcagggtcgtgtgcttgtaccctagtcaggtcagggtcgtgtgattgtaacctagtcaggtcagggtcgtgtgattgtacctctatcaggtcagggtcgtgtgattgtaccctagtcaggtcaggatcgtgtgattgtaccctagtcaggtcaggctcgtgtgat

SEQ ID NO: 628545 - DNA, 1576 bp, Homo sapiens
  misc_feature (721)..(721): n is a, c, g, or t
  misc_feature (1304)..(1304): n is a, c, g, or t
tggttaaaaaaaatttttgacaattcaaaaagggggtttcaggatgtggtgtggtgtgattgcaaaagatgtggaagccatgtggggtgtgggggcttgtcaggggtgtgggggcagatagtgtgttttcctttcacccccaccctgtggtgtgttccttctcctgtgaaggacagagggtcacatttccaaagatgtgggaagaagtcttttcttacgggtgtttgtgtttcaatgtgttagggaggagaattgtttatattcttcattcgaggcgagcttcacttatatttgtgtgactcctcaagaggcgattcgcttgcacattcattgtgagcgattctgtgtgcgcattcattctctctcatttcagagaccacaatatgtgttgtattacgccaagcccctctgtgtgtgtgtgcacaaacccgggcctgtgcttctgtgcgccccacccggatgtgcacgggtttagggttctcaagaatctccctcgaggcacatgtgctccatataaatttacaagagcaatgtgttttacacgccggcctctcgaatgtgtctccccatgtgcccttcggggcccaaaatctccgtgtttgtgggtatacgccccaacaaaaaaatcttccgtctcgttgtgaaaaacatttctttttacaactgtgggcgtgtatataccccggagagaacagaggcctcttccttcctctcgctgtgngggggccaatttcccccagcgggtgtgcgtattgtgcgccacaatggtgtgcctgcgggggaaaaacgtcttcccttgggcctccccactattatgtatacgctgtgggggccccaacgcggccaaatgtggcacacccgggtttggccccaagaccttttccaacacaagggattataccacccacaaccctggtggtgtttttgaaaacctcttccaaggggggaccttctctcgacaggaaggcgtgtcaacaagaggaaggccttcccacggggtcgagtccttatcctccggattttggtcaccttcacacgctttttaccagcgcttctccagtctcaacccgtgggtcgttgcaaaccacccacatgtgacgcgggtggctcaacaacttatttcggggttcattcacatttcattccccccggaacagctctcttccatgtggggactcctttggtcattgtaacccttttgtccggggacagcatctggggggacccggagtctcccttctttcgcggcccccaagaggtgatggcccctttggaacacatctctttgaggcccattaggtccncttccgcgtgagggcgggtgatctgcgcgcaacaccaattctcctctgcgaccacaatccccagaccgcattgtttatccctcttgctcacgcatccttcatcacaactacatcagctaaaactaaacgcagacggcgcgcgcctcaaaacatcactccgcggggcgcccgacttcctactccacacagctcttctgtccaaacgcgcccccaatcagcacattattatacaaagacacgccggcgtaactcatcacgcaggacaaactgta

SEQ ID NO: 628546 - DNA, 588 bp, Homo sapiens
ccccccctcttccggggacccggtggttaagaagcctccgcgggacactctacggtagtagttgcacattccgtgaccgatggccccttttcatcatctccgcggcagcgtctttgggttgtatactcgcttactgccgagattataagtgtgtgctccgcccccgcccccgcatgtgcgccccagtgtgacagtgtgcgtctcgcccctgagtgttgaggacggcttctctatggcggcctcctgttcatcgtttcctccgcgcattgcctcttattatctccccccacgaacaggcccactttatttactcgcggcccccctttttcgcacgatcgccatggtgcaccttccttctttgacattaacactattgtgccgcccacgctttttccactggagcaatttcgcacaccggcagaattgtcgcctctcacaactcttcgaagcccccttttttctttccgtcccccctcttgtaaaactcaccactctgcgcatatcttgccaacattaacaactaatatatatctcatacaaaaaagccacctaccaacccaaaaaaaatattccccccccaaaaaaaca

SEQ ID NO: 628547 - DNA, 870 bp, Homo sapiens
ttcccaggggcgcctccgtggcacctttggaggcgtctcctttggggtgtgcacccccccccccggcccttgtgttgcgcccccacacgtgtcttctcggggggggcgcctcccccaacagaaattgcggggggggttctctccttgcttccagacgccgtggtggtcccgcccgtgttggttttgttgcgcacccccccttctccctcccggccgcgcgtgcgattcttttttcgtcaacaagtgtgggttgtgaaagccccccctctcggttggtggcgcggatacgactgtggggagaaacacgtgtcccagcctctgtccccccgtggggttgccccacccgtcgcactcactctcgtgggcgggtggggatcccctttcttgtgggctagaggttgttattctacgacgcacgccctcctccgattagttgtgtcgcccggcagtccccctccctcctcccgcgcggtgggggggagcgactacttcttgcacccccactcgctggataattgtgcgcccgccgtttgttttttatcatatattgtgttctctctttacacaaacacataaacataaattagatttgtgtggtttttctctcatgtattgtttctcgcaccccccctctgagccgcccccgcgatcatatgatttaaataatattatgcaaggagggaagaaatatatattcttcccccccacacacgtgggggccctctcctccccctccatcgataatggctgctggcgtcggtgagaggaaatgaaaaaatcttctcttcttttctcccccctttttttggttttttttttcccctctttttttttttttttttcctcaaaaaagggatttttctcctctta

SEQ ID NO: 628548 - DNA, 815 bp, Homo sapiens
agcgggatggacccgagtgcacgtgtggagaagcggcggcacaagcgcggcgagcgggagacactcccgcgcctccatccatgactctagccctcactcgactctcgcgggccttcgttgtctcgctcagcctccctgcccaggctacggaggccggacttgcggggttgacgtggcccgcagcgtaacgggtgcgtgagacctaacgggcggcgactacgacgggcgttgcactatcgcgtgcgctaagcgaccaggcctcaagcagcgtcggcggacagactgaatacggtccggcatcgacgtctgggcaccatgtgagcacccacaacaatagttatacacagttgaatacatattgaatcacgcgtcatactttccaggtcagctactaatgacagagttctacacaggatgtgcgtggatggttgggcgagctagcagaaacttgccgtatttcaatggatcttgctgtaaggtagcagtatgctgtaagggtggatcattcacagaactcagaaggagacttctacatcatgacactaggatgtctggcaccttaccgacaggctaggacataggaactacacatgttaaactcatgtcttaaacatctgtgagaaagatggtactttagacaagcatttatctgcatgtccagatcacggaatgagtcggcaattgacttctacaggaagttaggctttgcagcattatggacgacaagaagaactactataagaggatagagcccgcaagatgctcatgtgctgcgagaaaaaactcaaagttcgttctggtcagaatgcgactgg

SEQ ID NO: 628549 - DNA, 865 bp, Homo sapiens
  misc_feature (17)..(17): n is a, c, g, or t
  misc_feature (102)..(102): n is a, c, g, or t
  misc_feature (111)..(112): n is a, c, g, or t
  misc_feature (148)..(148): n is a, c, g, or t
  misc_feature (155)..(155): n is a, c, g, or t
  misc_feature (160)..(160): n is a, c, g, or t
  misc_feature (166)..(166): n is a, c, g, or t
  misc_feature (195)..(195): n is a, c, g, or t
  misc_feature (197)..(199): n is a, c, g, or t
  misc_feature (202)..(203): n is a, c, g, or t
  misc_feature (216)..(216): n is a, c, g, or t
  misc_feature (219)..(219): n is a, c, g, or t
  misc_feature (229)..(229): n is a, c, g, or t
  misc_feature (232)..(232): n is a, c, g, or t
  misc_feature (241)..(242): n is a, c, g, or t
  misc_feature (254)..(254): n is a, c, g, or t
  misc_feature (271)..(271): n is a, c, g, or t
  misc_feature (288)..(289): n is a, c, g, or t
  misc_feature (294)..(294): n is a, c, g, or t
  misc_feature (298)..(300): n is a, c, g, or t
  misc_feature (303)..(303): n is a, c, g, or t
  misc_feature (306)..(307): n is a, c, g, or t
  misc_feature (319)..(319): n is a, c, g, or t
  misc_feature (325)..(325): n is a, c, g, or t
  misc_feature (337)..(337): n is a, c, g, or t
  misc_feature (339)..(339): n is a, c, g, or t
  misc_feature (349)..(349): n is a, c, g, or t
  misc_feature (372)..(372): n is a, c, g, or t
  misc_feature (400)..(400): n is a, c, g, or t
  misc_feature (430)..(430): n is a, c, g, or t
  misc_feature (485)..(485): n is a, c, g, or t
  misc_feature (589)..(589): n is a, c, g, or t
attacaaaattatcagnagcagtcttaagcatttcaacaatgctgatagattccactttgctaacacaaacaaggctattataccatgttcgaaaagcaagncttgttccnngacggcctatcattatacatctgcctcactgctcancacccgnttgtnactgtntcttcttccatctcttcttcaccatcatnannnggnnctgatctgggttntcngggaggggtntgngcagagtgnngcaaccccttcngcgtctccacttcagcnagagttgaagcatttgnnatggnattnnngantgnntctacatccccnggaganggcccacctttntntttgtgagtngggaaaccagcacctggattaanagtggggagggggaagaacataactgtnagacctagaccaacagaagttgcttctctnttactttcaaaagcttttgaaagtaattcaaccagtgtagtatcttatctttgtnaacaaactgatacaagaactctctccttcagaaacaccatccagttcatcttcctatatagaaaataggatgtacatggtatcacatgaagactgactactganatatttgctctgctaagctggtagaaatttcttgtgatgtgtggaccattgatgtacatggactataagcactcaaatttaataccacattaatatgtcagagtttttggttaattttgtaggagacgaactgccagacagatcagatcatgtttctgaaggtgaagtagagttaagttggatatccgtgtcttacgttttgcttctcctggcaatatcctttgcaagctgtgcaccccgtttgcccttgaacattttctctgcttcctgacgctc

SEQ ID NO: 628550 - DNA, 1514 bp, Homo sapiens
ggaatggcggtggctgcagcagcagcggctggtggaaaccctaaagtccgagtccggactacgagtgcgtggcctcctaatcctggatcctagtcctgagctgtgtcttgtgtgcagagtgtgacgtgtccctggacgctgatgaccctgaactggctggcgtgcagctggagctgggcgtggagcctgctggtggtgtggccatgtgagctgctgagctgcactgtctgggggcaggcacaccctgtgtggcccctgcaccctgccctgactgcacactgcctgcaggcgattgcctgggatggactgatgctgcgaaccatggcatggcaggcagcgtgaaaccctgaggtggcaccatgactgtggtggcacagatgagaccaggggaacgtgggaaccacagagggtcccgagtgactaggaccttgaggcccgcaggacatccagagggcactcggcatcaggactcaagaggtggcaagcagagcctgcagaaccgaggaagacgtaaacaacagggttgactgcatggctgcgagaggagctgcacccgggccgatgggcgacaaggacagcggccacatgtgacagcggccaatcattcagcgcggaggaggatgagacgggaccgtgggcccgctgaacgccaaggacggcaaggcaaggggcgacagcatagtgactccgcgtacgcaataaggatacggatggagaccggcggagtcacaagcatgcgcaatacagatccaagtggctcataccggaacgacatacggggagaacagcagggcacgcggagtgagaccgcactggagtttggccccgggccccaccttgacattgggcgcaccggcacgacgcatgcccataactggtgccaacgaggacggcaacgatcaggatgaacacggaacagacaggcggacaacggcgtcaccagcaggaaagaggaggacgagcaaggaacacatggcagaggatcccaagagcaccaggcccggcgcgctgaagaacggagcgaagaaccagacgtagagtggggtggcccccagttcaacttcccatcagagagggacgagcaaacgacagaagcagagaccaaggggcaggcagcgcccaacagtgcacgcggcacagcgggacgggaaattgacgaaggaccgggcgaccctcgagcacggacggggaacaattgagaagcgcgcacacagacacactgtgcagagaaactaacgagagcagacgtgaagccaacgaagtagccgcacggagcagcgtgacagagaagagttagagagcagaccagaaaagccatgcggcacgagcaccgaccacaggacacgccaacggagaaggagacaacaagcaccgcgggagagagaaaagacggagtaagacgcgagcgagacgagaggcagagagacaatgaagaaaagaaagagagagacgacagcgacaaccagagacacgaacacagcgaagatagacacacatcgcacgcggacgacgcg

SEQ ID NO: 628551 - DNA, 167 bp, Homo sapiens
  misc_feature (12)..(12): n is a, c, g, or t
  misc_feature (34)..(34): n is a, c, g, or t
  misc_feature (52)..(52): n is a, c, g, or t
  misc_feature (89)..(89): n is a, c, g, or t
  misc_feature (94)..(94): n is a, c, g, or t
  misc_feature (98)..(98): n is a, c, g, or t
  misc_feature (127)..(127): n is a, c, g, or t
  misc_feature (131)..(131): n is a, c, g, or t
  misc_feature (137)..(137): n is a, c, g, or t
  misc_feature (139)..(139): n is a, c, g, or t
  misc_feature (142)..(144): n is a, c, g, or t
  misc_feature (147)..(147): n is a, c, g, or t
  misc_feature (153)..(153): n is a, c, g, or t
  misc_feature (159)..(159): n is a, c, g, or t
ggcttttgaccncccatttttactatttgccaanacctttttctaggaatgngcttttttttggacccatttttatcccttttacattntaaancagngtaagttgtatattactgttttttatggncaangacccncnatnnntcntatggnaatttntttttata

SEQ ID NO: 628552 - DNA, 385 bp, Homo sapiens
ataataagcagaagcataaaatccatccaactagaataactatacctctactactagtactaaattcacacatccgtccttgatcgttctctacttctacccagtataactctactactagtaaccatccacatacaacttacatcgtcagctctgaccgacccgaaggtcagcaggacgcagcagaggcccagcacccacagggccctcaaggcgtgcggccggtagagtactcaagtccccttacgatcgcaggagccgacctccacccccgagccctgattccgatacctcaagcctgcctaccgcgtatctgcggatacccgctatcctctacattcgagctgtgaagccttgaagctgggcactggcccgacacaccaca

SEQ ID NO: 628553 - DNA, 464 bp, Homo sapiens
aagtaattgaagacgttttaaaatctgtttttgatgctaagaacatcgaaaaaattgaaaaacttgaaagaacagagttagcatacgaaattaaaaaacacaaacaaggaatttttgttttagctaacttaaaatctgaggaaagtttaatcgaagaatttgtcagaagagtaaatattctcaaaaaacaagttttaagatttttagttattaatctagattctgaaagaggaatgcacaaaactttcagacctagaaaaaatgataaacacaaatttttctcttctaaaaaaccaacaacttcaacagaagaaggtaaaagttttcaaaaaccatttgtcaaaaaaccttttgttaaaaaatcagaagaaacagattcttcaaaacaaaatgaacaagacaaagtgctaagaaaaccaaaaactgtaaaaccagcaaaagattctaaagtagctcacacagcc

SEQ ID NO: 628554 - DNA, 1187 bp, Homo sapiens
  misc_feature (443)..(443): n is a, c, g, or t
  misc_feature (470)..(470): n is a, c, g, or t
  misc_feature (473)..(473): n is a, c, g, or t
  misc_feature (503)..(503): n is a, c, g, or t
  misc_feature (583)..(583): n is a, c, g, or t
  misc_feature (586)..(586): n is a, c, g, or t
  misc_feature (592)..(592): n is a, c, g, or t
  misc_feature (610)..(610): n is a, c, g, or t
  misc_feature (664)..(664): n is a, c, g, or t
  misc_feature (696)..(696): n is a, c, g, or t
  misc_feature (704)..(704): n is a, c, g, or t
  misc_feature (711)..(711): n is a, c, g, or t
  misc_feature (740)..(740): n is a, c, g, or t
  misc_feature (755)..(755): n is a, c, g, or t
  misc_feature (763)..(765): n is a, c, g, or t
  misc_feature (767)..(767): n is a, c, g, or t
  misc_feature (784)..(784): n is a, c, g, or t
agtgcctcctcctagcaagctatatacctacatagtacagccatggcccccaccgtgatggcctcgtcggccacctccgtcgctcctttccagggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggangaggtcaagaaggagtaccctgacgcntangtccgcatcatcggattcgacaacatgcgncaggtgcagtgcgtcagcttcatcgccttcaagccaccgggctgcgaggagtccggcaaggcctaaacagctcactcacnacnggccanatataaagtgccattgcngttttgtcaactctgacattgctttgggttttccttctccatttatctttcttntttgttcctaagaatatgtgtatgtccatgtncatgtacnaacatgntcgagaaagcatgctcgtatgtgaatgcnatcggtggctatgtntatgcacnnncncataatattatacaatntgtcgactatgtattcgggtaattaactaatgagaaacatctttggcaccaaaaaaaaaaaaaaaaaaaaaaaaaaaaaaaaaaaaaaaaaaaaaaacagacaaaacaaaaaaagagaaaaacacaaacaaacagaacgacacagcaacacaacacacacaacaaaaaagggggggggggcccccatagaataaacccccggggggcgccccctttgccgcacgccctgtgtgttacaacgaagggggtcgcacctctatttgtgtgctgcttatacattacacgtggggagggcgcgtataacaaccctgcttctggggtgaaacattcgctcgagcgttgactgtctggtgaggcacccctcttttggtggtgcggtgaaccatagcgggagcacactcat

SEQ ID NO: 628555 - DNA, 194 bp, Homo sapiens
tccatagtcaaagtctctgctccttcagagaacaggacatcttcctggccttaatccattatagcagccgttatgtcatttctgtatttcaggaagactggcaacgaccgttgctttcattcttcctcaaagtatttaccatcagctactgtccgtgaggactcgtgagtccgtgaggagtcgtacagtccgtg

SEQ ID NO: 628556 - DNA, 649 bp, Homo sapiens
cgtcattattgtcttttgattataggccatcctatgggtgtaaagtggtatctcattgtggttttgattggcgtttccctgatggctaatggagtagagcatgtttttgtgtgtatttggccatgtttgtgtgcatttggccatttgtcagttacggagaattatctatatatatcctttgcccagttgttaattgggtcatatgtctttttatggttgagttgtaagagttctttatatattctgaatataagttgtttaacagatacaggagttgcaagtattttctctcatttagtggcttatcttttcattttcttgaggtctgtctctgtcacccaggctggagtgtaatggcataatcagatctcactgcagcctcgaactcctgagctcaaggagccctcccacctaagcttcccaagtaactgggactaactgcatgtgtgcgccactacacccagctactttttgtattttttgtagagacgggatttcaccatgttgcccaggctgttctccaactcctgggctcaagtgatctgcctacctttgccttccaaaatgcgggattataggtgcgacgcaccactcctgcctagtttttattttcggtaggacagagtctcactgtgttgccactcgtgtt

SEQ ID NO: 628557 - DNA, 355 bp, Homo sapiens
attaaatgctcaactccaaaaatacacacctatgaatatgaggtggctcttttcttccaattttttaaaataaagaggccccatacccgttcatttatgtattagaagtctcgtataatccaccaataaaaccgaaatagcctctgtgatcacaccacggagaaacaagatccagagacaaccttagccactgtaaaactggacttgaacactccgatgctctggctaagtcagaatctaaagatttgctaataaggttttattggtttagcctagtccccatggcctttgtctataactgatatgtgggaaccgttcccaacgaaatttcacgaacccttccggaattctggct

SEQ ID NO: 628558 - DNA, 353 bp, Homo sapiens
gatcccccgtaatacaacggcagcttagagcctccctcaattccctcctggcctaccacccctccactctgtgccttaccttgagcgcagtcttgtagtgcattagctgtgaattagctcacttggtgcattatgtcctatattggctatattgaaacctggaattgtggggcaatctattattagctgccttaaagtccgtaacttacccatagccaggactgggggataaggttagatattgtattccggggtttttcgctgctactttccgcgttttctagcacttgtttttggagggtttcctgctcgatccatgttctatttcagtgccgtttttcttcgacgaaagc

SEQ ID NO: 628559 - DNA, 355 bp, Homo sapiens
cctccagtcctgggcagtatgagctactccagcctggtgcaataagagctcattgctgcctgggggaggggtggcgatagggaggaagggctttttttcctgtagagagtggggtttcatcttactatgttgcccaggctggtctcaaacctctggcctcaagggaccctctcaccttcgcctcccaaagtgctgggattacaggcgtgagccattggccctgctagaatgagggcttttttttttttttttttgggaagacaagatctccagctctttttgcgcccgggggggagtaccccacgccgagaattaaagacgttacaaaaagtatgtaaatgtttctcccggggag

SEQ ID NO: 628560 - DNA, 402 bp, Homo sapiens
ctagctgttcagaggtccccgacgggcaggttatacggtacaagggtataattcatcctatgtggttcattgaggcagtatgctacgatttcgcgtagctggattgggttaatccacctcaattgcctgctatgatggataagattgagagagtgaggcgcaggcttacgtcaagtgagggagagatcgggtatctgcttgagatgggggctcagtttttgtccatgtgcagcacgcaagcaggccggcatgtcagaggggtgccttgggtaacctctgggactcagaagtgaacagggggctcatcctagtttcatggctatcagccattatgattattcactgatgagtatggattggcagtcatgggttatggttcattgtccggaacgtatatggttg

SEQ ID NO: 628561 - DNA, 194 bp, Homo sapiens
ctgccgcgtgcccaagacttccccttcctccccaggatcaacggcgacccgggaagtcacgcgcgtggccgggcgttgtggaacgctggaagagtgcacgccagcggtgcatatgacctcttcgtgcagaggccatcatcatgggccattcaacgcctccgggccattcaacgcctccgggccattcgacgcct

SEQ ID NO: 628562 - DNA, 369 bp, Homo sapiens
cacgggattgaatcaagtaaagccacaggttcttctgagtccacttaacacaacagaggttattgtgcgtgtggacaacttcttcaaagcggcacccaggaaaggtgtccctgatcaccacccttgttaagcattcccacgtgctgtcgatcggcacagtttcaaccaaagttgtgtttgaaagattctctattaaagaagcctgtggaatctgttaatcggtgcccattatatccttaagttgtggatattaagctgcccttcgctttaccataggtctaatttatttgccgtgcctccatccaactcagttgttttaaaaaagttcatttctcatcctgtgcattaaaataacaatttgcactgttc

SEQ ID NO: 628563 - DNA, 827 bp, Homo sapiens
ggctgacctgaagacttgtaaacccgtcttgaacccaggactgggctcctggtggggagtgtgatatgaggaggaacacccgtaccactcagtcacagcccatacccgctccccagtcccgctcagtacatggtactcagcgcagcgtgagactcctatgatcgacggatgacacagatcgtgacgcgcaggagcacccgctgcgtacacattccagcgcagctgtctctataccatgtcgtcgtccgccgccttcagcgaaggctgtagtaagcacgacactggaagcaggcgttggtcgacacgcctaccagaggctccacatgatccccgagatagcagctgcaggggagcatctaggcgggagaccgagcaaccaaggggccccgacggagaaggtggccggtcaagcgggaggggctgggcggcctgaccgctgccgtgagcaatgacctggagcagggggctctccgagagactcaaggcgacttcgtccggaggtccgaggggccatcgtattacctggtacgcggaggaggggcgcagtccgcccttttctggcggccgccccggccgtctccgttgtctcgagacgcgtgcctgcgaagcccatgaccgtcgttcatgtcgtcacccctacaaggaaggtacggacggattgagggcccgagcgtgcggcgaggcgcgtcaccacaggcgcctagccttccggagcaccctgtcggggaatacccgtggggcattgccactggtggcccgccaaaagagaggaagactgcgaagggggggaaagggcaaccctcacgaagctgcccggggggacttcc

SEQ ID NO: 628564 - DNA, 149 bp, Homo sapiens
tgatctcctctctcgtcttaaactgagtgcttatcagagtggaaagggagcgtgcattgaatgatcctgctctaggaatggtgctctcgtcacataatgcatatatatcaaagtccaggtcaggagggactgctggttcagcgtaaaga

SEQ ID NO: 628565 - DNA, 245 bp, Homo sapiens
ctaaaaaatcttgccttctaccaactgttgggtttccaacagggttggatttttttttccctttttttaaggggttaagaattttcggccacccaattgcctttaaaaaaaactttttgggaccaagctttttcccccaaaaggggccccccccttgaaaatccccccttttaaaaaaaggggttttttttcaccccccgggggttttttcccccgtataaggggcccccctattttttttggcg

SEQ ID NO: 628566 - DNA, 224 bp, Homo sapiens
gttgactctagagtatcccccaaactgaagaatctcaggactgcttagcttccattatcaataatgccaattccttataataaatctctacagacatgacacactagcgcacgagcagaacacacaccctgaccaagttcatgtctctcatacaatgattcctaagtgcgtttgttccagagatttacactcgtgggattgctatttccccacgttctcatgtc

SEQ ID NO: 628567 - DNA, 164 bp, Homo sapiens
tcggcggctctgtggtgcccgggcactcccgctggcgcccccagtgcgccctgcctctccccccctcgctcggccgtgccggtgtcgtggctccgctgtgtcctctccgccgttcgggcggccgccgtgggcggctcccctgccgtccggcgttcggcgcaccg

SEQ ID NO: 628568 - DNA, 249 bp, Homo sapiens
tgtgtatgtctccaccccaatgtaacgcacccaggacctgatgacagaaatccataggaataacgtcgaatacgtaccaatcgctgcaggcgtggtacgagtgggtgtatgaagggtgcccaggatcggaaagatgttcccccgtctttaattagcagttgccccccgaattcggcaagagctcaacagggggggttgcaacgtgtgtcagtgaccggccgcgaattagtagtagtagtaggcggccgc

SEQ ID NO: 628569 - DNA, 886 bp, Homo sapiens
tagatgtggcttgctttgtggcccttgtgatggatctgtcacgctagctagcgatttctgcggcctggagaaagagcggcgagaggtgttcggcgatctttatacgtcgtggaatccccgagctaacggcatgaggtgcgtgccagagagtctcacccgccattggggtgaagctgttcagcctccccagacgacgatctgggatctagcaatatgggaggcagaagaattgggtaatgaagcagagaaaccacaaaatgttcttgagacttatgggtgcagtgcaacatgaaagaacatactggtcgatcttgttaataaggagatcacagaatcaacatctcacttccgaaacctggggacagaagacaagaaccttaattgacacgaactggcagtctcaatatcagcaaagtatggacagtaacatcatcaggcacgcattatcggcgaccattgtggacttggccttcagtgaaggtagcaagagccatgatggcagcaacggtgatgtggctggagcatgatgctggatgacgatcgatgcattcaccttgactcctggaaagtccagactgattcctggcaagcgattcaagagtcagagaaaggaatgaatcttggtgaataactcccaggctgctgacaaccgtgcttactgtggcacgaatgccagaagacaaaacggatggcaaaggcactactaacacggaccatcggcacaaacccggcggcccaaacaccgaagcgtaagctgataaagacaccccgccccacgcatcccgagttacacacccaccggtccacaaacaagcacaaaacacacgggggcaacggcgcgcccgcgcccaccagacaagaggacacaggcaacccacacacaccg

SEQ ID NO: 628570 - DNA, 398 bp, Homo sapiens
gacctcctggtgggcacgggcagggtgtggcgctgcatggccgatcagaagagctcagaaaagtccacaggaaagctacggcacgctgggaaaccgagactcaccaagtactactctcttattggacccggtataacctgagaacacaccggaagcacttcaaaacaacatgaacatcacaatgagatcacactaagatcgtgatcgtgttcactgctactacaataagatacataacatgaagaggcattgtgcctgggtactgaccaagtcataaattctcctctgaactgggactctccccgattcagctcaggaaccagggctcccccgcaagaccaaaaccacagctgaccctgcaaatccctcccgttctgtccccgtccccgggccgtatc

SEQ ID NO: 628571 - DNA, 430 bp, Homo sapiens
ttctacaccatctctggtcccagcttcctcagacctctcagcttctctttcataggatgataaaagatattctttgggcttttatttatgtactcatttactgagacagagtctcgctctgtcatccaggctagagtgcagtggcgcgatctcggctgactgcaacctctgcctcctgggttcaagtgattctcctgcctcagcctcctaagcagctgggattacaagcgtgagccaccgtacctggcctacagcattattttaaatgtacatgtctgatttcattcagtcttaccacattagctattatctccattgaacaaagtaataaatgtaaaatttaagcccaaagagattgttacattgctggtgagttctcagatctgttctgattccaccacacactactgcctgtgcgtaacttccagct

SEQ ID NO: 628572 - DNA, 533 bp, Homo sapiens
  misc_feature (10)..(10): n is a, c, g, or t
  misc_feature (70)..(70): n is a, c, g, or t
  misc_feature (72)..(72): n is a, c, g, or t
  misc_feature (80)..(80): n is a, c, g, or t
  misc_feature (82)..(83): n is a, c, g, or t
  misc_feature (91)..(91): n is a, c, g, or t
  misc_feature (127)..(127): n is a, c, g, or t
  misc_feature (130)..(130): n is a, c, g, or t
  misc_feature (132)..(132): n is a, c, g, or t
  misc_feature (144)..(147): n is a, c, g, or t
  misc_feature (157)..(157): n is a, c, g, or t
  misc_feature (185)..(187): n is a, c, g, or t
  misc_feature (191)..(191): n is a, c, g, or t
  misc_feature (193)..(196): n is a, c, g, or t
  misc_feature (199)..(199): n is a, c, g, or t
  misc_feature (223)..(223): n is a, c, g, or t
  misc_feature (452)..(452): n is a, c, g, or t
  misc_feature (454)..(457): n is a, c, g, or t
  misc_feature (526)..(526): n is a, c, g, or t
tcaggcatcngctcaggcgaccgctagagtgtgcccccacccactgccatggctccgtgcttgtctgcangngtcctgcntnntttccctnctcctggccggcttcgtctcgcagaggcctgggganaananaagtcgaagatnnnntgccattgtngcataattggcatcagttacgcagtatnnncccncnnnnttntatggggaggagtacatccccttnaatcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttcnannnntttgagaaaggggatgtcaatggagagaaagaacagaaattctacactttcctaaagaactactgtccncccaact

SEQ ID NO: 628573 - DNA, 841 bp, Homo sapiens
  misc_feature (16)..(16): n is a, c, g, or t
  misc_feature (344)..(344): n is a, c, g, or t
  misc_feature (608)..(608): n is a, c, g, or t
gaagagaagccagtantcggcgagcaacgtggagcatcccgctctggtgccgctgcagccggaagagatggttgagctcatgttcccgctgtggctcctccttctgcccttccttctgtatatggctgcgccccaaatcaggaaaatgctgtccagtggggtgtgtacatcagactgttcagcttcctgggaaagtagttgtggtcacaggagctaatacaggtatcgggaaggagacagccaaagagctggctcagagaggagctcgagtatatttagctgtgccggggatgtggaaaaaggggggaattgggtggccaaagagatccaagaacaggacaggnaaccagcaggtgtggtgtgcgggaaactggacctgtctgatactaagtctaatcgagctttggctaaaggggcttcttagctgaggaaaaagcgacctccaggtttggatcaacaatgcaggagtgatgatgtgtccgtactcgaagacagcagatggtttgggatgcacataggagtcaaccacttggttcacttccttcctaaaaccaatctggctgctaagaagaaacgtaaaggaattcagccccatcagggatagtaanatgtgtctttcctcggcaatcacctgggaaggatccacttccataacctgcagggcgagaaattctacaatgcaggcctggcctacttgtcaacagcgaagctagccgaacatcctcttcacccaggaactggccccggagactaaacaggctctgggcgttacgacgtatatctgtacaccctggcacaagtccaatctgaactggttcgggcactcatctttcatgaagat

SEQ ID NO: 628574 - DNA, 1722 bp, Homo sapiens
tgccagccaagagcccaatttacctgaaagcagccaataacgaagaaaggacctgaaattttaaactgagggacatttcttgtctcctggatatgatcagtcccccgcttgggacgcactttcggctaaagcatcccaaattgggaaaagcaaggggccagcaacgaatggttctttgggcggaattacttttccctttttctttccacagtggaaccttaaccgagcctttataaccctggggaaaacccagggacggacacagccaacacgcctggggtcccaggtttccccctgggggccattaacattggaggtttcttttcaccgggtgaccaaaccaggacaaaccttcgtggaacttccttggtggtttccaacaaggaaaaaaccggctcgccttcaccccagagattggactccaaaaaaaataggcccaattctaccaccttccgctcgaacccaatttggtcacgggcatcacgccaaaaggcttccttcgacatggttttggcccccatataactatggtgcaaccccaaggtggaaccaactttttaaattctcccaaaaaccaagggcagctctcctttccgagggccccaaggccacaaaggtcgtgggaccccaagaggacttttaaaagcataggcctgaaagaccccccggataccacttgggtcacggtgtacacaacacagaggccgttcccaggcgggaacgcaaacaaagacgggccatggataccatagggatatggaggccacgacacaacttgggtgcgacaccaagaggataccacaacccccaagggggggtaaggaaaccaaaccaccattcggcgttgggcgggtgtacctatcccgcagagccgtggaaatgatctgggcaagttccaatacaaggatttccccacagagcccacaaggtggccacaggaaagacacccagagaggacaaaccgattcccattcaccaatagatccgcattgggattccctagagaatacacaaggagttaaaacacccccccaggaaacctttggaggacctaagggacccccgggaggggagacccacagttgggttgttgggaaacaccacaaaatacacacacaaagcaccacccaaaagtgggcgagggaaaggcgttcaacagttcccacagcaggggggcaaacacacaggaaccaataaaaggcgaccaacgcagacggtgaaaaggtattccccccataacgtatccatagtaaagcacgtttaaaacaacgggggtaaatcccccctatacccgcttaccattaaccgccatatggacgaagaagcattgtggacagtcactcaagttgggagaggagcgccccttctcaaccctttttcatggggggcatctgaccacagcctatgccctgtcaaacaccaatgtgatcgaatgtggtgacattaatccacacacactccaagaagttgaccatcacggacaggtgggccccaaccacttatttattgatcccctatcggggcggccgctacacaacagcgggttccatccacaaacacgaacaacactataataccacaacacagcttgtgtaatctgcacaaagcaggggattatcaggatcacgcgcaggaaattatcgacccgaactcgatagatcgatgaggagaagccacacacaaccacaacaattcattcttgtcagcggacatatattgaac

SEQ ID NO: 628575 - DNA, 236 bp, Homo sapiens
agtgaattcgactcgggtactggaggatctctagagtcgacaggctccatctaaacgagatttggagggcagcacggtgctcacgtgtcgacggaacttgtacatgggaggcatgcaccgcagtgtgtgaatacacgtcgaccaggatgcatgtatgcgtgattgggtgagtgagcagggatctctatatattgaaggagcaggtataggggaggtgtgcatggcacgtggtgaat

SEQ ID NO: 628576 - DNA, 295 bp, Homo sapiens
acagactgcgccgggactgtgagtcactcacagctcacgaagatcaaaaggaaaagcatttttgcctcagggtttcccctctttattttcctgtggtttgttttttctttcccttttttgttcctccaaacaaaaacaaaatgcaggccgagcgcggtggctcacgcctgtaatcccagcactttgggaggccgaggcgtgcggatcatgaggtcaggagatcgagaccatcctggctaaacacggtgaacacccgtctctactaaaaatacaaaaaattagctgggtgtggtgg

SEQ ID NO: 628577 - DNA, 454 bp, Homo sapiens
caccatctgaacaatatagctttgctgggaaaaaatagacttggagagggagaattgtacattgaaacgagaagaacttacactcttaacaatttttcaacactctcttccttttaagggaatacttctcaattaagggaccatacattaaattatatccaaacttgagtagttttaatttcttttctgtctgaaatccctgttagaacaatctctaaaactactccatagacacagaacttgagtagatttattggagcgccatctgctggctttgtttttaatggaccaaataggtggtgcctgggacatctttaagaattatcctgtatcttagtgttgcaaaattatgaagctggaagacagtatgaatttgggctatgactggtagtagtatttaaaataatagttttgtgttggcttccagaatggtaatcgaattcctgcagcccgg

SEQ ID NO: 628578 - DNA, 200 bp, Homo sapiens
agaaaacttttgttcaagatctaggttaatagaactgtaaaatgtacctgagactaaaagaagacttgaacagacagccaggcatgcttggttactggtgaggaagagccaacattgtaaagatgtcttttttttccaaatcaatctatcagtttagcgccccttttttaaacataccaccaggtttatttgttatacaa

SEQ ID NO: 628579 - DNA, 648 bp, Homo sapiens
  misc_feature (27)..(27): n is a, c, g, or t
  misc_feature (40)..(40): n is a, c, g, or t
  misc_feature (42)..(42): n is a, c, g, or t
  misc_feature (49)..(49): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (70)..(70): n is a, c, g, or t
  misc_feature (87)..(87): n is a, c, g, or t
  misc_feature (89)..(89): n is a, c, g, or t
  misc_feature (94)..(94): n is a, c, g, or t
  misc_feature (99)..(99): n is a, c, g, or t
  misc_feature (107)..(107): n is a, c, g, or t
  misc_feature (114)..(114): n is a, c, g, or t
  misc_feature (125)..(125): n is a, c, g, or t
  misc_feature (127)..(127): n is a, c, g, or t
  misc_feature (341)..(341): n is a, c, g, or t
  misc_feature (365)..(365): n is a, c, g, or t
  misc_feature (375)..(375): n is a, c, g, or t
  misc_feature (382)..(382): n is a, c, g, or t
  misc_feature (394)..(394): n is a, c, g, or t
  misc_feature (398)..(398): n is a, c, g, or t
  misc_feature (427)..(427): n is a, c, g, or t
gcacagtaaggcccatctggttggccntttttaagacacnancctgggngctatccntnccnaacgtgtnaccattatcccaaaaananccagntagcnccccgcanacgtggngaacgtgcttnanaatcccctatgatggggaacctttccttctccaaaaaaaaaaaaaaatttttcttcttcccggtattgggaggtctgaacggtaaaaattttttttccctgggggcaaaagggacccaaggatatgattgcgagtggaaaaatagggggccaaaatccgggattggccgtttttcccttttcctttgggggggaatttttaaaataaatgcggngacgtaaagccttaatgccagttnaaatgtttcngtgaacnagtttcaccggntccnctttataataattataaataaacccgttnaatttttttgggcaaagccagcctttgggtttttttaaaacaagtaaatttttttttgatggccactaaaaggggtttggagcctttttttcaaccagtagattcccccccttccctaaacttttttaactgagttgtcccacaagcaaggacatgtttttaatgttgtttgttttttgggctgttcccgtaagtttgctattaaaaaccctttaccttta

SEQ ID NO: 628580 - DNA, 336 bp, Homo sapiens
gagacaaggtctgcatcagaatatggtctcccgcagtgaagtggacatgttgaaacttagtgtctagaattcaagagaacgtacagctcgtccctgtactattatatccagcaagacactaagggcgactaccagaaagcgctgctatacctatagtggtggagatagactgaagcccgacacggcctgagcgtccagaaatggtgctcaccatgcttccagctacacaggtctagaaaaccagcttgcgaataacagtccccgtggccttccctgtgagggtagacgtaagcattacccccaacctcattttagttgcctaagcattgcccgcca

SEQ ID NO: 628581 - DNA, 879 bp, Homo sapiens
ctctgcctcatccccttcccaccaaacccagactctgtgaagtgcagttcttctccacctaggaccgcagcagagcgggggatctccctgccccaacccagttcccaaccattcccttccaacaacaagcagctccaagttgactctggtctgtgggaggtgaggctttcccaaccacggaaagaactactttacactgcaccaaacgaaatggcacataagtcaacaatcaggcagtcacacacttcatctgtctgccaagccccgtctttcctagcctttttctactaacctctctgctggggtcaagggttgtgtggccccgatttacagacaccaggggcttaagcttttagggcaaaccaacccacgtggaaaaactgctgcacgccgcaattatcttctcaatcaccaactccgtgcatggtcagccattctcttcccaatcgtgtgtgggggccttcagaccctcatgttcccagccagtgtcttcccccgaaattattcctgcatcctgggctttcaaacacttaccagacggacttcagtgccaccaggccgtcgtggtctattcatctccaggtgtgcgccgggcattccttcagtcgtggatttccacgggccggtaccaggtcaggggcccctcccccatttacacggacgccgggaggcgttcaattcctactgaaaggcagccatcttcaccctaatggacaatgggctccctcaatgtggtaaatctttgtcgtattccaagttctacaccaccgcgtggttcaagaaactaatcaatctcaaagctttagccctttatgcctctgggcgacaggggagggcccttacctacggatccaacttttacacagacctgagtggagc

SEQ ID NO: 628582 - DNA, 107 bp, Homo sapiens
  misc_feature (1)..(1): n is a, c, g, or t
  misc_feature (73)..(73): n is a, c, g, or t
  misc_feature (104)..(104): n is a, c, g, or t
nttcggcacaggtggaacatgggtgtatcctgcaggtgctcacagtatctccctttgctcaggctctagctantatttctggctcataaggccaaagggagccngaa

SEQ ID NO: 628583 - DNA, 1191 bp, Homo sapiens
agcggtgatcgggggtcaccaggggacgctgagattagcataggctggaactcacgttgaccatgctgtcccgggtggtactctccgtcgtcgatatagcggccccctctctgcaagaatgccgggctcgttcctaggtcgcagggtgatattcgcacggctaaccaaaggtaccttgttgcatactagggtcgatggctacacacgtgtggtctcactgatacgcgatcttcttgcctggaatacaggacgagaagaaggcttgcgttcatgagaacgtgatctccgtggatgagtaattttcatttctcaggctcgtgcctattgattgcgcataaaaagagggtggggatagttgagctaggggacacctgatgatacctcggggaaaccgtgggcggcgttaatcctaggtacggcggttttgagtcccagagaggaacattgaggtactcgtggactttgaaatcgccaaaaaggacctcattttccagcatggcctcctatgtccaagtaggctaatggcttgtaaaacttgagatccgtaatggaggacaatttcatacacaaacagttattgtgtactctcatttttaggtttggccagggaaccttttgaggcgagaggtaagatacccttgcaaacttcgaggcagaacaaaagctattggactcgcgaaatttagagaaactagggccgaatagcgaggcttatcccaatacccagaggcgatcaatttcctaagcaaaatcgtccaaactctcgaattcatcgggggaggcaaaagctaccaaaccaaaacttaagagacgaagcataagtgcttttgccaccgcacaagtccgacccgcgatatatacgcttatatattgggagtttgcttagccacacactggcgaacaatttaaattccaattcgtcgctgaagtaggagggcggattccgcggaccatggttctcaactttaattaaacccctgagcgggaaaagctcgaaccgtggttaaattatcgcaaggtaaatttatttgcccaacgtggcccgttgtcgaccactgcaacacttcgggtcccttggggaacattaaggtctaatgacttattccctttggtcggccctaacaccaccttcggatgtggcaagtcttggaccccggggagaagaacagtgaaaacgcacgagtttgcatg

SEQ ID NO: 628584 - DNA, 110 bp, Homo sapiens
  misc_feature (10)..(10): n is a, c, g, or t
gcctggagtncaagtggcaccatcgctgttcactgcagcctggattccctgggttcaggcaaattctccaacctaagcttccggcttgaagaccaccatgtttggctaat

SEQ ID NO: 628585 - DNA, 354 bp, Homo sapiens
gattggtcaggtagacggctactgtcataatgttatataaccttcatctcctcagctttccccagccaaatctgttgtacattctgcacagtttgtactgcacaaaggacgacaaagaaaagagaaaattgaagtttgagtataggagccaggagttcagtcgtggttccacgaatgattgggagttgtgcctgccagaatataccctgtagaaatagtacatgatgtgtgtataaaatgtagtaccttctagcaaaggcttaacatgtagattgacttgcttaatatttgttataaaggcaaagctagattaagtatcctgaaatgtaactctttcctttgtgtacagtcgac

SEQ ID NO: 628586 - DNA, 429 bp, Homo sapiens
  misc_feature (24)..(24): n is a, c, g, or t
  misc_feature (68)..(68): n is a, c, g, or t
  misc_feature (70)..(70): n is a, c, g, or t
  misc_feature (72)..(72): n is a, c, g, or t
  misc_feature (93)..(93): n is a, c, g, or t
  misc_feature (98)..(98): n is a, c, g, or t
  misc_feature (108)..(108): n is a, c, g, or t
  misc_feature (119)..(119): n is a, c, g, or t
  misc_feature (143)..(143): n is a, c, g, or t
  misc_feature (165)..(165): n is a, c, g, or t
  misc_feature (177)..(177): n is a, c, g, or t
  misc_feature (180)..(180): n is a, c, g, or t
  misc_feature (232)..(232): n is a, c, g, or t
  misc_feature (237)..(237): n is a, c, g, or t
  misc_feature (281)..(281): n is a, c, g, or t
  misc_feature (332)..(332): n is a, c, g, or t
  misc_feature (422)..(422): n is a, c, g, or t
aagttttttgggggtgggtttggnctgttttcgacactaacaccagtttcactgatctgattttttcnanantttgtttttttcttttagttngggtngatgcgacanccatgcgggcnggggtgctggctgtttggtgggcnggggcgtggcgtcggggcgggnggtctttgggtnccngacttttcgggtgtgatccttttcgaactgcatccgttcctcgcattggggntgtgntaccctggccctttcctctttgtgtgtgggtttgtgttcttgcngtttcttgctgggcgtctgggtttcgggttgcttcttcctgctgcttcagngtgttgtggctttcttcatcatctgtgctgcgtccagcttcatcttcactcttaatacccatcaatttcctaaatttgacattttggtcnttgtttc

SEQ ID NO: 628587 - DNA, 1170 bp, Homo sapiens
ggttgctcggaggcacgtgtcagtcccggaagctggcgaggggaaactgctccgtagcgcgcctggggaggaggaaccgccctggtcctttagggtccgggcccggcctgggccatggattcaatgcctgagcccgtgtccgctgtcttctgcttcttcccttgctgctgctgctgctgctgctgctgccggcccggagctgggcccgagccaggcccggcagctagaggagaaccgaatgggttcgcctgcaccaagcaaatgcgaagtgtgtaaatatgtacgctgtggagctgacagtcagcctttgagtgaaaccggcaaggaccaatgaggtgatatggacacgggcctatggccatcctggaacccagaaggcctctggcagtcaaatacaaccaagtcggaccttgcgcgtctaatcgacagtcgactgagaccatttgcacagacgatccttggcattatagcctgacacacatgcagaggaccggacagcaaagtcgacttagcacaatgcgcatgttcacagacacttttgcgcacatttacagcaacctggtaccaccccaggcggtcaagggtcgggtgcatggcacatccccctatgaagctggtgcgcaccgacgcgtcctagcagagcgctggctggacccttcgaagcgaaggccaggcggtgagttgtgacatgcagcgggcaaagaggttcaggcccggacagctagcaccacaaggcaacgggatacacacgggccgcccacccgcgccgcgacgcacggtgaccgcgcaatccacgccggcgccacagcacgcgacgcgtgaagtgaaagccggaccgccacgacgcagggcacggaccagatcgcccacggcggacgaggaaccagcacggggagcccggcgacaggcacgaaaaccccgccagagcaaggagcgcggccgcacgcagacccgggcgacgcacaacggccaaacacggcaaggaagatcggagcgcaaagaacagggccaggagcgagcgggcaagagggaaacacaaacagcaccggaaagagaggcacacgaaaagaggacgacacgcgagcgcgagggcccggaagaccgacagatcgaccgacacccggaacgcaggaggagggagcagggacaagacacaaccgaagaccacac

SEQ ID NO: 628588 - DNA, 157 bp, Homo sapiens
gagctgaggtggagaggcgtcactgtggggagactggggcggctgcctacctgcctcctgtgtggcggcctgggtagctgagtctccgcggtggtctggtggacctgctcgtgggacgagattgaccttgcgatactggacctcttccacaatggta

SEQ ID NO: 628589 - DNA, 482 bp, Homo sapiens
  misc_feature (240)..(240): n is a, c, g, or t
ttgtgcgctacgatgggtacaccagcagaaaagtcgtggaggtggaggttcagggaatccagttagacgtcgggcatggtccaggcctccctggggatcataggcacggatgtggtactgggtgccgctggcttagtttctcaagggcctcctcgatgtacttcagaccattctcctcccgcatggccttggtgctgaagtgggtatggcagccggcaccattccagttcccaggaaggngcttaggatcaagggtggctatcactccaaagtcttcacacacacgatgcaaagatgaaacggggcacccaggatgatctcccaagcggattccttcaaaaggtccaatctgaaattcccagtgggcaggcatgacctcgggattagtccccggaatcttggaccagtccaagatcgtgggtacagccgtggccctttcactccatggaatgctacagagccagaaagatgaattcccggga

SEQ ID NO: 628590 - DNA, 107 bp, Homo sapiens
ctggagcgagatataggaggtgagccgaccaggctcacaccaggaatgacgaggtctgtttgaattctccttcacttcgggcactaatgctggctgtaaatcacctt

SEQ ID NO: 628591 - DNA, 150 bp, Homo sapiens
ccatcctttgggctttggcccttttttcccagggggcccacccctattgggggcctccgggttattttttccctcccccccccccccccccctggggtttaattatggtaatgttgggggggaatgaataaaaaaaggggatttttgcca

SEQ ID NO: 628592 - DNA, 827 bp, Homo sapiens
gggagagcgatagcgggtctgtggctgacagacaagctgggggccacgagactagctgtgggcgccgaccaggcatcacgtccctgctcacggtcgcggctcatctgacaaaatccgtctctgcttccatggaccttacctccgtgcgcgcaagctgaagactacaagtggctactcgaagacgctgtaactcccgctccgatcgtggtggagcgatatgtaagggcgccctacatggagatcatcacatgctcgacgatgctcgactcgcgcaccccgtgggtagtcgtcatggtacgccagacaatcttgaagtccatttctcgggacaactaggctcgcgttaacctggagctggaggagttataatccgcgacgttcaggatattttagggagaacttagcgggaaaaggtgggtgagtgtgaagcgtctgccatgctgtcactggagtgccagtacttgaacaagaagaagcgccctgacgaccctcgcgggacccctcactcccccggtgaagcattgttcagttaaagcggaaacccaagagcgccacgctgcgggcggagctgctgcagaagtccacggagaccgcccagcagttgaagcggagcgccggggtgcccttccacgccaagggccgggggctgctgcggaagatggacacagcacccatcaaaggcatccgaagcaggcgccttcagaagacccacgggcccaggttttaagcccacgggaacgggaacccatcccgcttcaggaggctgtgggaagaacaagtgtgaagtggtggaaatttctgaagcggatattgttggggcgccaaga

SEQ ID NO: 628593 - DNA, 174 bp, Homo sapiens
  misc_feature (68)..(68): n is a, c, g, or t
accgaggtgtggaggcaggactgtctcctagctgaaaagccggctctcgattcttaccatctttgtcncagtaaagggcacgtctggaatgatgatttcgtagctgcaaatctggctgaactgaggggagcagtcggcatccacggcctccacacctctaccgccacaacctct

SEQ ID NO: 628594 - DNA, 110 bp, Homo sapiens
tcagtataagcaaggatcaggggactcccagcagacttcgtgagcctgtatctagaaggatcccatctctccagtacttaaccctggaaatactagctagctgtaggctc

SEQ ID NO: 628595 - DNA, 803 bp, Homo sapiens
tagaaagtgtattttattagtatttttccggtgaacagaagatttgttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaattggtgatgatgtgagcagaattggcaagtaagttaagcattttggatcctggtaatcatgggtatcattacaatgaagggatttcacaaattactggccagaggaagtggtttttttaaatttaagaggggaaatataacctataaattgggtttcttccaagcttagctcttaaattgggagactcaaagttaaacatcctcaacagagtttatttataatttgcgaatggtcaattgtgtattcggctactgatctgtgatcaaccattttaactttcatctctaggggatgtttaccatttatatatttgcaaaataaacaattataaaaaaagaacataagagagaatggtacttaattacttgtgtggtttgcaaataaggtcatttccatgtggagtagattataaccttattaatatgataggctaagaaggtggcatgactggcctgtaaatttaagtgggccgtgtggcattcgtaaagagatcctaggattgtctttttggaatcgaacctcaaaaaattgagtgtgcaagcatccagggggcggagaatccactctgagggggtccagctccctttactgtccgctgacggttggcagaat

SEQ ID NO: 628596 - DNA, 244 bp, Homo sapiens
cttacaggtgtttgactgactcggatagtgggaagtctacaccctccaacaatggaaagaaagggctcaagcacggacatcagtgaggacctgggagaaagactttgacctggacatgactgaagaggaagtgcagatggcactttccaaagtggatgcctccggggagctggaagatgttgagtgggaggactgggagtgagggagccagagggagcagctcccccacccatggcatctctcg

SEQ ID NO: 628597 - DNA, 439 bp, Homo sapiens
  misc_feature (54)..(54): n is a, c, g, or t
acaaggcatcagccagcagtgtcagcttctagttcaaccattatatctaatggngagcacagaaccattgggtgttactgaaacagatatatgcaacgctgccgaaagacgaaggaacttgtagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagtcatcgccaacttgtctctgtagaagctccgggtgtagattccccgcactgtatcattttatgctttgatttacactcgaactcgcgagggacatcctgc

SEQ ID NO: 628598 - DNA, 308 bp, Homo sapiens
  misc_feature (71)..(71): n is a, c, g, or t
  misc_feature (74)..(74): n is a, c, g, or t
  misc_feature (104)..(104): n is a, c, g, or t
aggttatgggagaagatatcccacaaaaataaaagatgaagttcacccagaggtgaagtgtgttggctccntancccttggtgcgggggggactgtatcctcanaaaaatttgaagacaagtgggtcagaaagatcaaagaccatttctgtgcatttgaaaatcagttccatacagagatacaattcttgggttagtgggttataaaaaacaaaaccacaaatatcttgtactgtgttgggtggccttggttacttcagacaggatccattgctaatcatggagtataaatgattatttatggtttat

SEQ ID NO: 628599 - DNA, 1241 bp, Homo sapiens
  misc_feature (720)..(720): n is a, c, g, or t
  misc_feature (977)..(977): n is a, c, g, or t
  misc_feature (1241)..(1241): n is a, c, g, or t
gtatcccagtgatctgcaaaaaaaaaaaaaaaggacctccttgggtccaatggggattctctggtgggtaaaaaattaattttaaaggggaaatccacaattgggtttggtccattcctaaaggggctagtcttatagaataaatcccataaaatgggttttaatggtccagtatggttatggtcattttctaaagtggcaggcaaatttcaatgggattaggcaggtctcaattgggactcattaggcaggggtttgggtatttttatcataaactgcttaagcttccaatattggggataaaaggtctggtgggcggaaatataggttgccggtattgggcaaattgagatttctctggggtataataagcgctttggggtgaaaaagagaatgtggctataggtaaagagacgctaaggtcttttgtaaagaaggtaatgtgcgcaaacacatttatattcggtaaaattacaagaccctattggggtggtacaatattccattattaaagggggcttttcccattgggatctcttggggagagagacatttattgcctttaaaatgagggtaggtattaccattgagacatctcttggggagtgttatgagagagaggcgctatgtataagaaacaccagaaattttctacagagtaagctctgtaaaaaaaaaacgctctgggtgtattggggttgtaaacacagaggggggaanattctgacaccctaatgggggctgtttctgtaggaagaacaacacacaggggtgtgtgttacccattttctctaactgaaaagagtttcaacaaacgactattgagaagtgtgtggtccacaacgactgtctttagagaacagcggcggtacatacaaatttgggggaacgaggtgagggtgtctcaccgaggagtatacaaggggggtttactcctttaggaaaaattccatataagagggggggggcgcacaaanaagaagaaaaaggcaacaattttatagacagatataaattgtggtagaaagaacaaaagctttttacaagcaattatatgctagttattatcaagaggggatattataagaggaccgagtattctgtcggaagaaaacatattacggttctaggcggggacaattcagggggagtatagacgagtttctggggaaatacggaagacaggaggtcatcttattacaaacccaaaggggtcgggggggaaaagatatattgacgan

SEQ ID NO: 628600 - DNA, 152 bp, Homo sapiens
  misc_feature (135)..(135): n is a, c, g, or t
tcccttggtatacaaagataaacaaggaccatcctactcaagtggacatagcctagaaagcaaagatacctatcctcgcccaccaaaacaggcaagacaatcacatatggatgatgttgctttcaaccaacttcntgtgaactagctttaag

SEQ ID NO: 628601 - DNA, 1001 bp, Homo sapiens
ggcctgttgggtggttggggcggtcagagtgctgagtgccagagaggtagcagcggaactgacagggaggccagtgggcagagctgaccctggagagggatcctgatgtcctagacacatggttttcttctgccctgttccccttttctgccctgggctgtgacccaaagatgaccccagaccttgctcgtttctaccccctgtcactttttggaaactgggcagatgacacattcatgctgttctgtggtgggcctgcatggtcatgttggggacccagctcacatgggcatgcatgcccttcagcaatgggtgcttcttcatccccagtggtttctgaggacagagcagggcacggaaagatgagcaaagtccctggggaaatgtgcttggaccaagaagacatcatcaagtgggggtggagatgcaggtgctgcaaggaaaaagctgagaagcggaacatttggaccctgcaagaaccttggccattgtggctgcaagacacaagacaataatggatctttcctcagccgggatcccatgagatgtgggacagaataccctgatgattcaactcctgctcccattgggaagttacaggcgtggctgaattggaaacctgtacagatctctgagagtacaagagcttgcgaattttctgaacaagatctgaaatgctcttacgatttaatcctcaagtgcttaagagggagacactttgatgcacagacatggtgaatgagtggatccccatcatcccagatagaatgcttggattcctaagacggctttgcctggtagccaaggaatagacacaggggatcataaacggagaggtattcgatcagtaatcatgcatggacaattttggtcaaaaccttgaggtcaacctgaggttgaagctggtgtggcttcgccgccttggggcctaaggtagagatgaatgaaggagcagataggacagatcttattaaatatagatagaaaaagacaaaaaagga

SEQ ID NO: 628602 - DNA, 392 bp, Homo sapiens
gggtccccctggctgccggtctcctggcttctccggtctttcacaaggctcgcgtctagctgtcttcgcagctgctgtatcacctgaaggctctcctgtgattaacctgctgccagctcattactgtgattgtttgtattatttatttctttatggtttgctgtattacggactttcagtttcttactggctgcttggccagagactgctctcagttccttccctcacggacctctcgaaaaggctagcttacaaaatggcagctggcttgcaaccaagtcatgcaagagagggcatgcaagatggaagctatttataacctaatctcagaagtgatgcctcatcactttgccatattctactcattagaagcaagtcagtaagtccagacc

SEQ ID NO: 628603 - DNA, 373 bp, Homo sapiens
accctccgtattacgcaaggcgaattccacactccacccgggaaagaaacgcgggtaattgaggcctgttccgcattgaaaagtttgcggatcaggcaagggcaaaaacgtaaatgaaataatacctaccgcataaagcaacacgatgggcataataatcatgcgtcgggcaggaatttttccatagcgtttgcggtatatcagggcggcaagaggtagagcaatcacggcaataatcagccatatagtgattgcttgaatcagaatgggagtcccccagctgaccatgaaatgcattgttcccctagtgggcgcgtaagtatgagcgacgaccgtccgagcgtccccagtttaccccacagatgaaggagag

SEQ ID NO: 628604 - DNA, 163 bp, Homo sapiens
tcatgcctttcaatgtgcatgcagctcactgattgcatcctctagtttccgcacggtggccaccataagtatgtgcgacgagcctcgtcgaaggccgacttccgttctcatgtcctgtccgggctaccggactctccttcgtcatcctagtcgttgctatttc

SEQ ID NO: 628605 - DNA, 870 bp, Homo sapiens
agctaacaggtataggacacggggactgttattcgcaagctgcgttttccctgctgtagtggatgactggtatagtcattactccccacacccatacactttctatattcagttctgaactcagttgcttggctcgtatccttgctcttgatcatcatcttctctgctatggtgcatccgaaaagtagaatcgattacgctaaccgaaggttagcgtataggtagacatgtactgatcgtaattgtagtagatagaaatctatgtgtttgccctgcgtgtgctgttgacgttgctagttcatcacgactggaattcacatctgacgttgtcgttacgtcttacatttataacaacacccaacaagatgaatagtatgcgtgcatcatggtactgctgctatgtctcctaatggatcctggcgtgtgactgaatggccgttggacactgggtaacattgtagcggattgcgactgccatttgcctaagacctaggtcattgctttaggcagctcgacaaccacgtcgtgtgtttgtgtcatgaaacgggtaggaccgagtaggacatcaatgcgctacggtggtttcggtcgcaccctccactgtttcattgtgagggctgagggatctgaaaattttaggcatcaatgaggaacttcactatgggcgcatagtagtcagaggtaggcactctgtagaatttgacactttcgaccgtttatcgagcgacaacttaaggtgtgagcttagttacaatcacagcagtataagctattagacgggccttaactttagtggtgggccctagcacttgtgaaggaacccacgtaagaaatatgtagtggaggacctaatttagacagtaaaaaccc

SEQ ID NO: 628606 - DNA, 273 bp, Homo sapiens
  misc_feature (3)..(3): n is a, c, g, or t
  misc_feature (10)..(10): n is a, c, g, or t
  misc_feature (14)..(14): n is a, c, g, or t
  misc_feature (36)..(36): n is a, c, g, or t
  misc_feature (40)..(40): n is a, c, g, or t
  misc_feature (69)..(70): n is a, c, g, or t
  misc_feature (104)..(104): n is a, c, g, or t
  misc_feature (124)..(124): n is a, c, g, or t
  misc_feature (151)..(151): n is a, c, g, or t
  misc_feature (155)..(155): n is a, c, g, or t
  misc_feature (157)..(157): n is a, c, g, or t
  misc_feature (165)..(165): n is a, c, g, or t
  misc_feature (172)..(172): n is a, c, g, or t
  misc_feature (175)..(175): n is a, c, g, or t
  misc_feature (203)..(203): n is a, c, g, or t
  misc_feature (206)..(206): n is a, c, g, or t
  misc_feature (214)..(214): n is a, c, g, or t
  misc_feature (227)..(227): n is a, c, g, or t
  misc_feature (242)..(242): n is a, c, g, or t
  misc_feature (254)..(254): n is a, c, g, or t
  misc_feature (261)..(261): n is a, c, g, or t
  misc_feature (265)..(265): n is a, c, g, or t
ccnttggaanatantgttacatttccttgtacaganaagnttggtggctttgttaatgtagctagtaanntttatgactactaagtgaccagttttcggtgccntttattgtgggatgcatgantatgtatttattgtacggaagccctgncctntntatttttntactttnctnaaagtaatggttgatcctgatttacatnatnattaaagncatctttcccaangggcacttcctttanatcatccttccnaaataanaagnattcattt

SEQ ID NO: 628607 - DNA, 1162 bp, Homo sapiens
gctccttcggggaagcgcgtacctggggcggcccgggaggggttggcccgtgcactgtcgctgactgatctggcagtgatcgacaggcgcgaaaactcagctttggcactccgttcgcgtccatctggtcgtgcctgtgcatgacgctcgaatagcatctgtcaggaggtggaagttggggagcttagaggacctcgatggctcccaggggggaccgcgaggaggagcttgaggaagtacagacggtaaggacgtagaggcgcttcgggataggaagagctgaccgtcgtccaagtcaccttctctggcccatagagcctggcctctactctgggccgcatttccttgtctaacggtcgcccagttcggaactgggctgcattctccctggatgctcgaacgtccagataccagggaagatgctccgagccctgcgtctactatggcccaacccccagatgaacggtccaagggcccaactattgacgctcagggagaccggagtagcccggatcgagtgaccagggcccgggaggagggggtccaggagaaggctggaccaacggctgtgctgggtcctggaacaccgaggcctgcgttggaggggggtccaggctggcgtggcagaggccatagtgacgtggcgggggcaactgagtaaactgctgaagagaccgtgatgagctggcatggacgggctggcatagtgggaggctcccgggtccacgggaagactaatagctgagtgaagtgtggacaccgaaaggtcggggccagaggcttggtcggcgacggtctcgggagctcatgtcacggggataccacagtgtgaggccacgtccaggtgtttgtcgggcaaaccatgggtaggttccccacgagagacccgcgtgggcgggggggggacaacaacccaagcgagtgggcgtacatcggccgtggtgtatattcgcaccagcctgggggaggcagcacccccggtggtagtcccaaagggaggagaagggtgcggtagaacaccaagtgcgcagaccacaagagtgcccacaacggagtatagtggggtgctaacaccccaccgcgaaagaaaacgccacggccagcgaagggaagcaaggtaactaaacaacgcaaagggggagaaggacaccacggcccacag

SEQ ID NO: 628608 - DNA, 739 bp, Homo sapiens
agaatcacttcagcccaggagtttgagaccagcctgggcaacacggtgagaccctcatctctacaaaataaaaataattagtcaggtgtggtggtgtgtgtctgcagtcctagctacttgggaggctaaagaaggagggattcttgagtcatggcgagaggatcatttgagcctaagagttcaaggttacagtgagctatgactgcaccactgactccagcctgggcaacagagtgagacctccatctctaaaaataataaaataatccagttaaaaacactgatttctgggccggatgcagtgactcacgcctgtaatcccagcaccttgggaggatgaagcaggcagatcacctgggtcaggagttcgagaccagcctgccaacatggtgaaaccctgtctctactaaaaatacaaaaattagctgggcatggtggcaggcacctgaaatcccagctactcgggaggctgaaggcaggagaatgtgttgaacctgggaggcggaggttgcagtgagctgagatcagacactgactccagccgtggacgacagagcgaggtctgtgtcaaaaaaaagaaaaaaaataaaaagatagcaaatctaatctctataattattttagaagttatcagggtggcgggtgcggtggtcatgccggttatccaggattggggaaggcgagggggtggatccctgggggcggagtcgagaacaagctggcgagtggtgaaacccat

SEQ ID NO: 628609 - DNA, 629 bp, Homo sapiens
  misc_feature (266)..(266): n is a, c, g, or t
  misc_feature (433)..(433): n is a, c, g, or t
caccaggatacttccatcagtgagtttccaaggcaaatgaatcatctttagaattggaagctcaatgtaagcaacaatgaagtaaagaaaacaactgaatttctcttgaaattattttcctttactgacttgtctttattgtctgtgttcacaagaaactagctctgactgcaaaaatgtctgcctgtttctatggccagttcttttctacatgtttaaattcctaattgtgcacacaatcttagtcacaatattttcatgtgcangcaattaaagactcatttaacagcccttcctcttgaagggttttgtcttcatcttgcacaaatcagattcttaggaagatatttgattttgaaccaatgtaaagtacttgtcaattttgtcaaatttcatttatggaccaatttttaaaagggatgtaatggacagncacaaaaagcttaacaacttgttcaaaaccaaacctttcaaattacccatatggaatggggccaaaaaaaatttaaaacttaatttgctgggaccaattgccaaataaaaaccgattggctgggttaaccatccttaaacaccaattttggttaataacaacctttttccttacacggcgaatttaaaaatttggg

SEQ ID NO: 628610 - DNA, 677 bp, Homo sapiens
caaaatcacttcgacagaagccaggagacagtaccatgacgtacctgaacaaaggccagttctatcccatcagcttgaaggaggtgagcagcagtgaacggaatccatcatcccatcagcaaagcttcgacgatgtgagtcactggttgggttattaagcatgaagacaaaagcagagaagatcagctctaaggcagttggaagtactggcactcccggcgagcacaccgcataaacaaagatgcattgacatagctgagctataaagaaaagcttcaacaactaatcaggtaacatcgagggagagtttgcgctataacgccatttgccttcacatgggacatcaagcgatgaagcaaaggttttcatctctgtgaactgcttgaagcacagatgtctcttcccagaagggagtgaaggggttagcctcttaacattcaagttgatacctatagttacaacaaccgagcaacaagcctgtgcaccgggcctactgccagatcaaggtcttctgtgacaagggagctgagcggaaaatcagggatgaagaacgaaagcaaagcaaagaacaagtgtctgctgttaaagtgccactggttccctctcacaagcgaatgggtatcacagttgtcaacccttcattgatctcgatactcaggctgtgctcttcattcctg

SEQ ID NO: 628611 - DNA, 346 bp, Homo sapiens
tgtcggcgcgtgatctgctcatcatttacacaagcagccaagtatatataaactaggcatggcatcccttatgagcgggcgcagtgatataggtttcggtctagattaaaatggcgtagcccacttcttagcaaaggacaactaaaacccttattcccatactaagtattatcgaaaacatcaggctaactcattcaaacaataggcctgggcgtaagcctaaacggtaacattactggcgggcacctactcatgccctaaattggaagcgcaccctagcaatatcaaccattaaccttccctctacacttatcatcttcacaattctaattctactgactatcct

SEQ ID NO: 628612 - DNA, 399 bp, Homo sapiens
ccgacgagttgtccgagttatcgaaacagtaacaacaacaacgtattaaaaaacaacagaagagaactcaaataactctttcgacatgtagtgaggcagagtctaccaagtaccctgaagcagttgggtgccgcgaatcctggtggtgcttcagccaatgatggcagcaaggctggccaccgtggaaggcaagtgactgagggcttcctaactcaagtctctgtcccacaagactactcagttgaccttcagagcagcggagtcacggctagagagaatcctccagaccatctcaggctcgcactacctggcagtctttcaaatgcccttagagcacggtcatcagaacaatctctttgcttttcgttccctaactcggacaactcgtcgggtaccgag

SEQ ID NO: 628613 - DNA, 454 bp, Homo sapiens
ctccgacctcagcctcccgagtagctgggactacccgtgcatgacaccctatctggcccttgttttttgttgttgttgttgttctttcttttttcacgtggtttcgcacttgtcacccaggctggagtgcggtggtgtgttgtcggctcactgcaacctgtctctcgggttggagtgattctcgtgtctcagtcttccgggtggctgggattgcgggcgtgtgccaccacgcctggctgatttttgtatttttagtagggacggggcttcgctatgttggtcaggctggtctcgatttcctgacctcgggtgatctgcccacctcggcctcccaaggtgctgatattgcaggcgtgagccaccacgcccggcccgcatccggctttgatttgtttttcacttgcccgtgggaggatgtacttatctcagatgctagagccgggagccctcccct

SEQ ID NO: 628614 - DNA, 1607 bp, Homo sapiens
cgcactgagctggttaagggccagcgcatgcgatggtcattctgcccgactcagtgcggaactacatgaccaagttcctgagacgacaggtggatgctgcagaagggctttctgaaggaggaggacctcacggagaagaagccctggatggtggcaccatccgatgtacaggagctgggcctgtcagcaccacgactgaaacagtgactccacagaccatcacctgtgggacacaccatcgagatcctccgggagaagggcattcgaacaggacgcccagatggatggactgaggcgaggggataactcctggagaatggtgacagacattgaggaacatgatcatcgatcaccatgacattgcacagggaaggatgcaagacgaatcagaccaaagattggaaaaaagatcaatctacaaagcagatatcaaacagaaatccagcacatcacaggacaacagactggagcaagagacatcatcgacaacattcacatggagactggaaccaccattcgacaacatgagatgagatgcaacaggcagccaggaatcacaaggtaacccaacaagacaaacacggtggaaaggatccacagactccagaccgagacaacagaacttgagaatgatatcagagagagcttggagacaaaccaggaacaaattaggaacaatttggacatagacaacgtgtccgaatggacccgacaacaccaagggcaagacagagggagaacaccaaaacaacaaggttgcaaacagtccgccgggagaaggacaggccagtaagggatacaagagacagacagggaaaaaacggaaggaaacacaggagcagaacacaccataggcacccacaaattagtccaataacatattacgaaatttacgcagatggaagcaccacgatcaaagcacgagcgacaccgcacgccttggaacttgaggattcaaacgatggcaacaattggtggcaacaatcggagagccaacacccacggacaaaatacacacacgattgagcaagccacacatgagcacgaagcaaaagaacgggaccaatttcccaggagatactatacgacccacataccggaaatgaaaaaccacacgattgggcgctttacccatacaaccataggaggccacaatgatgatcaacgaagagagccacatatttgacaggaattgggaaccactcacattgattggcacgtttacagttcatacgagtggtcagaacagtaatcgccgtgccatacaagaggcacatggtatcacaacagccacaatgtcacaacaatactttgggaagaacacgacacaatcgaatcagagcacacacgagcaagcaggaatgagacaaacacgacaaagacacaactagacacgtagatccacaacaagcctggacattaccacaaggagcgcacacacagacagcacacaagacaagtcaacagatcaacagagtgcaacaggaaacagacataccgacgaaaggacctacaagaagactagccaaagggaaaaagaacacgaaacaagcacacacgagagaacgaacgaagtatgcgagaacacaccaaagtcacacaggaag

SEQ ID NO: 628615 - DNA, 255 bp, Homo sapiens
acgatgaacagacccagtcctgaaagacaacaaaatagaaccgcggtcctattccattattcctagctgcggtagtccacggcgggctcggtgcctgcatttgaacgactctaagttttgtcagaagtaaagcgcttcggggccccggcggggacactcatgctgaagaggcagtcgagagggtgcgcgctgagcagggcaaggtggcgtggggacgggctggtgtggtctggcctcgtcaggcggactcgtccc

SEQ ID NO: 628616 - DNA, 903 bp, Homo sapiens
tctcgcggcgcgtagaaagtcgtttgtgtgtgtcccacaccagaatgtcgtaggttctggaagaaccgcttaatttatttggtgcgcacaacatgagaggaccttgtgaatattaacggcgcaattttgcagtggataagaacacacgggcggtgtgtcaaatgctgaatttggcggtcaccgcccccctggatttttattattgtacgagacttgaaaacataaaataatgcggggtgcaccacacccgagcgtcgccaccatgtcggcacttgttgaccgtagcccccagagcgggggtgttggcaacagcggcggagaatgtacaaaaaaagtcggtggtagcggagcacaaaaacttggagaccgcccgcatatgtggaggtgaccactcgggcccgcctcaatggaactccagccctggggtcacctttaaagaagggagggtttccccccgcaccccgagtctttcagggagaaatcttccctcttggtccgccccctcagtaggaatatcaattccctctgcgagcgccctcggcgcccactaaatgttgtttcaatagcccgacgcgcttgtaaggaacgcaggcgtaggttggtgataggtttccttgaaaaagagtccctcctaataaggtgtttcccataattgtttctctcgggacaaccagatgacagcttaatcatcaagaaaactcctgtttctcctatagccccccatattcaaacagggggacgccactaaaatcgagcaaccattcccagtattcaaaaataaacgatagggcggggccctacaaacacagaaggaagaaattttgcttacaggggcaaaaacatcgaggcaccacgtgagggttacccaacaaaaaaacaaaacggtttccccccaacaaaaca

SEQ ID NO: 628617 - DNA, 1281 bp, Homo sapiens
  misc_feature (1)..(1): n is a, c, g, or t
  misc_feature (150)..(150): n is a, c, g, or t
  misc_feature (160)..(160): n is a, c, g, or t
  misc_feature (171)..(171): n is a, c, g, or t
  misc_feature (184)..(184): n is a, c, g, or t
  misc_feature (195)..(195): n is a, c, g, or t
  misc_feature (199)..(200): n is a, c, g, or t
  misc_feature (209)..(209): n is a, c, g, or t
  misc_feature (211)..(211): n is a, c, g, or t
  misc_feature (217)..(217): n is a, c, g, or t
nttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagncacgccgaancgctcgcgccngggaggcgggggnggcaatgggcnaggnncgtgcgacngnaccccngcctggggacagagcaagacactgtctctctctctctctccatatatatatgtgtgtgtgtgtgtatatatatatatatgtgtgtggtgtgtgtataccatatatacacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcatttataaagtataataaagatgactgtaagacaaaatccaaaaaaaaaaaaaaaaaaaaaaatgaagaaaaaaaagaaacaaaacgataaagaaaacaaacaaaaaaaacaaacaaagaacaacaaataaaagaaaaaaaaaagtggggggggggtagccaacacactcatctcgacgacgggccgcacaacaccacacgcgcaccgcccgcactcgtgccacaacaacaggcgagccaccaaccgccggacgcagaaatacaagaacgaccacacggtggccggctcaccacagacatcacgcacgagcagaacaaaaagcacaaaagaagaaacatacaagagacaaaaacgaacaaacataacgctgcaagaacaaccaaatacacagcacccacccaccatacaacacatatacaaccccccggaagataaacaaaaaaccaacgaggctatataggcgagacacaacacagactagcatcaacgcgcccaaaagagaaccgtctcaagcaaaacaacttgcacacaattactcggcagagatcgaagaaaacacgacacacacaacaccgcacacggacgcaacc

SEQ ID NO: 628618 - DNA, 467 bp, Homo sapiens
taactcgccggcattaggcagatcccagtaatgtcggcagcagatcctgtctggctggcttcgaaaggagctggaaatgcagaatttattcccatgcgtgaaggcgcatctcctctcactggagggttcagaatctgagaaagatacctggcctatgaagagctgcaaggactcaaagtgggctctgaagctcctttggtagacaaaacccaagtagaagcctcgtcacctcggctgaatcctgcagtaacctgtgctgggaagggaacaccactgactcctcctgcgtgtgcgtgcagctctctgcaggtggaggttgagagattgcaggggtctggtgttaaagtgtctggctgaacaacagaagctacagcaagaaaacctccagatttttacccaactgcagaagttgaacaagacattagaaggagggcagcacgtggggatgcattccaaaggaactcaga

SEQ ID NO: 628619 - DNA, 172 bp, Homo sapiens
agcgggggcagaggcagcagcagcgcgcagtccctacggcctgcgcgcgcgctgctcgcccgcccgagaatgagccgggatggtgatataaagaaatgtgcagggcgggagatttcaaggcaggtcgcctcatcctcgacgacgtgcatggctggggcggcagcctcgccga

SEQ ID NO: 628620 - DNA, 154 bp, Homo sapiens
tccaaaggtgccagagggctcagaccctgagtaacaaggagtcagtaatccagcgatacctggtccccacgggacttaaagtgtggccagggagtgtcaaagctctgtcaaagcacacagcataccccgcgaggccgtgccgtattctcatgac

SEQ ID NO: 628621 - DNA, 623 bp, Homo sapiens
accctagctgtggcttctggaatctaacaaaagtatcacaggagggtgtacacgtcctgcgatattgggagtaacatcctctcccacgctggatatgacaaacaattatcacatgggggtgtacaacccctgcgatattcggagtaatatcatcctctacccaactggatattatgaacaatatcacagggggttgtacatcccctgtcatattcagagtaagatcattctctcctcacctgaatattacaaacaataccccagtagggtgtacaccacctgcaatattaggagtattaccttcctctttttgtctgaatattacaaactgtatcacagtggggtgtacactcctgggagtaatatcattctctcccccactggatattgcaaacaaaatcactgagtggtgttcactccttgggatatttggagtaatatcatgctctttctttctggaaattaccaacaatatcacaatatcacaaaggaatgtacaccacccgtgatgctgtcagcaatatcattctccagcccccccaatatggcaaacaaaattacagagggctgcataacccctacaatattaggagtaatatttttcttttcccccataaatatta

SEQ ID NO: 628622 - DNA, 1501 bp, Homo sapiens
tatggctggtgtgaagccgagggcgtactggcgaccctggagtgatgagccctgcccgagtatgatgcctgccgtggagacatgctgaggaagcaaaggagcctgcctgaagctgactatcactgagctctgccggtgacatgttctccaaaatggccacttcacctagacgtggggaactgcacggcaccagatgacagcactcatacagctccttgtgaaacatcattgacataaactcaccatgcttgaaagtcatcgttgcacactgcaaccgcatcattgctcatcacaaccttcagctaggaacttcaacaggacttaaacaccagaaatatcgctatgcactgccagccttatctggatccagcatcaatgtccattgcaagcagcagcgtcagccagctccttgcacccaggccagcttcacaagttggcatgcctcattcaaccaccaaactggcagcccagtccacacccagctgccgccaacgatgcacaaacttatttcttatggcgaccagacgtcttcacataccccccggttggacagattgtctttataaacacctgaatcctagacggccgatgctttcgtcgcacaattctccacacggacattgtgcggcaccaggaccttccagctccctgtatgggggattgtgtcatctcgccttttaggcacaacctcgaactccatctaatcccgacctaacggatgctggctaccgcagagatccaagacgaaatccgtccgacaccctcgcgcaccctcggaggaaaaccacacagcgagtcatctcagaacggcgcaaagacaaactaacagtgatatgtgttctcttcttttctcctttctctattaaaacaccataagcagacaaaaaccaaaacaacaacgcgtgggcagaaacacgcgcagggagggaagccaaatagagcagaagcaaccagagaccgcagaacaccagaaggagaaaacaccccggacaagccagcacccacaagaccagaagggcgacacgagcgacgaaagagagagacgagcgcagcagcgcgaggccgcagacgcggcaagagcgagcaacgcacagggagagagcgagcgagggaacgagaaaagaaagaaaaagaggcgagggagcgaggaagcggcgaaaaggggagagcagaaagagagagcgaaggcgaggcacgcaggaaggcaccggaagaagaagacgaaacaccgcaggaaaggaccgacgaacagggatacaaggcgcagcaagaggcgccaggggcaaggacggccggcggggggcggagcggggagggagcagggacacacaccgagggcaggcggagagaagagacgagacagaagggagagacgggcggcgagctcgcgagcgaccagaacgacggagagggagcagtcggaagggccgacgagcgagggcccgaggggcgacggaaccagaggagcgaagccggagggacggacgagcgaagaggacgg

SEQ ID NO: 628623 - DNA, 107 bp, Homo sapiens
cggcacgaggcgggccgctccccgcccccagcggacgcgcgcgcgacgagacgtggggtggggggggggggcgcgccggcgcccgccgggctccccgggggcggccg

SEQ ID NO: 628624 - DNA, 383 bp, Homo sapiens
attactggcacatgccaccatggccagctaatatttgtatctcttgtaaagacagggactccttgtgtttcctaggcttggcttcagctcccaggctcaagcaatgtgcccaccttggcctcccaaattgctaggattacaggcatgagccacccacccatcctggagggtttatttttgagggaaattgcattgcataggcccagaccataggctctggaatgggaccgtcacaactaaaattttaaaccccccttccctggcatggaaaaaaaaattaccctatgcatttggttccgtctgtatggggaaaaaaaatttttaattaataagcgattggacccgtacccccagcattattgatcgttcttaagattgagcta

SEQ ID NO: 628625 - DNA, 588 bp, Homo sapiens
  misc_feature (402)..(402): n is a, c, g, or t
  misc_feature (552)..(552): n is a, c, g, or t
  misc_feature (572)..(572): n is a, c, g, or t
atcggttgaacctgagagagggatgttgcagtgagccgagattgtgctactgttctccagcctgggcaatagagtgaggctcagtctcaattaaaaaaaaaaaaaaaaaatgcggccgggtccagtggctcacgtctgtggtcccagcactttgggaggccggggcgggcggatcgcttgaggtcaggggttggagaccggcctggcccacatggagagaccccatctctactggaagtgcaaagttagccgggtgtggtggcccaggtctgtagtcccatctactcggggggctgaggcaggagagtcgcttgagcccgggaggcgggggttgcggtgagccgagatcgcaccatcgcactccagcctgggtgcaagagcgaaactctgtctcaaaaaaanaaaggaagtggcatatttggtaaattgataaattaccactgtcaaattatattggtgagtctatatctattgttgtccccagatgttgcctttgcaagaattagtgtaaaattggaaaaaatactcaatgttgaaagctgtcattgttgngatctttatgaaattattgngcccatgtccaagttt

SEQ ID NO: 628626 - DNA, 126 bp, Homo sapiens
tcagctcggtccttttcacaggtgagggaaactgtgccaggttacaaatttattaactctagagaatcctgaaacaaccctgtcttatgtctcctaaaatcggtacaggtcctgcgtttgctggtt

SEQ ID NO: 628627 - DNA, 211 bp, Homo sapiens
  misc_feature (103)..(103): n is a, c, g, or t
gaaatttgtccaattgttcatatgccagccgcccatcttctcccagagacaagagggtttctgaggccacatttctgatttcttcagtatcagattgcgctgngttcccagttttttaatgctttcagtagcctcacggatttttagagccaggcaagctgctttctggagctggcggtttgcctttgttagtgcttcacaggaatagagc

SEQ ID NO: 628628 - DNA, 277 bp, Homo sapiens
gtgggtgacataggatccaatcgcacgacaagagcattgctatcggatcagtcggctgctttgctggcatagcgttcaggtagtgcggccaggtagtaggggcgtcgttgatctcttgggagcgtcagcagcccaggcacgtcgccaggaagaagcactcgagcagaaagcgcgggtcttctcacgccctgggtgtcgagcccagtggctcaggccgtagttggtgaagtcccgcaggatgtccaggcgctcggacgacgagatgtccagtgccgct

SEQ ID NO: 628629 - DNA, 1226 bp, Homo sapiens
ggcgccggtggcgggactctggggaaaattggctgcgtcttcgagtgggaacttatagaaactgctggcaatttcaagaaaccaaaagtggttacaggctggagaggaaaaccaggtcctggagtcgtcaattcaccgagatggggcaattccaagaactaatgacctccgccacttaactcagggacaaccattcatcatgacaactgcaacgtcccgcacgacacacaccgacacgtagcagcacagaggagaccagtgatcactccacgcaggctaccaacacacacgctacaaggcaacgccagaacacatacgtgggccaacagcctggtcttacccaaccgcgaaagggacgaaaaacttcaacgttcacactcagacaacacagcaacgcacacacagggttgcctatctcccttcctggacagcacaactacattcaaggtactgcacattagggatccagtgccaaggtcaaatgctggtatggtggctccaacttgggacctgggcttccaaggggaacccccggggaagacctgtaacccaagtctgactttaggacgatgaggaaagctgggcttaccgtgggtcaggatgcacacaactcctttcccaactaaactggcgcgtgacagggccattttaccccagcgaagattggcactttggcagccagcgcaagacttggccaagaatgtttccttgtgctccaccaggtactccagtgggccaggttcacaatggacctggtcggactcgaactatgttaacgcacgcaaaattcatcagtaagatgagacttcccgttgcgacacctccctgggccttaataaacgggacacatggacagcactgtcctggcgcaagacccaatgcgcaaccgggaacccccctacaggcagcgagaacgagacggcccgaattgggcaaaacgcgtttcacaggccgacttcccgcggactggaaatcgggcgacaacccgggcccttaacacagggtcccggcagaagtgcccacaaggctgccaaaacaaaccccggctaacacgggctgtgaggaaaagcggcccctcaaggcaccgcgtgcgccgtcaagccgaacccagtgagctagcgcactcacaacaggcgcggcccgagcccgaccgccactgcccccccgccgcgatcacgcccccacgggcacctatcgtgctaacgggagcccctccctcgcgaccg

SEQ ID NO: 628630 - DNA, 901 bp, Homo sapiens
  misc_feature (104)..(104): n is a, c, g, or t
  misc_feature (681)..(681): n is a, c, g, or t
ggaggcaatggatgaacagagcgtggagagcattgctgaggttttccgatgtttcatttgtatggagaaattgcgggatgcacgcctgtgtcctcattgctccnaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggnggagcaccagttgcggtcttgtagtaagagtgagttgatatctaagagctcagagatccttatgatgtttcagcaagttcatcggaagcccatggcatcttttgttaccactcctgttccaccagactttaccagtggaattagtgccatcttacgattcagctacttttgttttagagatttcagcactttgcgtcagagagcagatcctgtttacatc

SEQ ID NO: 628631 - DNA, 358 bp, Homo sapiens
  misc_feature (104)..(104): n is a, c, g, or t
ggaggcaatggatgaacagagcgtggagagcattgctgaggttttccgatgtttcatttgtatggagaaattgcgggatgcacgcctgtgtcctcattgctccnaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaagtatgtcctcaatttctttgttcaatattgaatggattttgcctttgtattgtttaatgacactaaaaaa

SEQ ID NO: 628632 - DNA, 491 bp, Homo sapiens
tactggatcctataaatttcactaactcaaccataatttttcttccatcctgtatccctctcttctttataagcaattatatccaagctgggcgcgatggctgactttgggaggccgagcactttgggaggccgaggcggttggaccacaaggtcaggagctcaagaccagcctggccagcacggtgaaaccctgtcaccactaaaaatacaaaaaactagccgtgcatggtggcacgcacctgcaatcccagccacccgtgaggctgaggcaggagaatttgcttgagcccgggaggtggaggttgcagtgagtgaggattgcgccacctcactccagcctaggcgacagaatgagactccatctcaaataaataaatacatacatacatacatacatacatacatacatacatacatacataaggctagtatcctgagcaatatgtaggagataaaagggagtgttagaccacgtttttctctctaacc

SEQ ID NO: 628633 - DNA, 833 bp, Homo sapiens
  misc_feature (104)..(104): n is a, c, g, or t
ggaggcaatggatgaacagagcgtggagagcattgctgaggttttccgatgtttcatttgtatggagaaattgcgggatgcacgcctgtgtcctcattgctccnaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatggttgcggtcttgtagtaagagtgagttgatatctaagagctcagagatccttatgatgtttcagcaagttcatcggaagcccatggcatcttttgttaccactcctgttccaccagactttaccagtggaattagtgccatcttacgattcagctacttttgttttagagatttcagcactttgcgtcagagagcagatcctgtttacatc

SEQ ID NO: 628634 - DNA, 809 bp, Homo sapiens
  misc_feature (104)..(104): n is a, c, g, or t
  misc_feature (589)..(589): n is a, c, g, or t
ggaggcaatggatgaacagagcgtggagagcattgctgaggttttccgatgtttcatttgtatggagaaattgcgggatgcacgcctgtgtcctcattgctccnaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggactggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggnggagcaccagttgcggtcttgtagtaagagtgagttgatatctaagagctcagagatccttatgatgtttcagcaagttcatcggaagcccatggcatcttttgttaccactcctgttccaccagactttaccagtggaattagtgccatcttacgattcagctacttttgttttagagatttcagcactttgcgtcagagagcagatcctgtttacatc

SEQ ID NO: 628635 - DNA, 178 bp, Homo sapiens
tcctgcgtaataggcttccggctgccaggcgtttcactggggtttagtcaggtggggttattttcgttaatgttagtaagggtggggacgcgagattgacctgttagggtgagcaggattattcgagtgctatcggcgcttgtcagggaggtagcgatgcgagtaacagataggccga

SEQ ID NO: 628636 - DNA, 369 bp, Homo sapiens
  misc_feature (227)..(227): n is a, c, g, or t
  misc_feature (309)..(309): n is a, c, g, or t
  misc_feature (329)..(329): n is a, c, g, or t
  misc_feature (335)..(335): n is a, c, g, or t
cacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggntcatttgagcccagaggtagaggctgcagtgagccatgatcatgccactgcactctgggctgggtaacagagtgagatcctntctcaaaaattaattaattnaattanttaaaataaactaggtaaactttggataggcagt

SEQ ID NO: 628637 - DNA, 1122 bp, Homo sapiens
ggagacgttcttcgccgagagtcgtcggggtttcctgcttcaacagtgcattggacggaacccggcgctcgttccccaccccggaccggccgacccatagaccacgccctccgatcaccatctatcaccgcaccctcgtgactgccccaaggcccccgaccgccgctccagcgccgcgcagacaccgcacgccgccgccgcctcatccttagatcgccgccatgacgaccgcgtccacctcgcaggtgcgccacgaactacacaccaggactcagaggccgcatcaaccgccagatcaacctgcagctctacgcctcctacgtaaacctgatccaagtacctcactaccaccgaccgcgaatgacgccgcgccccgacgaccctctgccacagatcacctccatccaccaactctcatgcacgacacggacccactgcccgagacacccgactgaatgctgccagacccacccgacggcgcgccgccacccctccctcccaggacccatcaagcacaccccacaccctgcgactgaccggacagcaccgcgccccgccctggccaacggacgcggcgcacccacctccgggcaaccaccaccgagcaatcacccacacacctgagaaccgccacaaaacccagcgccacccggaccccccacccactgaacccgccccaacccagatcatgaccaccaccctcgacgaccccccctcccccgctgaaacgcacgccgcgctcaaccccccacaccaccaaacattgaagattgcacccacgcatgaccacccacctgaggccccacacggccaagcgccccgacaaatcagggctgggcgggacacaatcccaatccacaaagacaccaacccgggcggcaacccacggcccacgcgacgcgcacaccgcctccgcccacaacaacacatgacgcagacggtccccccgcgaaccgccgggtcaccctacagtataggcgatcccacaaacccaacaccaagcgcccccaaccgccacgaaccccagcaggcaccccccacccctcacccccccaggcaatacggagccagcaaagagacccacacccacccaagcgccagcacaacaaaaagagagaccag

SEQ ID NO: 628638 - DNA, 807 bp, Homo sapiens
ggctggttcgtagtccttgttttaattgtgcacgtagggttctcttgtggtctgccgtcgctgtccggctgccttgtgctgtcgaacatactaaggcgtggtgccacatgcatctcagacagccgacgcagctcgacgcagggccggctggagggtgggcgttcgcgtgtcggagggcgccgcgcggtgcaggcgggcgggcgcctgatgggtgtgaaacgagtgctggtggtgctggctgggtcatgcgctgctggccggtgcctggcctggggaatgtcgatgcctgacgctgatgcctgctgctccgggggtcgtggagtgagctgaagcagtgccaaggagatcgatggactgccgagaagtactccttcatggccaccgtcaccaaggcgcccaagaagcaaatccagtttgctgatgacatgcgggagttcaccaaattccccaccaaaactggccgaagatctttgtctcgctcgatctcacagtcctccactgacagctacagttcagctgcatcctacacagatatgctctgatgatgaggtttctccccgagagaagcagcaaaaccaactccaagggcagcagcaatttctgtgtgaaagaacatcaagcaggcagaatttggacgccgggagattgagattgcagagcaagacatttctgctctgatttcactcaggagacgtgctcagggggagaagcccttggctggtgctaaaatagtggggctgtacacacatcacaggcccagacagcggtgtgattgaacacctctgttccctgggggtcagtccggtg

SEQ ID NO: 628639 - DNA, 886 bp, Homo sapiens
ggctcgtggaccgggtgggagagcgagtgggagggatgcttcacgaaagagcaaagaaggaagtgaagtgataccctggcatgctgctcagacacacacctttgtaatcacaagacacgacagtaaggggaggactcctcgcacaacgactgacaggatcaatgcgcgatggtgacaagatcgatcagaccagaagactgctgcggacgggacggaggcctcttgtcgtatgagaatgcattctgatgtgatgcaacaaaacggtaactagtatgcgtgatgaatgttatcaagatagctgtaaattgtgtcagacacttgcgaagaaggcatgagcgacgaagaaggactgcgttaaccttactatggtattgctggggaatacacacattataaggtcgttggtcatacagcaatcgataggatatcacagaaggggacgttggcgccccgaaaatgggttcccgaagaggttgtttggcgacgggtgtctctacgtcgtgactggtccacacatggtatactagtagaggaagcggcgtatgcgcttgatagtcgttcaaaccatatgggcgtgtactgattctaaatccatcgccattgatgcgtaggtgaggtcaaaagtccgactataatttatgggaacccgccgtgggtacgctccaagtactgaaaacgttaaagtataatttgtaacataaatatacttatgagaaggctggggggtattgggaggacatagagtcgacattaaagataacgtgagagtatggcatttatggactacgtattaaacgattttggaaatttgcttggtaatacatcgtgggttgaaactacagggaaatcattcggtgtcttggatggactaggagttcagggatga

SEQ ID NO: 628640 - DNA, 144 bp, Homo sapiens
gcatcaatcatatccagatctctccctcactagacgtaagccttctcctcactctctcaatcttatccagtcatagctggctgcttgtgttggattaaaccaaagccagctacgcaaaatcttagcatactcctcaattaccca

SEQ ID NO: 628641 - DNA, 287 bp, Homo sapiens
  misc_feature (7)..(7): n is a, c, g, or t
aagctcncaacaagagcgaaactctgtctaaaaaaaaaaaaaaagaggggggtgaataactggaggccagggttggaaatcagcccggcccaacagggtgaaccccttatctcaacaaaaattataaaataagccaggcatggaagcgcacgcttgaaatcccatcttctgggaaggctgaggcaggaaaatcgctaaacccgggaagggggaggtaccagtacccgagaatcgcgccaggtgcatcccagcgggggcaaaaaaggcaaaactcgtgtctcacaaag

SEQ ID NO: 628642 - DNA, 324 bp, Homo sapiens
ttcgctggttcataatttgaaacaatatgaaaactgtcctatactcattccaagcaaaagggctactagtgttagttttcttgtccacaagttgattgaattgagtgataaccaacttaattcactcttccctggttctttttatcaaaacgttttcttccttatgcaatcattttgatttaaattctttaaaaacaaaagagaaaaacatgctatcagttactcctttattttttatctgcctcagaatagttgagaaaggttatgttaggaattcctgaaaatggggtcatataagggctttatatcttatgataccgcgaa

SEQ ID NO: 628643 - DNA, 308 bp, Homo sapiens
  misc_feature (77)..(77): n is a, c, g, or t
  misc_feature (196)..(196): n is a, c, g, or t
tggggagagagggtagtgaagatacacagactgacatcaacacttggcggaaatttaacctaacaaaaaacaactcntaacagtctaacagtaatttctctaattcataaaagctctactttttttttttgcttcaaaagcttcttcacaatttattacttgatcatgaaatgatttttctaaacgttaatttttngtgcaaggcattttacccttggctttatgttgcgaagagcttcttgcaattaacttgattttccaaattcttaaacaacgtgctccattcctccattggtgctgagcgggat

SEQ ID NO: 628644 - DNA, 237 bp, Homo sapiens
cggcggcaaaacagggggagagacttcgttccaaggggaggtgcaagtgttcatctgtgcagacccttccccatggcgtgtcctctgcgtctcagggcggtccaggatcgcgacagtgctaaaggcacggcacatgacgggggaatactggccggaacagcatggtaagccatgcccaaggtgccagaaggaccaggagccacgcaggcagcggagaggaacacccagagtgctccc

SEQ ID NO: 628645 - DNA, 955 bp, Homo sapiens
ctgtgtgtgcggctctctattgtgggccgcttttgcccaacacctgtgccgccagttttcccccagtgggggccgccgcattgtacacccggggggacgcgcctcatctacgacggggcgcctctaatcaccaccccacaggctggtccccgaaaaggccgccttcctgatttacccgggggggtgatatcctcttttgttttttgttcccgccccccgccgagagaggttgtttttttctttctcccacggagatttttttttttgtcgacgacgcccgttttctccccctccgcaccgcgtttgctccccttctcccccccccacttaattttagagagggcaccgtttggcgcctccccactacacgggcggttcctacctcccccgctgtgtataacttccccttgtaggggtgtgctccgcccctctctgctgtgaacgaacacatcgccgtggtgtttgtcttctgctcactcacagagtgagtgtgtctttactcaccccctggggcttgctcacccacttagttttttgatatatttgaggaccccccccgcgctctcgccccaatattatttcttaacgcccccgtggttgttaccaagattttcgtgggtgtgttattttgtcgccctctcctccagcctctcatggtggtctttcgatgtcgcctctgtctccacattttctctggcgggggatttttccggcgtcgacacactattgttgtaggcaaccaccggcgttctccaccgtggttttgtatccgtccttttattgggttgctcaaacatcttctcttcaccacaatttgcgttgtatccccgccgacctatatttttctcctttaaacacccaaaatacccttgggtttaaacccccccccatttcgccttttttaaaatgtggtttgtttttttttttgttttcccttttttgatggggggtttta

SEQ ID NO: 628646 - DNA, 109 bp, Homo sapiens
gtgggcgcctgtaaatcgcttgaaccctggaggtggaggtggaggttgcagtgagccgagatcgcgccattgcactccaacctaggtgacaaagctacacgccatctca

SEQ ID NO: 628647 - DNA, 289 bp, Homo sapiens
  misc_feature (53)..(55): n is a, c, g, or t
  misc_feature (165)..(165): n is a, c, g, or t
  misc_feature (167)..(168): n is a, c, g, or t
  misc_feature (171)..(171): n is a, c, g, or t
  misc_feature (198)..(198): n is a, c, g, or t
  misc_feature (217)..(217): n is a, c, g, or t
  misc_feature (222)..(222): n is a, c, g, or t
  misc_feature (241)..(241): n is a, c, g, or t
  misc_feature (247)..(247): n is a, c, g, or t
  misc_feature (258)..(258): n is a, c, g, or t
  misc_feature (271)..(271): n is a, c, g, or t
  misc_feature (276)..(276): n is a, c, g, or t
  misc_feature (278)..(278): n is a, c, g, or t
ctgaaaagtataagaatacaatttacttttcccaaactctttttccttatttnnntctttcaaataactttaattatttaatcccatactgattaaaatatgtctgtctaaagggatctactactatttgcttttaaaaaagtgttccctatttatttaggaaananncangcaagcaactgaatttatatgtaaaantaacatttagacctgtggntcaanggttattttcaaaaatgangatatnaatttggtatnagtaaaaagtgtnttttntnttagtatataa

SEQ ID NO: 628648 - DNA, 774 bp, Homo sapiens
  misc_feature (458)..(458): n is a, c, g, or t
cccaaggaagtagttacctttcaaatgcatctaccttgagggaaaatatgacacaagatagaatggataatttaacctaaacaattcaactaaaattccacaagctaataatattttaattggaatttttgtatataattaagtagtcctgattcaagaccagtcaataacttaatgtaaacagagtaaaacaaagtttgttcagttagtggaaagaataaggaacaatggagcaatctgcatatgtccacttcttggtatttagtttaatccttattagtttcctgaaatgttgtttctaaaggaaaactacacatctagaaaggtatcttggtattagacctatgcaaactaagttaaaactactgtgaaattttgcttttctttagtatgtacttatctctgcaatatattgctctttggagcagctcaattctgcatttctctgtatacctggngtctccatggggtgataattaacattcttaaccttagacactgaaaaatgccttctctttccaaacaacaagcatttgttgcatttagggttgtttaagaggaaagatggatatgaatagtggaacatgtatagtgagaaccttaagtttttagaagacaacttcaactagggataaaaaaaaagcctctgagattgccggtactggtctgtacagaatggggtgaaaataaacgaaaaaaaccagcctttaaactataaacatatgtgcccacgatatattgtggaagaaaaatcctccctagttggaaaccccc

SEQ ID NO: 628649 - DNA, 1080 bp, Homo sapiens
ttagtcagaaacactataccgctgcctgtactggtctcgaccttagccgtgccagcgcaccgaaggcgttccatagctgatcatcccggatcttggtgtacctgcgtgacttggcgttcaccctagatgcgatcacgcacacaaattgagtgtgagcaagtactgaaagacacagcgtatggatgctgcgtcaaaccgtttgaacatatactactcaactctcatgaagcaatatgaatcctgagtattgacgctaaattgacccatccgtgtaaaaatagactatgaccttgagcgggctcgaacttataaccaggtattgagatgctgtgctagaatgtcgctatcgatgtgtatacgtggagatgtgattcctatttgccactataatgtccactactggcttcgctgtaccatacatggatgatcccagggaccatatccactctcctctcgcgatgccgcataccacctcgtctatctctcaaaggaaaacttactaatcattatagtgacctcgcgagactcagccgacaggttcttattcgcttcacctctttgcttaggagaaggtggtaccgacagttagctccctggaacagcacctctcctgttcttccccttggtgcgatttcgccttcgagtcaagtagcaatgtaatggccctcctatgtggggttagtctttgactactccaactcccctcgtaatgctagcatacaagactttgttatatccgcctgtgcagttgctgcagagttggactaggtgccttgtgttagatagatagctatccgtcagaacatgggtatgcgcctggtgtgaaccatatgcgttcaacgatcctcaacaattccaagcggtcgtgacatcggtaatctcggcctatgaatttcacacatgctggtgaccgtgaacggccccacaagaaacgtgcatcgtagataaaccattcctggtctccacccgaacgtgtggcctccttgcacaccccgtggatcctccctcgccgatccaggcgtacaacccgcttgttccgtggaaacagctaacccaactcccacgctcaccacacgtaac

SEQ ID NO: 628650 - DNA, 138 bp, Homo sapiens
tggtcactgagctgccatgggatggctgatggatgggatggattgcattgagccgtgggaggcagaaggctgcatgtgagccatggattgcaccactgcgctccggcctgggcaacagagcgagaccttgtctcaaca

SEQ ID NO: 628651 - DNA, 1430 bp, Homo sapiens
  misc_feature (475)..(475): n is a, c, g, or t
  misc_feature (573)..(573): n is a, c, g, or t
  misc_feature (608)..(608): n is a, c, g, or t
  misc_feature (861)..(861): n is a, c, g, or t
  misc_feature (1164)..(1164): n is a, c, g, or t
ggaacgggccaacatgggccgcgttcgcaccaacaagcggggaagaaggcggggcgggtcatcatagaaaatagtactagacgcgccagggagcacaggatctcctgacatcggaaccaaggcgcgttgctgtcgcaggtagactcgcgcgaattgaatcaccgcagtgatagagaagcgtccgtggagcaaggatagacagcgataactgtcacagcaatctggatgaagacgaattcagcagaggccacagtcatacgaggtcatctaccaatctaggccgaggagggaggcagcgcagaggacgcacaacggcaagagacgagagtgatggtatgccttgcaggtcgtgcaaggctcgtatggcatcgagggaagatccatctagaacgtcagcatcgcatgcacccactttacgaggcagagagtgcgctggaaagccttgtgtatgtgacgcttcggggcgaagggtctntggtcgcaaaaactctctctctcagggtgtccaacttcgaaggctcagtaccacgtatgtggcgggcagtggcacagtttctcgatataattaggccnctctcagaggtggcacgcattgctctctgtcaccntgtaaggggtggtcacttgttgacgctggcggtggtaaattcaagtgtgtgtcccacagtaaggagagtcatcgcgggggagcaacaccgaagagaaaacacacaatgggcatacaaggtgtagacgaagcacagttgacagtgtacaaatcccacaatccacggggaaccgggttacactcggcccggggggacaccagaccccaaaaagacccggagtggcatggacgaatagagctcaccagaatttgcnacattctgagggagaaagtccacacgtggaagcaaagcaattcgcaccctggactgggcgccacgggggcacggcgagaccacacgacaccaataagtgagattggattattcccctcagaccaagggccgccattggatggggcggtacgcccacataaaaccaccaagggactacatcacagaggcgggaaatcacctattaaataggcgctgtgtaacgccttggggttccacaaggagctaatcaagggcccaaggcaaacgagggcacgccggagaaacatggcgcacagcagcgggntcacacggggccgcggtacaacacaatgtggcaacggtaatggaaaaccccggcggtcaagcccattgacgggaaggcacaggggcgagcacgtcaccgtgcatgacactgctacattacgtggcggaataatacaatgagccatgatggagacactctggtgcgcgacaacgagacttcactggggcacacaagagcgttcacacagacaacacaccagaaggtgggatgatgaacccgcgggacccacaggagaggcacaggca

SEQ ID NO: 628652 - DNA, 240 bp, Homo sapiens
  misc_feature (67)..(67): n is a, c, g, or t
  misc_feature (77)..(77): n is a, c, g, or t
  misc_feature (96)..(96): n is a, c, g, or t
gaggttttttatataatccaacttcccttcatgataagaaaccttcaacaagctaaacattggaagnatatacctcnaaataataagagtaatctnaggaaaccccgcagccaacatcatactgaatgagcaaaagctggaagcattccccttgagaactggaacaagacaaggatgcccgctctcaccattcctaatcaacatagtactggaaggcttagccagagaaatcagtctagt

SEQ ID NO: 628653 - DNA, 216 bp, Homo sapiens
atttgaaagaggtacccttgagaagggcccattttttcacatcccccctgcatcagagaaccccagaatggggtattaaaaataaacccccctccccaaaaaaggcattcaggcatgcacacacatccccaggcatcctttcagtttatcagggccctataattgagcttcaggggtgagagccagagctcaaatgttggaagtaaccctttggca

SEQ ID NO: 628654 - DNA, 242 bp, Homo sapiens
  misc_feature (18)..(18): n is a, c, g, or t
  misc_feature (20)..(20): n is a, c, g, or t
  misc_feature (27)..(27): n is a, c, g, or t
  misc_feature (109)..(109): n is a, c, g, or t
  misc_feature (169)..(169): n is a, c, g, or t
gaagtaagcacgtgccangnacgggcncatggaagctcacccatgtactgcaagtctgcaggagacttccccccaggagcagcacctgcagtgataccagcccccctgncccggggaagagggtatgatcgagaggaaacgggcagactctaaggcagaatggcgatgncaagcgcagtgctgctctgatgaggagggagctggtcctcacccaacccctgggcctcctccccgaaccccct

SEQ ID NO: 628655 - DNA, 407 bp, Homo sapiens
tatctgtgccctatgtgaatccttaccaagggtacacttacagaggctgttcctactcgggtgtctaggatgaaccattctgtggatatcagtcagcctctttaccaagctaaccttatcatcacccaataggctcatgaacaaagtggtcatgctggcagtgatgaaagttatgcatgggctcagcaacatggacttctgctcaccaaagacaaactggctacagctactgctgagtgcccagtctgctgtcagccacgaccaacattggttccccaatatggcaccattccctggtggcaggctgatacattggattgcttccctcatggcaggggtagtatttatctcttactggaatacacactttagatacaaatttgccttcctgacacaaaatgcttctg

SEQ ID NO: 628656 - DNA, 989 bp, Homo sapiens
tggggcccccaggtcgcttcccgacagcgtcagtagatagccaagcccattgtcagaattgggcggtgggacttcttcgcgtcttgggataataggaagttgttcataggagaaggacggacgttctacggcgtgggtcagaggacttcacacaagtggcaatctataaggagcaggtcctgcgtctgctctatcaaacgtcttctatcgaaacacgcgaaggaatatgaatgagaccatgtgaagttgtcagccaatgtgagcccttgcgccacagcgcgaatatcgaagcaagagtaaccggaggactagtgagaaggagaaggaatgcgcacgcggcaagtccactgcggcaaggaagggacaccgaacactgcacggcagtgggatgtgcccagtagggcaattgcagaaccgctggctcgaggcacggagaggaaccgcacctgtcctccccaataagcagcagggtccatcctgcgtcacctcggtgcttgtgcactggagtgactattccctggctaaatattggcatcgggtcttttcttacctacattgcttggtctgcggaggaccagaaatcaccgtgtgctctatacattggactgacctgtaacgacaccttggtcgctggacgtggcattttggaattcgctttctctgctagaaggtgatggacgaacaagactgggaaggattgtaggtccacatccctgcctgaacaagccaatggcaccccagggcatgcagatgcctggaaagcaaggcgtcatgatgctccccggaggtgacgtgtgcaaagagagggatgcaaggtgcacaggaccgtgcagcagagtggccagtattgtcgtcgtgcttcccgggatcctttgtgtcccaagatgtgcctgtgggtacagcgtgtctgaaaccgtgcactttgctaccacccaggtgacaagtatgggctttgagaccgccaaggaaatgaacgcgtcgccatatag

SEQ ID NO: 628657 - DNA, 359 bp, Homo sapiens
ctaaataccagcagcgaaatagcataagctgtaacaatctcaagacattcaatagaaagtctcagaatatcccagagttggcaacaaggtaacgctagtctggaatttgaagttatttctgtcatctttgtcttcggctccatgttccatgatgcgtgtgacctcgatgtatttgaaacttccccgtttttatcaataggtgcttctctgttagcagtttatccatttcctcatttgttatccgctcccccttggttgtcattcgctctctcaagtattcttcctgtatggtgccagttgcttcttcatcaatgcctgcgatggcatttctggtgatctcttcgaaatcctaatcaggt

SEQ ID NO: 628658 - DNA, 246 bp, Homo sapiens
ggggcccccccaaattttccttttccccggggggggaattggggggggggggcttttcaaaaacctttcggggggcctataaagggggggtttccggggggttttcggggggggtttccaaccaaacaaagggggggggaaaccccgggggggggggctttttggggggggggggggacgggggggttttttccccaggggggggggggggggggggggggggaatttttggggggggggggccta

SEQ ID NO: 628659 - DNA, 380 bp, Homo sapiens
actctagcaggaccccagcttagtgagctccttgatgctgcttacatgtctcgatcccacttaactatcttgggctgtgacgaagtcacgtggttcacatcggcaggcatactcagtctttctcagtgggggtgaattcatgtgtagtacaagccgatagacagaccagtccttgcttgacgcacaagtctgaatgctccactttgtccaattctctctccattcttcagtaagtcaactccaatgtcggatggatgatacccagacacatatgccacttccggaccatttgactttccattctctgccgggatgacgtgattaaacctgaaatctttgcgagtacgctggatagcctcccggccagacagagagagtag

SEQ ID NO: 628660 - DNA, 257 bp, Homo sapiens
  misc_feature (250)..(250): n is a, c, g, or t
gctcgagtcaagccggggtgcaaggcgaggtgtgcagatcatcgacgacgagcctcaagctcagagcagcggagggtgctgttcctccggctaactgctcagcctgtgaccctcaaaacataagagaactgtggatcattgccctcaacatgaagactgccatattccaagtcacatcattttaccaatggagttatagaattaacagtattttcaattacggtttataacactgcaggagaccttaagntgcaaac

SEQ ID NO: 628661 - DNA, 579 bp, Homo sapiens
ggggctcccagaggcccctgctttgttgcagtggcggatgctgacggtgagaagctgatgactcggagcacaagtacagctccacgccgctggactgggtcacgctggagaccaacatcgcctactggctgcacccccggaccagtgtaagcagagcgcttgtgcgcgcagagctgtcccgtgccccagactcccgtgaccttaggagcagccgtcgcatgtgaccgaggcccagccttgcgacgtctttcctaacaaaagccttggccttgcttcctccgagtgcttcggtggcgtggggccacagctcccacacagccagggcgtcaggtcgcagcgcctctgcagatcacggggaaccgagcttcactgcagacgcgggagcacgtggttccgcttctctggcaaatgtggtttggttttgttgttcggggcggggtgtattgttttgttttgttttgtctctttagggccgcacctgcagcatatggaacttcccaggctaggggactgcatcggagctgcagctgccggcctacaccagagccacagctacaccagatccgagctgcagttttg

SEQ ID NO: 628662 - DNA, 116 bp, Homo sapiens
ttagagtagtagattgcggtagtagttaggatactataaatagttaaattaccgaatggttatgttagggttgtacggtagaactggaataaaagctagcatgtatatttctaggc

SEQ ID NO: 628663 - DNA, 1312 bp, Homo sapiens
  misc_feature (178)..(178): n is a, c, g, or t
  misc_feature (219)..(219): n is a, c, g, or t
  misc_feature (295)..(295): n is a, c, g, or t
  misc_feature (980)..(980): n is a, c, g, or t
gctgggaccgaggagtcggagcgtgatccgagctttcagcgtcgacctgccacgccaggggccagggcaggatcagatcttagctccgggagactcatggagagcatcgcaggggagcaagcccgcactgagggagacggtggacactggacagcggggcaaacggcgctagaattcngagaaacacgtctagtaggcgagagtgggagccttgtacanggagtagctgtactagacgggtgtcgtgtaaaaatgagaagatcagcggcatcacgaatatggggccgcgtacgcntggcgggagagaaggaagtgttggatacggactagtgagcagcacaagattgaaagcgaggtgagtgttgcggtggccttggctcatggatgcggatcaagagatcttaaagcggttgtgaatggggagtctaggacaacatatgggtggggaccaaagatatataaatggtactggaagcatcagcgatggagattcagatgcatagcaaagtcattgaggttaagtgtgtgagcccatggggcatactttctgtgagcgattagtagcctaagcggggtgggggtggtcacacgcgcgcgtgacgacatgttcgaacgtagatgggggcagatcgacctgtgtaaacggaagcgccataagtttcgctagtattgcattcgggcgtggagaagaacacggttggatccctacaggtgtagtgctctcaagagtgccacaacgaccgtatacaatgtgttacgtagtccaaattggggcgtgcctcacccatatgccggttgcgggattataccacaagcttagggtggaactctggtcccagggcaagtttccattgtactctccttgttccatgctgggtggcaccccaagagtcctctttggcaaacgcgccatggtccattgccgccaattgggacgaccaggaagagtctaacaaaactaaccttccgaggggcgaggntcactcccacaagttgacccacaccggtttattgtgaggcgatggggcatatggaccacccccaaatgggtggcgttgctgggcgtggcccgactgcgtggtgggtttttgttcagtgcgagcccaaagaacaaattcttctaggacacattaaaacacaaatgttattttgccccctctagccaagctggttggttctggattgaggcaaacagcacccaattctcagaggggacggttggggcggggatacccacaaaccactcggcgagcgcagaataccaagcgcagttctgcattatgcgacaaagcaacctataagcgatacattc

SEQ ID NO: 628664 - DNA, 938 bp, Homo sapiens
ggtacaagcgccgttggggaagccagctgctggaggtgccgagtaatctgagtttcggcaagcaagccaggtctggaaactgtgagtgtgtgggcttactccgatcgatcgagcggtggcccctaggcgtaaacagatgcattcggcgtctccggttacactcgtttcataatcgtcagggcttccctcaaggccggagggtcaggagctggtagccttatgctcattactagacgctggatgggtgtcagtagggcaccaatcagagtctggtgccgacagggtgtaacttgttgcgcgctctctctaggcctcatacttcgctctcaactgttgatgcctcaggtcgcagggccggagaatccgaatcttggccgagctccatatctttatccacttggtggtagtccatgtcctcaatgtctcggcacgttgacttctgccctaaagatgggctttgtcttctagtctttttttagggtgtacaggacattcagtataagtcactgatggtgcagtgtgatcagtctcgcccgagatctcatcctaagtgtgcaggccagtgacaactagtacatgaagtgagccgtattcattcggtctgttcatgcaggtaggattacttatggaggggtctaggcttaggtggtgtcaatgttacaggtcgggtgtctgcgtgattaggaagatcaggtgctgtgtgcgatataggagaactcggtacaatgggggggtcagggaacgggtgagacattggcgggcattgggatgtattacggggactggcgtaggggccaggcgttcctgtgttcggacgtgagggttcaatggtgatataaaacagtgggggggtcagagaggctaagaggagcctttgtttataacacggggaaagaggcgttcttccttttctttctctattactaatttattaccgc

SEQ ID NO: 628665 - DNA, 156 bp, Homo sapiens
cgattgatggggctggacggtaaagtggaagtgagcacgggactgaagcccaggttgggggtgaagcctggagtgggactgaagcttgggtttgggggcaggtgcttagtagtagttccttcaagctccccctctttttcaggtgtcgatttccca

SEQ ID NO: 628666 - DNA, 129 bp, Homo sapiens
gcttttgataagtttggaagagaattttggatgtgggtacctgaaatgacttcaacactgattgtttacaagagccacagtatgtttcaattattaagatattatcaggtagcagcggctgacttttaa

SEQ ID NO: 628667 - DNA, 180 bp, Homo sapiens
cgcaaggtctgatggttttataaagggcttcccccttagcgcagttctcatacttctccttcctccaaccatgtaaaaaagcacttttttgcttccctttctgccatgattttaaatttcctaaaccctccccccccatcctgaactttaaatcaattaaaattcttttctttataaatt

SEQ ID NO: 628668 - DNA, 176 bp, Homo sapiens
ctagtttagaagtttcaatagcacctaataaaaaaagccccaaagcgaaacacctcaagtgtccatcaaccgatgaatggataaacaaaatgtaatatatccacacaatagaatcttattcgtcaataaaaaggaatgaagtactgatacatgctattgaaacttctaaaactagg

SEQ ID NO: 628669 - DNA, 127 bp, Homo sapiens
tttgtagagtagtggttgcttagggctagagattgggggaaatcgggaaatggggagtgactgctaatgggtatagggatcctttgtggggtgatgaacatgtcctagaaggaattgtcatgagggt

SEQ ID NO: 628670 - DNA, 785 bp, Homo sapiens
ctgtctcgtctgtgcagccggtgtggctgggcctgccccctccaagctgtggactcccataaagcacctgtggcgttggtggagggggtgggacgtaggtgcctcaaccagagccccccaaagcgggtcatccaagcctcagggttctcttccaagcctcccatgtgcctcttcgtcaagtgtgccccagctcgaaagacccttaagtcctcctttcttcagcctggacctggaccaagattgctctcgatcctgcgccgtctcccctcgtaggggctcctgggagtagtgatgctgaggtgcttgtcaccttgcctcacctcagtgccgttctctcctgtcgccccgagtctggggcctgtcggctagcctgctttgcttgccctctgctccggagcctctccccgcaattcctccccgagagtgtgggcctggggatcgtcgaggtctcccgtagacttcccctgtagacgtcgtgcagtcgttgttgagtctggatgcctcgtcaaaacatggggtcaatgcgaggccaacgaggaagatcccccgcgtgtctgcgagcctttcgtggggacttagaccacgatgaagtcagaagaccgatactcaggaatgtgtagtgtccaagaaatcagcccgggaaggctgcagcatctcctccccatggttccatggctgttaggcccccaccctctctggattctgcaggcccactggggttcttcccgggctgcgtgcactgaccggcggacgagcgggctgtggcatggatcgaacctcagtgg

SEQ ID NO: 628671 - DNA, 402 bp, Homo sapiens
tgagcgacacacgcatcagagtggagtccttggtccagcgtagggcagggtgtgggcaggccgtgcacggagcagttcactgactgcacggctgtttagaggtaaggaaagcaccttcccctcgctgagctctaggggtccagataggccacgcgcagctccagcgtcttggagagctgcacgtcatcttttgcgtcgtaatcctccattcttgcagccatagggtcccgttctggcccggggtcactccctccagggtcaggtttcccctcggagattcacattcaagcaatttcctcctgcttcattcctgaaggcggaaaaagtgtaatactcgggggctggggctggcgttccccgggcagagcagcttggacagtgtcaccctcttccccagcccag

SEQ ID NO: 628672 - DNA, 167 bp, Homo sapiens
tctcgatctgcctgacctcgtgatctgtccgcctcggactcccaaagtgctgggattacaggcatgactcactgcgcccggccccaataaatgcatctttatttgagtgtccatttaaacctggtcaccgaagattcccacaaaccatccacggtgcgttggcccaa

SEQ ID NO: 628673 - DNA, 160 bp, Homo sapiens
ctcgagctctgtacccatggaagattggagaaatttgcttcctcgaagtctatataaggagcatttacattgaactaccgaaaccttggcaatctcacggtctcatccgtcgggtttggctgtatggggatgagtcagagctatggtgcgcccgccgaaa

SEQ ID NO: 628674 - DNA, 1029 bp, Homo sapiens
acaaaagctttttattgaacgattcacctgcagatggataagagggaatgagaaggagtcaaaaggggcacactaagtggttctcatcctaagcttgcagggccaagtgctcgccgggtgtgggcaaaagtagtttgggttctgatgtagatggcataatacaggatctagtgggcagagtggcatgtggacgtgggaagggacattagtgtgaccccaattaacttcgtggaaagtgacacctccgtggctcatctttgcttctcgtgcccagtgggagggtgagaaggctcagcgtgaccattcctatccacatatccagaggtgggttacaaccaggaccgcaaatcaagcaagttagtctacacaaactctccacagagaggcagaagctcccgtggtccacagcaccagaaagaatcaatctcgtggggccagaagaagaagccccgagtgggaactaaagtggcacgggcgcataactcagctcaagacagggagaccaccgagaaaacaccagcagcgcatgcgcagcgctgcacagggcaaagtgacagccccgagcagcaccccaagtgcgtgtgccgccccaacgctgtcgacgaacaaacagtgagaacgtcgtgcccagggggaaccccctccggacagactacacctccaataagacgacaaccatcgcggggacacacaagggggcagagggcctcgccataaccaacgaaacgtggaacaccacatgacaccgacgtgggaacaacgtggcccacagcacgcaacagcgtagggcgagagagctaagaagacgtgcctagaaacgcgccaaggtaacacgaaggaagcggcggggaagcaccagaagggcccaacgcatagtatacaagcgacccaaaacacgccggggacaacccaacgcttcatcctgaacatcaccatcggaggctggcaacagccctccaccagtaggtcctgcggtagcgcaccaccgggcagacaatcccaccaagcaagccaagtgctaacaactgg

SEQ ID NO: 628675 - DNA, 825 bp, Homo sapiens
gacataataactacactcagaggaccatggaggcatgagggatcatggtttcaggccactgaagactctacgaggccagagaggactagtgcgatggactgatagagtcaggcgatgccctcgaaataggctgtgattttctcttccaggagatgtaaccttatcccctatttgcttctgacctgagccagatggaaatcagaaagtctcctgtatcatggagctgaagaggggctgctgtcttaccgaatgttctccatttcacaggcgccagctgcttgcccggggtaggtcttgagaagacacccgaaagtgttcatgcctcagaagaggcagcgagaatgccttttaggacaattctccgttagagtagttgggaagttctatagaagtgtgggtgaagaagaagcagtggtttctctcttttctccctcagtttcatggaggtgttaatgatcatggctggcgcgtgatgtacacgagtgggctgattatcgattttttacagtttcatagctgagaaattcagctatgtttcagtagaatcatcatattggaaagcagacattgaaagttgtcgtatttctatcttagttatgaatgtgctatggaccctttgggagacttctattgggtaatattctatgtgagagaaggaaacttggtatcaaatgtcgtggaagagatggtaagtgatgagtaataataaagtatatgctgcgaatggtgtactggccaatcagatgcttgggagaagcacagtctatgcaaatccaacgataaaaaatttaattgcttatcgaataaaacaggactgtgccaata

SEQ ID NO: 628676 - DNA, 1081 bp, Homo sapiens
  misc_feature (304)..(304): n is a, c, g, or t
  misc_feature (397)..(397): n is a, c, g, or t
  misc_feature (407)..(407): n is a, c, g, or t
  misc_feature (511)..(511): n is a, c, g, or t
  misc_feature (744)..(744): n is a, c, g, or t
cataatatgtggacagagcgatcatcgggtggagttgtacagaaaacaggaaaggctgttgaatacttgcatgtgtaaatccatctaagggtacctataccggcagagatgtacctgtgtacaagagaatggtagggcgtacaagtccagatgccactgactatggcatgaaccactggcgttgtaacaatcacagtgcttcggattattgaggtaactgtgtcatagaatgtgatggtagcaatgattaccgtatggtccattcgtgctgagagctctaatgacggggcatgagttgtgacanagaatgctcatctcaactatgtaattgccgcgcctgaagtaagaggaattaatggttccgacttgcggtagatcggctgagatctcgtagcantcctcgccantagtgtgtaccctcagaagggaagtggccagtcatcggggagagcaatcacctggtagtcacattagaggcgcacaagggtaagcgtgcattatgctcgcatgntgtcattctgttacatgcaatcgcataccattcaagatatacaggtaaccacctggggaatttggaattttccatggcataaacgttatgggagaccatcattggtcactcttttgctggcactggggtataataaggcttttgaattccttggagaggatttacgtaaataacccctggtagaagttcactccaggtaatacttgacacatttcacggaaaccatttaacangagagttgcgaacaaacccaattatatagtaggagcaagttttggccccgttgggcccgagccgagtttgtttggcggttactttgcaagtaaggacagggggtgcttttttatacaaagacacacgcttgtttaccgagggttggtggcgcgttggagagggggttgtaaccataagttaagaagtgtggaaacggaaacagccatggcggtgtttaagccagaaggacagtgggtttcacacgtgtcgagagagggaaaactgcaagaggaggagggtttaaggtagtccaggggagttgagtttgtaggggaagagctttcatttccccaaagg

SEQ ID NO: 628677 - DNA, 271 bp, Homo sapiens
gggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgttgggattacaggtgtgagccacttcaccaggcccattttctcctaa

SEQ ID NO: 628678 - DNA, 370 bp, Homo sapiens
aaacactctttactggagccaaatcacgcactttgagcgtaacaaacgattgtactgttcaagcatggataaactcattttattcgtcattatctgattaacatttaatagtttcatgcaccttgctatagaggccctctaaatgagtgaatagacagtgagcctcttcatacaggctgggctgattatgatcagagtatagaaggtaattccacattttatttcctgaaaattcagggtctatctagtggacagtgattagagtaatactttttcacatttccaaagtttgcatgttaactttaaatgcttacaatcttagagtggtaagccatgttttacactattgaacttatatagcggtgagggc

SEQ ID NO: 628679 - DNA, 153 bp, Homo sapiens
aggtactcatcattatcttattattaacaaaataaagccctttctatgtttacagtcataaaaaaagaaacagcctggaaagaagtgggggctttgaggatggagagaaaacgggggcagacacagactccacatttggccctgtgggatttg

SEQ ID NO: 628680 - DNA, 237 bp, Homo sapiens
gactcctgtgaactgagagccatgctataaccagctatacatcagctacaaagtctagcacaagttttacatatagcaggtgttccataaactttttttttttactctgggagacagggtctcactctgtcacccaggctgaagtgtaggtgcatgaacacagctttctgcagcctcgacctcccagggtcaaacaatcctcctatctcagcctcctgagtagctgggaatacagag

SEQ ID NO: 628681 - DNA, 1033 bp, Homo sapiens
  misc_feature (1011)..(1011): n is a, c, g, or t
atgagcggagtttatgtgtgtgtgggtgtgtacgacattaaccgtttgccacaatgttcgatcgactatgttgtgatttgcgcttatttggccccggtggatgaatgtcctagggctgccctcgtgatggttcaagtctggaggcccggcgctagtatgatgagcgggaaaggaaatccacgctatcgcatttcatgcaattgccgggtgtcgggggcctcgttcaggccaccgacgatgggatcagttgacctggcccggcgtccaagccattcggccatttcgtccctgatgcgtggtcaagggtggaagagtcgcagtttgttgccggcaattcaggccgtggaaatgccccttcatgtctaagactggaaaccctgtcatgcccctgtcgcgacacatgacggccattactgtttgaccgataggtccgttgcgggcatgcttgcgcagtggtctcgcacgcctgtgatggcctagccttctgatgcccggtatccctgtgcacgggattccgagtggcttgcaagccagcccaggagcgacacaggagatgtgtgacgcctcgcatccgagaatgcaggctcatagctgccgcatttgccattaggctcgcccaggtgtctgagcacagcactctactcaaggacgttctaccaaggcagtaaatagcccggagcacgccatccaacatcggtgctgcagctcattgctagcggccgcggcgagagtccagcatcgcatgcagcgcaaggttctctaccgcctcaagtgagtcgcgccgcctgcactggacgtcatggactcggcccactgccttcggcccgctcctgccagctagtccatgcgcatgtgacaactagttgcatgggacctctgcctccccactgcagcccttcgaacttcccaggcacccttcctttctgccccagaggaaaggagctgtagtgtcctgctgcctctgggcgctacgcctctagcgcaggttctgggaagatgtgcataatgcanggcgtaataacacagggtgtcg

SEQ ID NO: 628682 - DNA, 134 bp, Homo sapiens
ccccattgggttttttttttcccttttttggttccgcttttacccggggtggaaacccccatttttggtcctggccgggggggtttttttttaatggtccccttcttttttattaaccggtggggggcctccca

SEQ ID NO: 628683 - DNA, 465 bp, Homo sapiens
  misc_feature (12)..(13): n is a, c, g, or t
  misc_feature (431)..(431): n is a, c, g, or t
cagattatagtnntagaaacaaactgaataagaaacatctcatgcaaaaactggcaaattggcagatgtcctttacatacatgcagcgtgcaagctaaagtcagtaataacccatagaaaccaaagaacaggcaggtcatagcatgccctctttactcacatcgcgatgacaaggaccatttcactggtcatcaacgtttttgtttttcgtccatcaaaatcagcatgccttaacaacactggagaaggtgtggggtgaagggtcattaagggcacgcagtagccataatgccacaccctttgtgccagccactgcgcttctggaaacctaccccacagcggtcaaccaaaagacagcaaaggcttctggcactaagctggtcacaaacgcattactaattattgtgcacatgtggaacctaccatctaancctcctttctaaggcgaaaattcccactactaca

SEQ ID NO: 628684 - DNA, 87 bp, Homo sapiens
cataaaactaaatataaaggatcgcaaaggagactgatcatgttaaaataaagttgatattttcaaaggttttatgatccagtaaac

SEQ ID NO: 628685 - DNA, 400 bp, Homo sapiens
gagcgtgactctaaggatccccacctcctaccacgattaagtcagcttcatccctgcggatggtggctggttcaaactactgccaatcaataatatctaactccatcatattatacatgaatctaatcgcacataaactccaagattatctcaatagacgcagaaatggccttcaataaaattcaacatcccttcatgttaaaatactctcaagtaaactaggtattgatggaatatatctcaaaataatatgaactatttatgatcaaaccacagtcaatatcatatcaaatgggcaaaagctggaaccattccctttgaaaaccggcacgaggcaaggataccctctctcaccactgctattcaacatagtattggaagttctggccagggaaatcaa

SEQ ID NO: 628686 - DNA, 510 bp, Homo sapiens
  misc_feature (269)..(269): n is a, c, g, or t
  misc_feature (315)..(315): n is a, c, g, or t
  misc_feature (320)..(320): n is a, c, g, or t
  misc_feature (335)..(335): n is a, c, g, or t
  misc_feature (361)..(361): n is a, c, g, or t
  misc_feature (387)..(387): n is a, c, g, or t
  misc_feature (393)..(393): n is a, c, g, or t
  misc_feature (407)..(407): n is a, c, g, or t
  misc_feature (410)..(410): n is a, c, g, or t
  misc_feature (414)..(414): n is a, c, g, or t
  misc_feature (423)..(423): n is a, c, g, or t
  misc_feature (431)..(431): n is a, c, g, or t
  misc_feature (440)..(440): n is a, c, g, or t
  misc_feature (442)..(442): n is a, c, g, or t
attccaaaagagttccttaacaaagttttatgacccagaatgaaacaaaacaaaacattggtgttattgagggaattaaatctaacattgagagaaatttggatttaagaaatatgttatttaaaaagtatgttacagtattaacatctggcaatatataatctattcagtcctttctagccatttgttggcaagaaataataattaaattttttattaaaacaaaacttttttcattgggagttattaagagcgcctccttttggtgnattcgttacaaataaaaatgaaatatttattttgcatttttattgngcttnatgttggttgcttanagttggtctcttgggcttaccttccnagttgggagatggggaaagtgcccantggaangaaattttaaaagnatncttnttgggaggntgaaccanttttttttncntttataaggggaaagcctgccaaagtttgtcatacaggtttacgtccccttttaaaccaaaaatacaa

SEQ ID NO: 628687 - DNA, 676 bp, Homo sapiens
cccccagcctcgctgccgccttgcagtttgatctcagactgctgtgctagcaatcagcgagactccgtgggcgtaggaccctccgagccacatgcaggatataatctcccggtgtgccgttttttaagcccgttggaaaagcgcagtattagggtgggagtgacccgattttccaggtgccgtctgtcgcccctttctttgactcggaaagggaactccctgaccccttgcgcttcccgagtgaggcaatgcctcgccctgcttcagctcgtgcacggtgcgctgcacccactgtcctgcgccccctgtctggcactccctagtgagatgaaccctcagatggaaatgcagaaatcacccgtcttctgcgtcgctcacgctgggagctgtagaccggagctgttcctattgggccatcttggctccaccaccctgagatagggtctcactctgtcgcccaggctggagtgcggtggcgcgatcacggctcactgcagcctccaactcctggactcaagcgatcctccctcctcggcatccctggactataggcgtgagccaccgcttacgggcgaagacttgcttgtcccgttgtccttgccatctaagtggagagcctacgactagattgcatctttacgtcctgcgcggaggctgtacacacttgcgaagtctg

SEQ ID NO: 628688 - DNA, 883 bp, Homo sapiens
  misc_feature (439)..(439): n is a, c, g, or t
  misc_feature (607)..(607): n is a, c, g, or t
  misc_feature (641)..(641): n is a, c, g, or t
  misc_feature (667)..(667): n is a, c, g, or t
  misc_feature (700)..(700): n is a, c, g, or t
  misc_feature (718)..(718): n is a, c, g, or t
  misc_feature (748)..(748): n is a, c, g, or t
  misc_feature (760)..(760): n is a, c, g, or t
  misc_feature (783)..(783): n is a, c, g, or t
  misc_feature (840)..(840): n is a, c, g, or t
  misc_feature (846)..(846): n is a, c, g, or t
  misc_feature (858)..(858): n is a, c, g, or t
  misc_feature (877)..(877): n is a, c, g, or t
tctctctctctctctctctctgctgctactactccatctaatgctcctgtctgagctctcgttgaacgcatcatgctgcgcgttgcacgtgcgcttgatttcgtggcgcattgcactactacgtccagcgtcatacaactgcagacaacacaagaggtatacattggctcaggtgtacttgcgggctcgtatgcgtgcgatgactgagaaggcaacgacagagagtagcggacgtagctatgcgtagtgtgagataatcaatatttcaccaagcaactcatctattcatagacactacacagcatagggaggcatggtagggataggccgatgtagatagatctgccctactagagataccgatgcatcgactccgacgtcacactaatgcatcgatgtgccctcatcgtcacgaacgatctgcaggacttcacaagtntgagacagtgacgacttatgggctacggtgactacaggagtagtgcggtcggaggcacagtagagtcgtaggacgcagtagtacaactagtaccactcatacttctgaagcactaatccatccgttgctatcgtaagtttgctccgatactgctatagttcgagtttngcttttgattggcaagatatgcgaagtgtgccanccagctgcgatgttctgattatgcgnacagttactgatgccagtgtgatcgtgactccngtgagtagttgaccttgnacactttcgtcttttggaatcgcacaccgnctctgtgacacnatgcgtcgatacactgggagttnactgcggatgaaacacggaagagcagacagacagtgcatagtacacgcatattagcnacgtgntacaaatgagancacacacggagacgtgtancatctg

SEQ ID NO: 628689 - DNA, 445 bp, Homo sapiens
gaggaggtattataactcttggaaagctggaaattctactgtatgtaattctctataaagattttataacttgtctttaattaaattgtaattacaggccaggcatgatagctcatgcctgtaatctcaacattttggtaggccaaggcaggagaatcacttgaggccagaagtttgagatcagtctggataacatagtgagacctgtctctatttatgtgttaaaataataatagtagggataataatcaattgtaattatagttattcctaaagaagttgctttagatatattccttaaataaggttttaaaagtgaaaatttaccttaaatctttttttgaaaaatgtcattttcagatgatgcacctttttcagaattactttaaacctaccgttcgttatggctatgaaggtgtttttttttccctttaatttgtgagca

SEQ ID NO: 628690 - DNA, 879 bp, Homo sapiens
  misc_feature (117)..(117): n is a, c, g, or t
  misc_feature (119)..(119): n is a, c, g, or t
  misc_feature (124)..(124): n is a, c, g, or t
  misc_feature (126)..(127): n is a, c, g, or t
  misc_feature (129)..(129): n is a, c, g, or t
  misc_feature (150)..(150): n is a, c, g, or t
  misc_feature (155)..(155): n is a, c, g, or t
  misc_feature (170)..(170): n is a, c, g, or t
  misc_feature (294)..(294): n is a, c, g, or t
ggggggccgtgctcgagtaggaggaggacaggcctcagtacatcgcttgagaagggaggataaaaactttcagaatgagcaaaacaccatcaacgttaattccagagatggaacatngngtttngnngngagaaaacaacccatttgaanagaanaccactaatgagaanaccactaaagagagacatcaagaatggattcagcagaatcatttcacgttttgaacagcagcagtttgagagggcaaagccttgatcagggatcagtcattaaaggagggggggggggtattantaaaccctcttatgatgattagaagagaagggcagccctctccaccttttggtactttctattcaacttgcactgaccataaatggttctcttctgaacaagccccatcattgggtgaacctccaccctaacaaagtaggatgagggtgggggctaaattaattggagtggggcgaggagagagccagaaaacatagatccgagggcagcagtgcttgggggagaggaccaaaaaacagattctggagcagcaagcctggatgggaatttctaagctggggcatggtgggtttggctttctttcctctttggatatgaaaagctatttcattataacttgttatggggggttttacaggcgaggagacaaaagggggggaaaatgtgcctcttctactgggaaaatgggttatgataccaaggaggataagggtgtttgtgaattggagggcgccttgggtgataaacctttatggggggaactgaaatggtacttggcgtacttcagataggagggtagtttctgggcgaggagaagagaaaaagtctaggggggaaggagcaggtgagggggcgtgtgggggc

SEQ ID NO: 628691 - DNA, 959 bp, Homo sapiens
  misc_feature (9)..(9): n is a, c, g, or t
  misc_feature (74)..(74): n is a, c, g, or t
  misc_feature (86)..(86): n is a, c, g, or t
  misc_feature (94)..(94): n is a, c, g, or t
  misc_feature (101)..(101): n is a, c, g, or t
  misc_feature (197)..(197): n is a, c, g, or t
  misc_feature (199)..(199): n is a, c, g, or t
  misc_feature (204)..(204): n is a, c, g, or t
  misc_feature (206)..(207): n is a, c, g, or t
  misc_feature (209)..(209): n is a, c, g, or t
  misc_feature (230)..(230): n is a, c, g, or t
  misc_feature (235)..(235): n is a, c, g, or t
  misc_feature (250)..(250): n is a, c, g, or t
  misc_feature (374)..(374): n is a, c, g, or t
ctgtcaggnccaaaattccttccagtgttacctgaagaaacatcccatccaaacccttcaaatgactccccctnctggaccacccnttatatgncactggntcaatcatgccaaacagtgtcattcttcgaaagggaggataaaaactttcagaatgagcaaaacaccatcaacgttaattccagagatggaacatngngtttngnngngagaaaacaacccatttgaanagaanaccactaatgagaanaccactaaagagagacatcaagaatggattcagcagaatcatttcacgttttgaacagcagcagtttgagagggcaaagccttgatcagggatcagtcattaaaggagggggggggggtattantaaaccctcttatgatgattagaagagaagggcagccctctccaccttttggtactttctattcaacttgcactgaccataaatggttctcttctgaacaagccccatcattgggtgaacctccaccctaacaaagtaggatgagggtgggggctaaattaattggagtggggcgaggagagagccagaaaacatagatccgagggcagcagtgcttgggggagaggaccaaaaaacagattctggagcagcaagcctggatgggaatttctaagctggggcatggtgggtttggctttctttcctctttggatatgaaaagctatttcattataacttgttatggggggttttacaggcgaggagacaaaagggggggaaaatgtgcctcttctactgggaaaatgggttatgataccaaggaggataagggtgtttgtgaattggagggcgccttgggtgataaacctttatggggggaactgaaatggtacttggcgtacttcagataggagggtagtttctgggcgaggagaagagaaaaagtctaggggggaaggagcaggtgagggggcgtgtgggggc

SEQ ID NO: 628692 - DNA, 421 bp, Homo sapiens
  misc_feature (239)..(239): n is a, c, g, or t
ctcgctgtgctggtgccattttgtgctagtgagcctgataaaacctggcccggttctgtgtgaaatgtgggcgggggagccatggatccctggaatggctggagactctgtcagtgcctagtgtgattcttggagctgtgtgtgtgcttgctggctgtgctctgcagctcctgcctcgtacagagacctgggactgcagtgctgccatcagctgacctagctagatggttgatctgatncttgctgtggctgtgatgcttgatgtgaaactgtgaatgtaggactctgagctgtggaaaccaaggaagctgttatatgattggagctgtgattgaaagaagtgcaaatttgaagatgaaagtgttggtaaatccttgaccgaaaatatgaaaattaccctcctgatgtgtgaacacaagag

SEQ ID NO: 628693 - DNA, 190 bp, Homo sapiens
  misc_feature (138)..(138): n is a, c, g, or t
  misc_feature (151)..(151): n is a, c, g, or t
accgggtagcttggccaggttgtgaggaaccgcagcgccgcaggaccgggccgctgagcctgcagccgccccgcccgtgacctgcgaccctagaccccgactccctttggctcagccgcgcgccccaggccggcccgnggcgcgacagganggatgagcggcgggcggcggaaggaggagcgctcagccg

SEQ ID NO: 628694 - DNA, 347 bp, Homo sapiens
atggagttgctgtggttcaaacgcttctgaaaatttcagagttctaggaaaccaacaatcaggcctcccacatagatcaaggaattgaaacttaccagatcacttcatctggacaatgagatactagacaccttacccatcatgagtgcctaagcgaccacctgctattgggttaccagctcctcttccatatccctccctaattcctgttttcccacacatgattacatttctttccagctatacaaactcttaattttagtacattagggagatggatttgagactgacctcccttctccacagctgcaacaaccaattaaaggcttcttccctggcaaaaaaaa

SEQ ID NO: 628695 - DNA, 205 bp, Homo sapiens
ttgatatagaggatccccctagtttagaagtttcaatagcttacataatataatgtaaatgctatgtaagttctattttatttatattattttattgttgtactgttattttttctaatattttctattcacaattggtcgaatccacaaaggcagaacacacagatacagagggctgactgtccatatatgtatatgtacatat

SEQ ID NO: 628696 - DNA, 227 bp, Homo sapiens
gaaacgtttaccaagaaccttgatgcccaaagccatacccaatactaattaaattaaaatgtctcatgtggaagatgaggcagatattaaagcttctcaggcgattttaatgtgcagcaaagtttgagagccactgcttaatttgagtttaggacgagaaactgctcctatttggtgggaccttgggcaagtcagttttaaggtttgtttccctgatctgtaaaaca

SEQ ID NO: 628697 - DNA, 871 bp, Homo sapiens
aaatgccaaaataatattttcataaccttttttggtttgagacattgctgatacctttttatgtttgttttccagagtcaagaaaatgtttttttcttttgagctgtacatagcttacagtaattagataaattacactttgtgagaacaattgaaacactaacctttctctctacctgatgtctccagaatttggaaagtatttgtgagtattcttcactttggcaatatagttatttgtacaaattcgataggaatctgttttcttttgtaacagaacacagttggatacactgattattttgccaaggctttcattggaatggcataattttttaatgaccagactgctttgaggatttgaagttgactttatagagcctataaaaagcctgttggaaaaattagcctgataccttgtctacacagtttccttacaaggttcctgaccttgcggtagtaaagaatgtcactctctggcaggcccaggagcctcaggatatttgggaaccttgacaagagaggagtgtatccaatttatacaggattaccagtgcgctgattgtgaatccttgtttgggttttagctgagaattttaaaagtgatggaaatccttttgaaaagtccaagaagggcaaatttagaagaggcctaatggggcaaaacacatttggggtggttttcgcatatcggggcgttaattaagttgaaatttttggaaaagggcgcagatggcttacaacaggggtggggagaagaattttcaaaaagaccttgggacacgactgaggaattatcaaagatatggtgacaaaattattggagaggaaatttatgacgtactcatggtgtgtattagtaaataatata

SEQ ID NO: 628698 - DNA, 144 bp, Homo sapiens
  misc_feature (84)..(84): n is a, c, g, or t
ctttttttttctttttgtctgttagttatttctccaggggaaaaggcaataattttttaagacccgtgtgaatgtgaaaaaaancagtatgttactggttgttgttgttgttcttgttttttatagtgtaaaataaaaatagta

SEQ ID NO: 628699 - DNA, 1382 bp, Homo sapiens
gatactgaggaagatgaacccacaaagaagaaaactatccttcagggcatccagtgaggtggactggtctatgtctgctcttgcattctcgcctaacacttacaatgaacctgactgatgaagagagaactaatcagggttgctcctgaccccatgtccattctcccgcaaaaccctcggcactggtttcgcccatgatagctacacgcccatcacagaacgtgggcttctagagagcacaaggacattcctctactatggccgcgctggttgatgggcaccatgaacctacacaactacgctgtcagcccatcgtgcataatcaaaggctagcatgaccaaagagtgcttgcctcttgacgaatggtgcacaaagcgatgatcgacgcaagaaggacgaagcacgacaagatgatagcaggacaattagatccccgcgcaaaactgtatgtacatcacacgtccctgtgaaaaggcatgagaccgatactgagagattgagaccactactcgccttatcccagtcacccaactgataccactggaagagcatgcctcgcaggacaacggaagcacaaggagtccggctttttccaggaactggaatgcatcgcctcagattggcactcccccatttggaaggtctcaggacgaatgggcaacgcaagcgctttacacacgatagaggagcacccccatatagcgcgattaggccttaccacgtccatagggggagaatatgaatctaaaacaagtgataaacaagaacttccaagaatttttggacgcaacaggttactaagggtcacgaattgtccagacatggacacaggatttaggtggacattttaattctaagtacaaggggagtaatcaaatttgcatcacacgaacggtgaatgggggcctaaacactaaattccatttgtccaaccaaggggaaaccaccacggacatccggcctgaggattacaaccactcacactaccagatgggaacaacaaatattggaacccccactaaggaattgacgccataaccctttacaagaacgaaaattgcaacgcaaaatagcacactatgataaggttacggggcacaggcgaaggcgcacagaaaggaaagaggaatacccagcaagggagaggaaccaagacaaaaccgtacaaacgtaatcggagagacggcagtacaaaaacgcggtaaataggacaaccaatgcgctcccatgcattcgaggaaggcccgccaaagtccaccatcggacgtttagaaccacagatgtcagaggataggaaacaggaagagacagtcaaaacaaacaaggagagcgtacaatagccacagcaccaacatcacgacatcgggctcgaatggagacc

SEQ ID NO: 628700 - DNA, 102 bp, Homo sapiens
acgtgacgcgtgagtgtatgcgcgtgcatgcgtgtacatgtgcatgtgtgtgtatgtcagcctgcatgagattgcatgagtgcatgtgtatacagtgtgcat

SEQ ID NO: 628701 - DNA, 390 bp, Homo sapiens
agggctgaggactaaaagttctgaaaaagtagagggaacgctgcaatactaaggtggaattcctgagtgagggttaaatgccaaatatagaatattttcttccccaaatgaacagttttctgtgctctgatcatccccatgagcctaatacatttttcaagtcatattttaaacacaaaaaagaggccgggcacagtggctgacacctgtaatcccagcactttggcaggccaaagcacgcgaatcacttgaggtcaggagttcaagaccagcctggccaacatggtgaaaccccatctctactaaaaatacaaaaattagctgggtgtggtggcacatgccggtagtcccagctactcgagaggccgaagtgggagaatcacttgaacc

SEQ ID NO: 628702 - DNA, 1079 bp, Homo sapiens
tccggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaacaaaaataaaaaaaaaaagctggtctaatggattggcctaaaaattgcagggagctccaaagcaacattgtggaccgtgtcgttcctcaaataaaagctcgagggatacatccgtgaagtccgttaagtgctggccacatttgaggggcaaactttacaggcttcatcatttcgggacattctacgagaagcatcccaggtgaattggcgtataagacctccagaaacactgctcgttctcatggggatctaccggatccacaaaccgttgggattaacctccatacgggggaggtttacactcaatcatcccctgttactccaggtgtaatgcaacaccctttgaatgtaccatacaacttgctccaaatcacaaggcaccttactctggacaaatgggcaaagagtgagtaaaaagccatgcatggggcccccacaagtatggcaactatgcaattggcgggggccagccaggttatcgcggggccaaaccatcgcacaagggccctaacagagggataccaagagcccggcgcgacaacagcagaaaacacggttcccatggagaggcgaaaggaagcgacagccacaccggccacagccgttatcacaacaaacacaaagggagtgagaacaacaagacaggccaaagcgcaaacaaccaggtggagcgggcaccaaaccggtcacacacgacaaaatcagacaggcagcgtggaccaccaccagctac

SEQ ID NO: 628703 - DNA, 716 bp, Homo sapiens
tcgatctagaggatcccgcccaccgacggggtgaggatggatgaatggatgagtggagggtagatggatgggtgagtagatggataagtggatgagaagttgggtggacaggtggatggatggatggaagaatgggtggatgggtagacaggtgagtggaagagtgagtgaatgggtagttgggtggatagatgggtgggtgagtggatgggtggatggatgaatggatggatggatggatggataaatggccaacaacttcaaatcccaatgacggactggtggggtgggcactggagacggaaacacataggtgcacaggtctgttggtacagaacatgctcaccagctcattcccactggcaatggacagggagagcggggagtggccactccacagcaggttaggatttgctccgtgggatagaaggagccggactatgtccctggcacactgggtggagcgctccacccgacggggtgcgggtgcggacagctgttaaaccttaattcttggtcggtctgtcggcaactttgggaaccaccagtaggatgtggttaagattcagttcttgctgagctaaggaagcattctcatttcttttaattgtctggctcattctagtcctaattaatgccaccaagagtttagttgatgtcaatgtcacaaattaggggtgatcccccattcaggtaagagaaggaaaatgagtgcc

SEQ ID NO: 628704 - DNA, 417 bp, Homo sapiens
ctgtgatgtgaagagtgagctgaactctcatttccccaacagggacctctttttatggcaaaacgcagcaggtttcatctcgtcagggaaaagggatagaaagtggaagagaagtcgacctagtaaatgagggtcgatagcgggtggttgaggagagggaaggcaatgagcggttgtcgtcgagatgcgagatagaagtctggcagctagaaggcagattgtagcgacggaacccctagtgctctccctgcttttttttgttgttgttgttgtgcttaatgttagaaaataacattactactatggaacgaagagaatttttttttcaaaaccatgtcttgccattacagatgagacaaggcaaccccatgctaatacgctgttgaagaaaaaacaaaagttttttttcccttccaa

SEQ ID NO: 628705 - DNA, 259 bp, Homo sapiens
tccgtgactttgccaagaacctcagtaagtacgctcaaaccatacggtgaaggttctacgctcaaactcttcttccctaaggccaagccactatcatctgatgtgatagggatgggtactggttggcagaaattaatcagctcccaatgagagcccacggaactaagtagggtcccaggaaaaaaaacgggaggtattacacagagctcagcttctgccaaattacattcctcaaacctttagagagggtaaatagggg

SEQ ID NO: 628706 - DNA, 182 bp, Homo sapiens
tcctgatagagcataccctgtatcaaatggttcttttttttcggagtagtaagtacaatatgttgagattattcctgaagcctggtaggataagaatataaacttcagtgtgacctgaaaaatcagaataggcgttgggatagaaatgtggtctcctccctccgggcgggggtcgaaagaaa

SEQ ID NO: 628707 - DNA, 160 bp, Homo sapiens
tcactggcatggacgtgaatggcaggtacacggccgaacgggcccagaggtgctggagtatctagggtaaccctgctaattacccggtgtccattcgatttggccggccccgtctcacttctaatgaggagcttacgcttggcctacagcacatgccgaa

SEQ ID NO: 628708 - DNA, 121 bp, Homo sapiens
aacttgggactctgaggactgtgcgatgtacgccgcggcgcccctgctgtctttgcagttggggtgtagcgtgcagagaagtgtcctagaagaccccggggcgtgattcaaaagctctcga

SEQ ID NO: 628709 - DNA, 427 bp, Homo sapiens
  misc_feature (32)..(32): n is a, c, g, or t
  misc_feature (74)..(74): n is a, c, g, or t
  misc_feature (91)..(91): n is a, c, g, or t
  misc_feature (95)..(95): n is a, c, g, or t
  misc_feature (128)..(128): n is a, c, g, or t
  misc_feature (172)..(172): n is a, c, g, or t
  misc_feature (200)..(200): n is a, c, g, or t
  misc_feature (271)..(271): n is a, c, g, or t
  misc_feature (281)..(281): n is a, c, g, or t
  misc_feature (301)..(301): n is a, c, g, or t
  misc_feature (313)..(313): n is a, c, g, or t
  misc_feature (414)..(414): n is a, c, g, or t
tctgtgtctctctgtctcttcagatgtctgtntcaccagggagaatgttttctgaagcctgtccaggaaatttngttctaagaacagcctnctantttgagcatcttcagggataactcgtgcgatgnggctggcatgctgtccacagacagtggcaccatggcggtggggngtgcggcctgccttcgtctgccggggcngccgtgacaaaggaccacaggctgggccgcttaccccacagaaatgttttttctcacagttctgggggctngaagccccanatccaggtgtccgccgattntttttttctgtntctctctcctgggcttttggttggccatgcttctttgtccgtcctctcttggtcttccctctgcacacttttgtgtgtcccattttcctctttttaggtcncctgttgttttgg

SEQ ID NO: 628710 - DNA, 361 bp, Homo sapiens
ctgcactggttccatcgccctgcttgtagcctgttgtcacaggctggtcatgcgacgcttataatctctagttgaacctgatgacgaaacctgagcgaggagacaggccatggatttgcaaaacagcagcaacaaccagattccggtgattcgtccctgcccgcagaaattgggctgcgcgattatcgacgcacagggccgtgaagtgccgatcaccgaagaaatgatccaggacgcctgccgcgaactggaacagcgcttggtcaagcctgctgagcaagactgacagccctaactcccccttgacccggcctcgctgccggtttttttatgcctgcgtctacaacaggacagcccccag

SEQ ID NO: 628711 - DNA, 364 bp, Homo sapiens
gttgacatgatacgaatcgagctcgtgtacctgtgggtatcatcaatacggaagggtccccagcgttggggagagccccaagcttgagaacaagtaagtgaacacattagttgtactgaaccacttgttacgatactgctagatcacaaacaacctgtgtgtaatattatttccttacacaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 628712 - DNA, 483 bp, Homo sapiens
  misc_feature (48)..(48): n is a, c, g, or t
  misc_feature (104)..(104): n is a, c, g, or t
tgggttttttttccctcgtgtgtgtgtgtgtgtgtgtgtgtgtgtgtntgtgtgtgtgtgtgtgtgttaatgagaccaaggtcttggcttctgtcacccagggntgcagtgcagtgttgcagtcttggccccatgcccccaccgcagcctcttggaatagctgtcttgcaggccaggcacggttagtcacgcctgtaatcccagctcttagggaggcagaggcaggaggatagcttgagcccaggagtttgagacctgcctgggcaatacagtgagaccctgttctccacaaaaagaaaagaaaaaaaagaaaaaaaaattttaaaaatgcaaaattaggtgggcatcgtggcacgtgcctgtaatcccaggtaccccagaggctgagacaggagaattgctggaaacctggaggcagagcttgcagtgagctgagatcacggccctgcactacagcctgggcaacaaagtgagacttgtttc

SEQ ID NO: 628713 - DNA, 162 bp, Homo sapiens
ccgcagctctggaggctgaggccgcagacttgctggagccctaaagggggcggttgctgggcgccaaggcatcacgagtaacgtgtatgctcagactctgctgacaccaaagtattttaaacaaataaaagggctcggggaattctgatgtccgtacggaga

SEQ ID NO: 628714 - DNA, 1610 bp, Homo sapiens
  misc_feature (175)..(175): n is a, c, g, or t
  misc_feature (632)..(632): n is a, c, g, or t
  misc_feature (676)..(676): n is a, c, g, or t
  misc_feature (745)..(745): n is a, c, g, or t
gcggaatagagaacgcagctcagcctcatggcgtgtcgtgtggtacccggcttgggcaggacgatgagccctagaaacagtgctgcgaaatcctcatctgcgcaggcgccatgaccagggaccaaagagtccagtagtccgcacccaagtaattagcgggtagccgctgtgcagngtatcgcgaagtagcctgctcacacaccaacgcgagcactcatctaattacctacgcacgttacttcccgagggtcacattagatgcatgccaaatatgaataacgacccgatacatgtcgaaatgggatctcattgtcgtcgcacccattcacctgaggaagcgatcgaagatacaagtgacccgatggatgcagtcacatcccgatgctggtccactccttcatcacacccccctcagtcacgttacagttgacgagcacttttctccaggatcacacccgtcacacatcccatcagatgtcaacgtccaaacaaggcatgtccagacatcctccagctcctgatatcccgtacgttattaatcccttgtctccgaggtggtgtaggacagatcaccccacctcttggctggcaaggtcagcctgtatatcccatcacgggtggattcaggcaancctacccatcctcactgtcagtcgacacttccatgtccaggttntcccatcatatgattcccggtcctcctggtccccaacaactggcatccctcatccagctattgtaacanctcaggtcaaacaggaacatccccacactgcacagtgcacctaatgccacgtgcacagcctccagcatgcaaccagcagcaacaggcagcagtgagcccaaaaagacctccacattcaagcaagcctctgaatgcttttcatgttcatcacatgcaccagaacatgagagcgaatgtcgttgcatgagtgtactctaaaagacacgtgcagctatcaaccagattcttggcagaaggtggcatgccctctcccgtgaagagcacgctaaagtattcatgcaattcaagccacggcaacgcaaagcacagctcacaatatgcaagcatttatcccaggctgtgtctgcacgcagccacattatggtacgcaaaacgcaagaggcaagagcgagaaaactacggaattctgcatccaggtgaacaaacgacgctcatttccaacgtggcaagccaaggaataagacacccaaggaactcttctggagatgcgacgctggtgacaaacccagactggctcaagggtcatgccagattgaaccaaaggaaaccttgactccaatacaaccccgtacgtccggaaagaaccgcgaaccaatacagcaagaagagaaacacacgacacatgaaaggccagacccaaaaaccctaaacggttgaaaagggaggcaagcgagaaaaatcaaacatgatgcaaataaaatataacacaaaatgataacacagacataaacaacagacctgaaagacacataacaacgctaaaccaaaaaccaaaattaaacaggggaggaatcataatataactaaactacacaacaacatagctacaaacccaacactgaactctttccttcttgcaagtaaa

SEQ ID NO: 628715 - DNA, 635 bp, Homo sapiens
cagggattggaaaatatcatgtgtcgtctactgagaagggcaaggataggaatgagcaggttagggcaagaactaagaattgagttttgaatgttgttttgagactctaagcagaatccaaatggatgcatgctcagtatggatgatggatatctatgtcgagagctcaggccagaggttgagagtatgaacataattccaggagtcagcagacatacgctaggtatataaagctaagaaatcagatgaggttctttttaaaatcttacttagtaacaagtacagaaatattgctaagtgcttcacaaatattaactcaatcctcttaacaactctctgaggtacgaactattattactcttatattccatattaaagataagagaaaactgagaaacagattatgtaaggcaattaggccaaagatcagactatcggtgagcagcaaatctgggactgaatccaagcagtgtgtgccccagtctgaattcttaatactaagctaaattgcttcctaatactctaagggcaaaaactcacgtggaaggagagaagaggctccggaactgagccgcagggcactcaacttttagaagttgccaaaaggggaagccataaaattaaaaggagctagt

SEQ ID NO: 628716 - DNA, 810 bp, Homo sapiens
ttgcgatcacctggaggagtattatccagctgttggatttttggccacggttcagtcagttggggttgccgtgctcccagaaacagttgtaaatgaaagtattggcatgtcgtagaaggcagcagacaaaatggaaagtaatatgagagcagaagagtaagcatttgccagcctatctaatttctttagttctcgtatttgcctccagtgcagtccatgtgtcctaagggtatacctagcctactgtactattgtcacaatgcgtcaatttcagcaccgatgggccatgtaaataagatgatttaatggctgattggaatcctgtagtataaaataaaaagtcacaatgagtttgggcatatttaagttgatgattatggagccttagaggtctgttgatcattggttcggctgcttttatgtagtttaggctggaaatggtttcacttgctctttgactgtcagcaagactgaagatggcttttcctggacagctagtataaacacaaaatctctgtaggtctattgcacctatctcagccataggtgcagtttgcttctacatgatggctaaaggtctgtcgaagtgggatcctgatggaactaaggactccaatgtcgaactcttctttggctgcattccatgttttcattcacttagcaagaacaggcctgaacttggaggacttgtctgtaaccaggaacattttggtaggggtcgaagtgctaataaataactcaaccaggtctacttaagaatggctgtatatatcaccatctcaataggttatacatctatgcatgtcaata

SEQ ID NO: 628717 - DNA, 400 bp, Homo sapiens
  misc_feature (386)..(386): n is a, c, g, or t
  misc_feature (391)..(391): n is a, c, g, or t
tctgacttattttacttagcatagtaacctcatagcatgtgtcaaaatttcctttctttttaaggctgaacaatatttctttgtatgtaccacattctgtttatctgtccacacattaatggacactttaattgcttccaccttttggctgttgttaataatgctggtatgaacatggatatacaaatatctgttcaaggccctgctttcatttcttttgggtatatgcacacaagtgaaattgctaagatcatatcataattctatatttaattttttgaggaattgacatagtgttttccacaagtcactgcaccattttacatttctaccagcaatgccagaagagttcgagtttttccacgtctttgccaatatttgttatntttcngtttttttc

SEQ ID NO: 628718 - DNA, 115 bp, Homo sapiens
aaaaaacaaaggctttaattcactccagccaccctctgtcccgcagtgtcccaggcagaggccctctcccttcccatattttttcgtgggaggaggaaatctaccacccagcaca

SEQ ID NO: 628719 - DNA, 105 bp, Homo sapiens
  misc_feature (5)..(5): n is a, c, g, or t
aatgnctctggaaaagcgggtaactacggtgatgatcgtcgtgatggcagaggacgctatgatcgaggcggctaccggggccgcggcggcaaccaagtgggagtg

SEQ ID NO: 628720 - DNA, 935 bp, Homo sapiens
  misc_feature (902)..(902): n is a, c, g, or t
gtgagagaatgacggcggaacgcagttgttggggtggctggcgcataatccttttttctattcttattttgcaaggtagtattaagtgtccatatttctcaagccacattcaaggaaatcatgtcttaactattttggatgttgcctctccttcatcttgtacatgaaactccagcagatttaatattggcatccatcatctagtcaaacctctcacatgttcttcaaatcaatcaaattggggattgtcaacattttctgtgtcaataaaaggtgtggaattagtagattcgatgaagacctgtttttccttgccacattggactttccgacgccatttggattgggttaaaaaaacgggggaatttaaaacgacccttctttgccctgagtctcttaggacgtgacatgcagaaagagagagtgaacctctgaaaatgctggtccgtgacttcgtggccaccccgacccggctgtggtggtgggatttagttcggctatcgggccagcccaacaatgagaagtcctcctgggagcgatcactcggatggccacggggaagctatgcaggaatagatctggtttcgcctttactagtcgagcttaaacaagagaacatgtctgtagcctgtattgagcgaggtagacaagctataggatcaggaatgtaatattgagcgttgatcacttcttgggagtatcgcagggggcgggatatgtatacggtcgagatgattggttatcccaccagtgccgaatgggtgaaatcccattcggcccttaatcgcattcgccactccaaaggtgcggagtgcgcgccgacaacacctaccgcgggggagcaccttacgcacctagatcgcgggagcgcggtggtgtgacagtagcatgacgcgagattnaaacaggctgatttgtgacgagttctccgccca

SEQ ID NO: 628721 - DNA, 233 bp, Homo sapiens
gaagcgggaggatcgcttgaacctacaagttcgagaccaggctgggcaacatagtggaaccccctctgtacaaaaaaaaaataacaaaaattagctggtgtagctgcatgtgcctatagtcccaactactcgggaggctgaagcagcggaagggctgctcgagcctgggagatcaaggctacagtgagccatggtcataccactgcactccatccagactgacacagtgaatc

SEQ ID NO: 628722 - DNA, 386 bp, Homo sapiens
  misc_feature (105)..(105): n is a, c, g, or t
gaacctcgagttatgggacgagaagaggtgtgagaatatggcgataagcgggagagacgtgtgagcttggggagattccccctgggaacctggggtatccacggnatctctgggatcagtgtcggaaactcaccctgcctgaggtgtagttagtgggagtaggatggagcggggcagtgcatgcccctcaagaaggagcccaggacctcttgccatctgggccatctcctaagctgggcccaagccccacaatgttttttctacgttctaaactggttcttcagttgacaatatcccctgaagggaccttgggtagggagtattttggcacacacgcaggccttgccagggaggaaccattgcgatatggtatctagcctggggtc

SEQ ID NO: 628723 - DNA, 191 bp, Homo sapiens
ggatccccatgcttatacacatggtagaaggtgaagggggaacaaggcaggtgacatggccggagcagggcaagagtaggggggaggtgccacacacttttaaatgaccacatctcacaagaactcactgttgagaggacagcaccaaggggatggtattaaactattcatgagaaaccgtcgaattcgag

SEQ ID NO: 628724 - DNA, 1064 bp, Homo sapiens
ggcggacgcggagatctagtgcagtcactgatctctttatctctgtgcgtgcttaaagttcagtgaccgtctctgaatggatgtcttcatctccgtctgaatcattacaaagcatactacagagaccatatcgtcttactgagagacacctgggtatatcctggacgtatcgtatgcgaaccatgaggttgtgaagccatgtactcaaagctctcatatgcactgttactctattggcagaggctttatgggtaggagcgcgtctgagtgcattgtgggaagcagcctaactcatggactctgagatacatgtcctgttaacatcaggttcattacccaggtccctatcctggcgcacaggcgcggcattgtgatgaattgctgcctagagaatggggaaccatgcctgggggctcgcccatgggggtgtgtaccagcatagcgggatcatgacgactgcacttaggcaggtaacgaaaatattgtccatggacagattgtgtagtggggcccacaagaggagcgaagtcctagagcatcagggcatgtgcatagagctcaattgggcgctggtcaagaagtgtaattagggggagccagggtgaaagtcgagcagagaaaggcattacccacacaataccaactgggccggaaaatcgtgggttttggagccttagctcgatgggtgacaaataccttgtgattgccttgtcctttgctatgttaatggatactttgggtcctccacgaggaaaagagctccctgaggttggggtgagacggaggaccggccgttatagcgttagctggttttgggaactatgagatagggtctcggtgtgcgtaggagcggttgatatcgaagcaaaaacaattggtgtgttaagttgctatgtcctccaaatgtaacttttataattaaaggggcttgtgaaatttaggtagaaagaatttatgaagttttaaaaggaaaaggggaaagtttttcatgtgcagaggttattggttggtggaaggacatgcattttaaatttcattgggaataaattgaaaaaaggattatg

SEQ ID NO: 628725 - DNA, 240 bp, Homo sapiens
ggagacgggggtctcactcggtcgcccagtcgggagggcaggggcatctcggctcgcggcaaactcggcctccggagtacaagcgattctctggcctcagcctcccaagtagctggggattacagggcgccggccaccacacccggtctaatttggcttattttaagtaagagatgggggtttcacccggaagggccagggcgggtctcaaactcctggacctcatggtgatccacccgg

SEQ ID NO: 628726 - DNA, 101 bp, Homo sapiens
ttcagttacaacatcaagcagtgctaacaaaagtcttggaatatttctctccacctgaccctaagtcccgaagttcctgacatcccataggcaggatgcag

SEQ ID NO: 628727 - DNA, 321 bp, Homo sapiens
gcgttcctgaggccttccaggtatcctcaatgcactcggggatgtaacacagcgattatctagccagaatgctaataggatgatgaggttgcatcagctcaagaaaagtgcagataccttcgtgggagcatccagtacaggacgtaaatagactctgtgatgtagtgagctctagggctgtagactatctaaaaagctatcaatgtgacttaactcgagcctttagttttcatgccatgtacatggatcacagtttgcttttatcttcattctaatatgtgaatttgggctcacagtataccgcctggactgttgaaactt

SEQ ID NO: 628728 - DNA, 132 bp, Homo sapiens
atcagggttgctgcatacagcctgaagtcggcaccactagagcaggttgccatccatgtaaaccacgagcgtcactcgtgcccaatgccctaatcatgatcctcccccggcttccaaactgcattagataaa

SEQ ID NO: 628729 - DNA, 149 bp, Homo sapiens
gtatggctagaccacaatttatatctccattctactggacacgggttgatggacagtcgtttccactagtaggggttattttgtatcttgctgctacagaccactcttgtgcaatgtctttaggtaaacatctgtcagcaggcgagaac

SEQ ID NO: 628730 - DNA, 2008 bp, Homo sapiens
  misc_feature (1998)..(1998): n is a, c, g, or t
taactcatgaaacttgagaacacgagaacaacaaaaatactttccttgaacattttcagctagaatgacacggcattctcctacataaaacattataattttcccactactccaaaggaatccaataaataattttacagtgaaggggcctggatcaaaactggcagtgacacctggcccctgacaagcctgagtcacaggtccctgtgcaggtcccagcgtccagtcctccaagaaccagcactgccggagcctcgctgtggtttcttccttccccgatgggaccagctggaatttccaagctgcttcacagaggccaaagatgacaacacgagaggtggtcaaagccaaggtttccctgcgctgcctttgtcttcttcccatggcctggcctgagtgctgcagctgggccccaggagatgagctcctcgcccaagctggagagcatccgctgcacccgccatgccgggaagagctcgggtgggctttctccatagcaattcttcgcaatggggtcccaatcggtgggatgaggccctgggatgaggtcctgcatttggccggacatgactcaatactgatcttcgactgccatgaagaggttctggaacaccacgatgctccaggagaagctcctggctgggctgcaggcagcaagagacatggccagcagccgtcacagcagcactgcttcacactagggctgtggacgttacagccctgcaccagcaaatccctcctctcgcaaacatagcctggttcatccacgatgaggagcttcccttgcacagagttctggcactgattccacgggtgactgctactgcccaggttaacctgcactttgcacgggctgggctggtcgtggtcttgaacctggaggagagtcctatgtctgactcccgctcttcctgcctgaaggtgctgctgaggacatgaatgaggatatctgggcaagggccccacatgcccagcagccccatccttgtgaatgattatagggagaaaagcattttccaggccaatggctcactccaggtgccaggggtcatgtcaatttgctctggaaaatatgtcacatcagtagcagcaggtgcagttggaatagccacctgctgagctttgtgaaaatccacaggcgttctccaaggatgcccgccttgcgcctcgcccagctagggagtcaggtgggggctgtgctggggatcaccagccctgcatcgttcacatcttttgggggtagcactaaccttggcattttcaccagacatgcagatttgagttcattaacctggtaggaaagaaaaattgcagggcttccatttaactttttataccatgacagccgtaaccctgtgggtcacagagctgatgtgagaatgccgccggtttctgggatgtctttttagctacacactcaggagcttgcaaagtgaccacaggcaggctctgcagaactcccaggcccagctcgagatgaacttggactacagttgcatgatccctgaccgtcagccaccactttgactggtggaccaccatggtgttttggggccccagaatttggcattcaccaaaatcagtgttctgtgggccctgaaagcgcaggatgtcgcccttgtctggagcaccccactgaaggggcagtggctcccgtggggaaggctgggagggcaagtcctgcacacctgagagcccagggagcccggctttcttgtcaaccacaggtgaggacaaggacaggaacacaaccaaatcagttgcacaactgtgtcttttagggtctgtctcatggcacattctggtgccaagtactgcatctatcagagtacagtcaggaaacagaaaacttaccacatttaagtatttaaaattgtagggcttgcacggtggctcacgcctgtgatcccagctctttgggaggctgaggcaggtggatcactggagtgcaggagttcggggccagcctgggcaacatggtgagatttcatctctgcnccggtgcgcc

SEQ ID NO: 628731 - DNA, 179 bp, Homo sapiens
aaatacgatggggtgacccctcacgagggatacgtgcttatagatcaaacaacccggtcagggcgtctccggcccggcggatgggcgtggatcgtgaccgaggttatactatggtcaccaatggatacctctagaatataccctgcaagcatgtcaactttgcactaaccagcagattt

SEQ ID NO: 628732 - DNA, 315 bp, Homo sapiens
  misc_feature (78)..(78): n is a, c, g, or t
atgaaatatgacattgtcttctttaattatgtgtaagtactaaacaattacgagtatgatgtagaggatagtgtatcngtaaatctagcagagaagcataccagcatagaaaaaaatttctgtacttaagttagattcaaagaaaggtaaatatcacctgtagtcagaggaagtcacaaagaagagtgattaattttctttctcttctgaaaatagtagtgattcttgcaagtggagataactttttgcttcagagagtcataatacaaaaaataataacacagtcttttggtggtggtagttacatattacggg

SEQ ID NO: 628733 - DNA, 470 bp, Homo sapiens
  misc_feature (15)..(15): n is a, c, g, or t
  misc_feature (464)..(464): n is a, c, g, or t
ttgtaaaaatcttgngaggaggccgggcgcggtgggtcacacctgtaatcccagcactttgggaggccgaggcaggcggatcacgaggtcaggagatcgagaccatcctggctaacatggtgaaatcccgtctctactaaaaatacaaaaaataattaactgggtgtggcggcaggcacctgtagtcccagctactcaggaggctgaggcaggagaatggcgtgaacccgggaggcggaggttgcagtgagctgagatcgtgccactgcactccaacctgggagacagagtgagactccgtctcaaaaaaaaaatcttggaggaaactcctgcagtcctggggtttgactaagtggtctgtgcagccccttccatctctaaggtgcagtgcagtctgtcatttctaatggcagaactccatggacatggacaacacaaatactggttaatggtgtttggtatantctctt

SEQ ID NO: 628734 - DNA, 1445 bp, Homo sapiens
  misc_feature (1435)..(1435): n is a, c, g, or t
taactcatgaaacttgagaacacgagaacaacaaaaatactttccttgaacattttcagctagaatgacacggcattctcctacataaaacattataattttcccactactccaaaggaatccaataaataattttacagtgaaggggcctggatcaaaactggcagtgacacctggcccctgacaagcctgagtcacaggtccctgtgcaggtcccagcgtccagtcctccaagaaccagcactgccggagcctcgctgtggtttcttccttccccgatgggaccagctggaatttccaagctgcttcacagaggccaaagatgacaacacgagaggtggtcaaagccaaggtttccctgcgctgcctttgtcttcttcccatggcctggcctgagtgctgcagctgggccccaggagatgagctcctcgcccaagctggagagcatccgctgcacccgccatgccgggaagagctcgggtgggctttctccatagcaattcttcgcaatggggtcccaatcggtgggatgaggccctgggatgaggtcctgcatttggccggacatgactcaatactgatcttcgactgccatgaagaggttctggaacaccacgatgctccaggagaagctcctggctgggctgcaggcagcaagagacatggccagcagccgtcacagcagcactgcttcacactagggctgtggacgttacagccctgcaccagcaaatccctcctctcgcaaacatagcctggttcatccacgatgaggagcttcccttgcacagagttctggcactgattccacgggtgactgctactgcccaggttaacctgcactttgcacgggctgggctggtcgtggtcttgaacctggaggagagtcctatgtctgactcccgctcttcctgcctgaaggtgctgctgaggacatgaatgaggatatctgggcaagggccccacatgcccagcagccccatccttgtgaatgattatagggagaaaagcattttccaggccaatggctcactccaggtgccaggggtcatgtcaatttgctctggaaaatatgtcacatcagtagcagcaggtgcagttggaatagccacctgctgagctttgtgaaaatccacaggcgttctccaaggatgcccgccttgcgcctcgcccagctagggagtcaggtgggggctgtgctggggatcaccagccctgcatcgttcacatcttttgggggtagcactaaccttggcattttcaccagacatgcagatttgagttcattaaccacatttaagtatttaaaattgtagggcttgcacggtggctcacgcctgtgatcccagctctttgggaggctgaggcaggtggatcactggagtgcaggagttcggggccagcctgggcaacatggtgagatttcatctctgcnccggtgcgcc

SEQ ID NO: 628735 - DNA, 604 bp, Homo sapiens
actccgaggtcaacaagtatcttgaccttctggcaccttcgtttgtaagtgtggagataacacccagctcctaggatggccttggagattaaatgagttgggataacaaatagcactcagtgagggcttactatgtgccaggtactatccaaatgcaaatttcaatttctaaattttaatctctctctttaatcaaacatacagctttgatatttgatatgcattcttgtattttcctcttaggtgcttttcagttatcttcctgagaatttgtgcattttatgtagaaataagataaaatacacaagatataatatcctactggtccttaattccacagcttaataactgtatgaacatgggaaattacttaatctctctgcgtctcagtttcttcaactataaaataacaatgctgctgctgctgctgctgatgatgatgatgatgatggtgaagatgatgacacctatttcatggggctgttgtgaaaattgagatgatccctgttaagtatttagcagagtgcctgacagtgagtgctcaatcacttattattattgctggtaatactgtcgttagcattacttttgctgttattaatgt

SEQ ID NO: 628736 - DNA, 481 bp, Homo sapiens
  misc_feature (187)..(187): n is a, c, g, or t
  misc_feature (206)..(206): n is a, c, g, or t
aacatttgttagaatcaatggccctacatggacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctanttatcccaccctcccgccnacccctggcaaccactgatctttttactgtctccatagttttgccttttccatatgtcatatcattggaatcatacagtatgtgacttcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaattatgaataaacctgccgtagacatcc

SEQ ID NO: 628737 - DNA, 316 bp, Homo sapiens
  misc_feature (83)..(83): n is a, c, g, or t
  misc_feature (288)..(288): n is a, c, g, or t
gcggacgtatgcgaccaggccttggcatcgcgagtcttggcgcctcgcaacgtgtacagattgtgcatcgtgtgcgtgacgtnctcagctgaaccgagcgctttgaaatcaggcaggtagaacagcatttcggacggggcttcggttcccggagcaagcatgaaggtcactcgcacgccgtcgatcacttcttcgtgtaccggttcggtaatgatgtcggttggcacggcgaacgtcgacgtgccgtgcgaaggtggacaatccgagaccaccggatacctgcccctntggacccgggcgcaggaacgatccgtac

SEQ ID NO: 628738 - DNA, 539 bp, Homo sapiens
  misc_feature (103)..(103): n is a, c, g, or t
  misc_feature (163)..(163): n is a, c, g, or t
ctcagaaatccctctgttatggcatacaatcttttcaaggggaaaaaaaaaaaaaaaagaaatcccggctcccaccttctcgtatcagaaggaagacgttgtntgaggtcatcggttcacatggcagcagcttcctcgggtgaccctcctcattgggagcgcngcggagagatggacgcctccacgatgctgctgcttgcatggggcccgcacgaggtcctggttgagcttcactagaggaacactatcgcactctctgggtagctctggctgggtgggtgctttctcgtcacatctctatgctcctttagaaaaaatttggtacctgattccttaaaacgtcaccaaaagggagtacagtgctgtgttcataaaaaccagacatgctgccgaattcaaagtaagaagttccctcttcactgcctgcccctccttccgcagaggaaacaagtactttttcagaagacaaatgtccagacatactgtggcatgtatacaagtacatgcttgtacaaatcattaacaaatattaaaatggg

SEQ ID NO: 628739 - DNA, 118 bp, Homo sapiens
ttgttggcactacagcagtccacgtatgcctataatggttttaagcaaggtaaagacagcatattcaacaagcaagacacaatctctgaagggtcaagaggtgctcacagtattataa

SEQ ID NO: 628740 - DNA, 529 bp, Homo sapiens
  misc_feature (31)..(31): n is a, c, g, or t
  misc_feature (296)..(296): n is a, c, g, or t
  misc_feature (394)..(394): n is a, c, g, or t
  misc_feature (430)..(430): n is a, c, g, or t
ggcttggcgggtttcggcagtagctgtggcngcggtgccgggcctggggacgcgggcggcgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgntaaaaaggaaacacaaagcgagaggaggaggcaggatgactgcattgttccagtaacgacaagaaacagggataacgtgggaagcagagctcctgtgncctggtcccctaatggacctggggaattccttttgntgggcaacaaatttcaaggggcatggtagaggggcatggagtaaatcccagtgtagtggcctttccataccgggatattagatgttattgtgaagaatg

SEQ ID NO: 628741 - DNA, 288 bp, Homo sapiens
accgaggggaaggatggggagggaggcgaggaggggggcggaagagagagggcagcaaggaagggccacaagatgccccagacccagcacaggcgcagacctggccgccggcgttgaaagtcacaggcaccaggaagtttcccccaatgccaaatgtgggcacagccggaatgcaaatgtggcggggggacagctctgtgggtgagctgagccgaggctggcttcacaaccacacccaggggtaccggggggagtatggttgcaaagctgaaacttaaaggaattgac

SEQ ID NO: 628742 - DNA, 466 bp, Homo sapiens
  misc_feature (221)..(221): n is a, c, g, or t
gcattgagatggtcatggggcatcatgtacactctaacttttcatttgttagctatgaaaccagaaacatccatccacatacaacagagttgcatctgtccagagttgaacataaattctcaaacttcctatcatggttggatctgagtttgttaacagatatcttgagggtttttaaattgactttgcaaacgtcagctggccaagagtagtgagtagcnccccgacggccttgggtgttctaaggtctatgttgatgctttttgatctgaacttctcacacatggtacatcttccgttctactgtgcagttaagtgcaagtaatagaatagtcttcctatttctttaaaatagtgtactcttttgcattaatataggaatatttgaaaaggcacattgctgaaggtgaaatgtttgaggccacaaactagatccttccagaaaagccttgggtaaaaaaaaaaa

SEQ ID NO: 628743 - DNA, 162 bp, Homo sapiens
ctggggaacaaggcgtattctcccagcctcgaggcatcctgcagtaagtggggactaccgagctctaccacccaatattttttatgttacgtcacgccagaagtagttgtgtgggccctcctgcataagaaaatccttgttacatgaatgcgcttgagtcca

SEQ ID NO: 628744 - DNA, 961 bp, Homo sapiens
  misc_feature (1)..(1): n is a, c, g, or t
  misc_feature (65)..(65): n is a, c, g, or t
  misc_feature (78)..(78): n is a, c, g, or t
  misc_feature (93)..(93): n is a, c, g, or t
  misc_feature (187)..(187): n is a, c, g, or t
  misc_feature (205)..(205): n is a, c, g, or t
  misc_feature (221)..(221): n is a, c, g, or t
  misc_feature (351)..(352): n is a, c, g, or t
  misc_feature (379)..(379): n is a, c, g, or t
  misc_feature (384)..(384): n is a, c, g, or t
  misc_feature (390)..(390): n is a, c, g, or t
  misc_feature (401)..(402): n is a, c, g, or t
  misc_feature (407)..(408): n is a, c, g, or t
  misc_feature (410)..(410): n is a, c, g, or t
  misc_feature (471)..(471): n is a, c, g, or t
  misc_feature (540)..(540): n is a, c, g, or t
  misc_feature (553)..(553): n is a, c, g, or t
  misc_feature (560)..(560): n is a, c, g, or t
  misc_feature (569)..(569): n is a, c, g, or t
  misc_feature (605)..(606): n is a, c, g, or t
  misc_feature (610)..(610): n is a, c, g, or t
  misc_feature (621)..(621): n is a, c, g, or t
  misc_feature (659)..(659): n is a, c, g, or t
  misc_feature (699)..(699): n is a, c, g, or t
  misc_feature (712)..(712): n is a, c, g, or t
  misc_feature (720)..(720): n is a, c, g, or t
  misc_feature (782)..(782): n is a, c, g, or t
  misc_feature (787)..(787): n is a, c, g, or t
  misc_feature (803)..(803): n is a, c, g, or t
  misc_feature (848)..(848): n is a, c, g, or t
  misc_feature (961)..(961): n is a, c, g, or t
ntctcccaggtatatatatacctccgtcccaagatataaagttctaaacatagatttaaaaagancaaaatggaaaanatataaatatttgcngttcctgtttatatcttttgtgcatttattgtcttttctaaggttggcctttttctttattttgccattcgatccatacttacagtaaaacccnatctaaatattatagacngcgtataaagccaaangtaagacttcccttcactccatcttctcctcagatattggtgaatctcctcccaaactttcaaccacatagatgccttttccttttccaacccgacagccattaacactaactctttaacggctgccgcnnacttcccgccacgacgacttatgtcgnttaangctgcngtctccctatnnccttnntngccggattccccctttttttaaagcccatccttcctgttccacacactgaatctgcctggnttgtctcaccttgcttttaactattaggcctgtttggcagaggcaatataaatttttcaaaatgtaagntgtttaaaatgcnattagcntttagcacntggaatttgaggcagaaaggtatgagttaggcaacnnttcntgccataatcncagttttgacaagcctcaaacacaatgtacaatatttnagacacaaattcattaggtatgggcacaggacagcatgcncatatttaatacntgcgtgcntgtggttttgcacaatggatgggtattagagtttgccttggatacttggcattgattagacngttcngaaatttggttatgcntagtcaaaaaattcagtttattgttcatcagcaagaatagatgtnaccactttaaaaatagttacattgttttccagattaagtaaatatttcagttaggagaatacatatttttatttttattttcagtttttgagatggagtcacaaacagtcacn

SEQ ID NO: 628745 - DNA, 200 bp, Homo sapiens
cgtttgaactctggggctcaattactcagcccaccttggcctctcaaagtgctgagattacaggtgtgagccagccgcaccagaagtgctttctgaattttttttgtgaggcggggtcttgctctgtcatccaggctggagtgtagtggtgtgatcccagctcactgcagcctctacctcccaggctcaagcgatcctcc

SEQ ID NO: 628746 - DNA, 123 bp, Homo sapiens
gttgagttgaacagagcaagcatagagcccgatatgatttctagataattggggggatacggagctttggtcctggatagctgaatacttcccatgagatctgtccaaaatagtactctggcc

SEQ ID NO: 628747 - DNA, 624 bp, Homo sapiens
agcggggtgtctggtgtgtgggcggggcctgccctgagccccgccccatcccccaccgcagtgggtgctggagaagcacccactggtgccatgaggctgaacgctgagctgacatgcttgtgccaaaccccaccatgctggctcaccaagtacccgctgctgctcagagtctgtgtgcttgagtgaacgaccctgatggagccgctgcgccaaggaggccgtcgtctgccatgatactggctccgttgtgcagcggctttcatccaggcactgtagaactgctgtggcattgcaggccatccgtgcatgtgacccggcatggctggcttgtgccggctctgctggttgacgctcgcattccgacttgccctaccgcagtggtggcgtggaaacgcctgccagctgaacgaatagtgcgagcgaatgcattccctcgcaacgggatctcatcctggcaaccttttggagcttttgagcactgctcggcccgagtccccttgggccgccctttcccacgtggagggaaccaaccggcgagccacggccctgcttggctcggatgcgtgcggaacccttggaggcgcttccacccgagcggcgcacggctccatgcacacgagatgg

SEQ ID NO: 628748 - DNA, 1153 bp, Homo sapiens
taaagggttacacaattaattattgggaaagccttcctctccccggcccttgcaatctctagggtcattttctccggttaggataaatttgggcgcgccgcaacgccccaaaaaagacgggttgggggcgcagggtgcgcagcgggtactggtgcaatggaaacgccataatggtggctggaaactggtgttccctccattattggaaaagacacattgggtgggacaatatcccagctccctacattatagcggctcttaacccggaggcacatttttctacagctctcctttctggcccggaatattttcccttacagggatacggggaacccggtgctctggagaggtgggcccggttggcaaaacctgtagaaccacaaccaagacacagctggctatatgtggttggtcccctggagatgtgtaaggtggcacaattttggcgcgcagagtaaacctgtggggggtgtcccccacaaaagagggccacagggcacactacatcctaggatattcttgagaaaaaattccgccacatttttcccaagcagggatcactttctgggagcattggcgggtggggcctcttactgcagctactcaaatttctctgggcacatgttacccatgggctgtgaacgctactcggagacggggtccaacggagagttcaaaacaagcggcgctattggatccatcagaaccacactacccaatttggctcccctctcttaacacagagagaactctgcgaacacaagatcctcccccattttggcccccttgggggagagatctcacaagcagcgaccaaaaagacccggcccaccatcctccaactcagctagcaaccacctccctgccagaaaaaaagtcccacacacagggcacccggcacacagggccgggccccccggaacaaaaaacatcacaacaaagcgcgcaacacaagcacaacagagggaaccaacaaagaaggaacaacaacccaccaccggtgtgaaaccagagaaactagccccggcgtcagacgaagaacccaaaagtaacacgaccaaggcaaaacagttgggcataaacacacacaacccaacaagcacgccggaatcaccaccatgtcgggcccaacccgaaacaacaacacaaccga

SEQ ID NO: 628749 - DNA, 81 bp, Homo sapiens
ggccgtgtattactgtgcgaaagccccaactaatcggccaatcagttactactttgactactggggccagggaaccctggt

SEQ ID NO: 628750 - DNA, 121 bp, Homo sapiens
atatggccggtcccctcattactattctgctaggcaactcaactacgaacgcgaagcttagtagtgcaggcttcggaatatctcccatatgtaacttactactccggaaaaaaagaaccac

SEQ ID NO: 628751 - DNA, 592 bp, Homo sapiens
gaccagtttctgagcccgttgcacctcggcgatccccgactcccttctttatggagtcgctcctgtgctgtgggccgaagctggccgcctgcggcatcgtcctcagcgcctggggagtgatcatgtgataatgctcggaatatatttcaaatgtccattccgtctgtgttgattgaggaccgtcccgttcacggagaacacgatattcgagaatggaccccagaacatatacaaacctttacagagcaagtcgagctacacacttgtcgtcatcgctgcagtgcctttacctcctcctcggcaggcttctcgtttctgccacgtctggctcaatacagcgcaaggaatacatggttgcgcttagggccctcgtgcagccggttccccgctccagtcgcctcctctatcttcaacagaattgcctgcacccggcgttcacccagtgtcgcgttccaaccctttgcacggggccctctgtagggaattgggtatcccggcctagacactgggtcccttcctcccatctgtgggatccggaccagtggacagggctgggatggcggcatgtcgcgctctcagacttgctggtccg

SEQ ID NO: 628752 - DNA, 375 bp, Homo sapiens
aggacttatggctcactgcacctgccttggcactgcctggctgtctcacgagtgtcggtttttcctgtccagggccctcccaaagcgcccacgtgtatttcgttgtctccctgccttccagtctctgctgcagtctttcaggacccgagcacttgggaagtgtgggcaggcattttgtagactccccctcaattttggtttgcctgatatttacgcgtgattaaactgcaattatgcattctggcaagaacacggaagagatcaggcctcctctgcatcaaatcaggatgtaggtggtgtctaccaggtctcttcactgtagagttactgttttctttggtgtaatgagtatcttgcggggacacaacgagaata

SEQ ID NO: 628753 - DNA, 115 bp, Homo sapiens
ggcagtggctgcgtaggtagatctagaggatcccttggggctccaattcagggggtcctgggggaagagcttgttaccagctcattctgtcatgggaagaatacagttccgggga

SEQ ID NO: 628754 - DNA, 458 bp, Homo sapiens
ttgttttatgctgaaagtagaacacaagtcacatttcagatggaggctgtaacatatcgtggcatttttcttatatggtttaagtgttatctctgtgttctattccttctgtgatcgggtttattatatcttattttcttgggggttttcacgggtaatgggccttgtgatacgagctcattacttgtctcctgtgcgtgcacattatcgtgaagtcaactctcgtcttcaagtgccagctttggcccaaagttaagtcttcgaagtaaaacgttggcaaacaacactaagagcttccgtggggcatttttaaatttccaaattcacaccggcttaaacaccagtggggggaaaccacccttctgcccctcctgggtttatctcctggcaacggggggacggtaaacgaagtgtttacgtcaatctaccatatcttaaatctttctgaggttggtaag

SEQ ID NO: 628755 - DNA, 493 bp, Homo sapiens
  misc_feature (59)..(59): n is a, c, g, or t
  misc_feature (63)..(63): n is a, c, g, or t
  misc_feature (67)..(67): n is a, c, g, or t
  misc_feature (73)..(73): n is a, c, g, or t
  misc_feature (90)..(90): n is a, c, g, or t
  misc_feature (93)..(93): n is a, c, g, or t
caccgcgcacatccctctgagaggccaggcacaaaacccgtgctttagtagatgatatngttnttcngtaaancttcatttccaaaaaanggnctatcatcctgttaaatctgtggactagagatccttgttacatgcccaggattacctattttaagtataactttgttggatgcctagtgacatgctttggctgtgtctccacccaaacctcatcttgaattatagctcctataattcccatacgttgtgagagggacctggtgggagataattgaatcatgggggcagtttccccaatattgttctcctggcagtgaataagtctcaatagttctgatggttttatacagggaaacctgtttcacttgcttctctcattctctcatatctgctgccaagtaagatgtgccttttgccttctgacatgattgagaggcctccccagcaatgtggaatgtgagtccattaaacatctttttctttatgcatt

SEQ ID NO: 628756 - DNA, 365 bp, Homo sapiens
gaggcggaatcgaccagaatacgggctggtggtggggcaggcccggagctggtagtgtggccggggagcttcctcctggaagcaggagaatcgagcctccccctgccgtttgcagcacccgtggggtcgggtcttgaccgagaactcggcctcacagaaccgggtcatcgcgtcctcccactagagcaagagggatggatcagcctggcagcccactgttcacactcctgtcttcctcccaggctccagaaaaggaccctgggcaggcaaataagcagaggctgtcctctgctcttctggcacactgaaggggccaaggtagggccaatgaaagggacctgaggttccgttgagatcaggcatgt

SEQ ID NO: 628757 - DNA, 469 bp, Homo sapiens
gtgtatagattaggaacaaggcagggcggttgggtgcctgcccagggtcataggcagcagcagtgatctggaactggagcccagctttcccacaccctgcccttaccacttgtcctctcctgatccagggctccagtgcccatgtccagtgccttggtggggctgggccaagaggcacagcgagggccctggccacaggcaggggcgttggagccctgctgcctaggtttggatcccagctctactcctggtgagctgtgtgaccttgggcaagttacattacatccctgttttgcagtttcacccactgagaaaatagggacaagaatagtacgtaactcatggagttgctggagacctccatgggtcagtacgtttcaggtgcttagaatagtgcttggcacactggaagcacagccataaaagtgttgtgaaataaataaaacccgctgggcgagaaaaaaaaaaa

SEQ ID NO: 628758 - DNA, 170 bp, Homo sapiens
tatgcaccgttgaaaacagctttgctccttcatcatgtacacaggcacgcttgactgctggcggaagattgctcgtgatgaaggaggcaaagcttttttcaacggtgcgttgcccaacaggtgcgttggccaacacggtgcgttggcccaacacggtgcgttggaccagt

SEQ ID NO: 628759 - DNA, 431 bp, Homo sapiens
tgtgagtccggtggatgatagctctggtgagctaatgctgtagttcaggagtattctgatcactgtcatccattttcctcttgtcgctgacaggctgagcaacttcccactagcccattgattgagtaggtggagcccagggaatccgattggggttattcctgatgagttacatctgaatctggggatcagcgtgtggtcgggaatcagagacttgttggccactctgatgtccatagggaggttgaattgcgttgatgcactttggtccggatgattctattaactggagctgacactgggcacgtgtgtcattgtcacagacgccctcagccaggagccggtctcggatctcccaggcaaacatggtagggttctggcgtttgtagtccccaatcttctccaccaccttggggggtggcaccttgggc

SEQ ID NO: 628760 - DNA, 103 bp, Homo sapiens
  misc_feature (88)..(88): n is a, c, g, or t
ataaagcactgtttatttttatgtattgaaaatgtccattttaaaagtcttcaaaataaaaacaatccctccaattggagcttttgcnaagaaggggaaggac

SEQ ID NO: 628761 - DNA, 224 bp, Homo sapiens
cttgtctttgtaagtcagtgggctccaggaaatgttccttctctttttgttggcatgggcactgtgggatctggtacattccggtagacactctcttttatttggactgtaagtctgacctctatgaataattacttcagcccctgattgctcccgtgccaagctccttggccaaactttcaccttagcttctggtaagtcttgggccaagctaagcagcatct

SEQ ID NO: 628762 - DNA, 343 bp, Homo sapiens
taaattctggggaactatgaagtcctgtgcaagcacagctctcgttttcgtgcagatttattttctccaaacgtggtttcaaaatgtggacccaaaaccggagaaactccctttaaaaaccgtgaagaggcgcaacatttaaaagctacgattactccagttagcaagtgtgtttccaggcctcttcagttgtgccagccggtttccctccttcttatatttcccaaaattatagggggagtgaatatattaggccttataaagcactttgagtgttggtgtgtgcaggttagtcccggaacgtgtgtgggtactcaggttgtgaagtgggtgtttgtctcct

SEQ ID NO: 628763 - DNA, 80 bp, Homo sapiens
  misc_feature (9)..(9): n is a, c, g, or t
  misc_feature (11)..(11): n is a, c, g, or t
ctcgtgcgnancaaaactatattttcagttttacttttgtatataaatctaagactgcctgtgtgataaaacacttgttt

SEQ ID NO: 628764 - DNA, 293 bp, Homo sapiens
gaagtgccacgataaaaagtgaaaaggccagactcatattaatgcagaacaacttcagctccaaagctcctccggattcagctgggacttctgttgcaattgcattagagagagagggagtgagagagggagagagagggagagagacagagagagagaaaagagaagagagaggagagaggagagaggggaaaggggagaggagagaggagagagacagagagagacagagagaaaagagaggagagaggagagaggagaaaggggagaggagagaggagagagacagagag

SEQ ID NO: 628765 - DNA, 1378 bp, Homo sapiens
  misc_feature (428)..(428): n is a, c, g, or t
gagtagagttcacgcggtgacactgcaactaggagtatttttgactgaaccctagcacccgtgtcgccaagtgagggcctacggctcgatgagggcgtgtgtgctatcatcgatcgtgcgagcacgattttgtggtctgcactaggctggaagtgctgctccgcgtgcgcacttgcgagccgtcggtgtgcgaaccgagagtcagacgtacctggggacctatcatagctacacggtggtcctgtgaactgtcactggagactgtaggagacttacctagtgctgtggttaggtaccttgcgctacgtatgcaagggaaatcgcgcagtggatatcacgatcgactgcgtgaattgatgcgattcgtagcctagcgtaagcttccgtgcaattcgatcactctgactgggttccatcaggcgtgtacnatttcaatgctctcccatggcaccgtctcatgtacacgggcaggcatcctgtactaggtctggcgttggttaggagatagaatcgtgttgtcacccaggttgtccacttgagtccgttccaattcactctgacttcgatagaccttcggaatgacggtgcgaattcggatccgaacttgcatacattggttgctgaagatggaatagcagggtatgccccaccttcatggctgtgcccatccataaacgtttacctgtatgccacacgtactgattcgcgcgaacttggacacgtggacctgctcgtatttgccatagtgcgcgcaaacatgcgcgtcgttgtagcaccctgtgctggagggggacttgtcggtgcagagtcctgcgaatcgttagcgcgagaaacctccctagtggtaagttgccgaagagaagacgaacgctctaacaccctaagtccccccgcaaaattcaatgtcggaaacacgcttgcgccgatgacacaaagatcatgtcggcaacgtcttgtctcccgtacgaaataggagcgccaacaccaggaaagtggggcccacgtccaaatatgttttccgttcgcgcccaattggcaagcgattattggtaggacatcgccacgtccaggaagcctccgtggtgtacatctatgtgacgactggaatctgcaacacgatttgcggagacgcaaagattatccgacagaccccccttgtgaagtggggtttgacagcgcaaacggacacggcaagatgtgaaaccccagcggtaagtggccagaaattgtattgacatcgggctcctaactcggaaccccaccattgcttcgtacgggaaatccagattcccgattatagctcgtactataagtccttagactgtggtcgctgcttccccctctgagggcacgagttcgaaccaatacaaaattccaa

SEQ ID NO: 628766 - DNA, 839 bp, Homo sapiens
  misc_feature (11)..(12): n is a, c, g, or t
  misc_feature (41)..(41): n is a, c, g, or t
  misc_feature (55)..(55): n is a, c, g, or t
  misc_feature (90)..(90): n is a, c, g, or t
  misc_feature (199)..(200): n is a, c, g, or t
  misc_feature (209)..(209): n is a, c, g, or t
  misc_feature (267)..(267): n is a, c, g, or t
  misc_feature (284)..(284): n is a, c, g, or t
  misc_feature (297)..(297): n is a, c, g, or t
  misc_feature (299)..(299): n is a, c, g, or t
  misc_feature (311)..(311): n is a, c, g, or t
  misc_feature (318)..(318): n is a, c, g, or t
  misc_feature (324)..(324): n is a, c, g, or t
  misc_feature (337)..(337): n is a, c, g, or t
  misc_feature (339)..(339): n is a, c, g, or t
  misc_feature (348)..(348): n is a, c, g, or t
  misc_feature (351)..(352): n is a, c, g, or t
  misc_feature (358)..(358): n is a, c, g, or t
  misc_feature (387)..(387): n is a, c, g, or t
  misc_feature (390)..(391): n is a, c, g, or t
  misc_feature (399)..(399): n is a, c, g, or t
  misc_feature (429)..(429): n is a, c, g, or t
  misc_feature (447)..(447): n is a, c, g, or t
  misc_feature (451)..(451): n is a, c, g, or t
  misc_feature (464)..(464): n is a, c, g, or t
  misc_feature (485)..(485): n is a, c, g, or t
  misc_feature (488)..(488): n is a, c, g, or t
  misc_feature (507)..(508): n is a, c, g, or t
  misc_feature (526)..(526): n is a, c, g, or t
  misc_feature (536)..(536): n is a, c, g, or t
  misc_feature (577)..(577): n is a, c, g, or t
  misc_feature (587)..(587): n is a, c, g, or t
  misc_feature (629)..(629): n is a, c, g, or t
  misc_feature (655)..(655): n is a, c, g, or t
  misc_feature (657)..(657): n is a, c, g, or t
  misc_feature (704)..(704): n is a, c, g, or t
  misc_feature (749)..(749): n is a, c, g, or t
  misc_feature (752)..(752): n is a, c, g, or t
  misc_feature (813)..(813): n is a, c, g, or t
atttcagaacnncctttatgtacagacatcatttaaaaaangcacatacaatggngattttccaaggaacaggagctggaaataaaattnaaggacattattagaactgaaattgtcccagagaagttctgaggatcaggattccttaaatgtccttgataacctcttcaagttcttcctttgtgaacatgtgggaatnntggccaggntgcactgtggctagctcaatgtttgtagcattcagcttctcctccattacttgtttgnggatgatgagtgaaganttgatggcttctntnaaagtcataganttgtggnaaactncttgcaaggagcncngggcacccnccnncgccgngccaatcccccgaccatcacactgtacanagnncccagacngctccataccccacacccggcgtcctttcncatcaactcctccaaatnatantgctactccaaanccacgagacaaggcacctggntcnccatctccttctccaaacnncaaagccagattggacanagcttgggtnaaactctccactgtcattgtctcattgtaggtgaaccagtngttctgtgtntccactctggctttatcaattaaagttttagcatcagcaatnagcccactcatggcacaacctatgtnancctcaatctctacaattttgctcaatgctgcagggctccattcagtngggaagttattctcttctccacagctaggcacagaccctctgagngtntggatcccaatggctgtagaaccaagctttgaaagcctcaatggcataatccacttgaaanaatcttccttcgggagaaaaagtatt

SEQ ID NO: 628767 - DNA, 610 bp, Homo sapiens
tagcaagaccctgtctcttaaaaaaaaaaaaaaaaagggaaagaggccaggcaccggggctcaggccgggtgagtctcagcactttggggagcccgaggtggcaggggatcacttggaggtccaggagtccgaggccagcctggactggacatgggtggaaacccgggctctactaaaaatacagaattgggccgggtgtgggtggcgtgcgtgcctgtagctggggaggctagaggcaggagaaatggcgtggaatccggggaggcgggaggttggaacgtggggccgagattggcgcccactgggactccaagcaataggccacaagagtgaaactccatctcgtaaaaaacaaaacaaaagaaaagaaaaacaaaaaaaccatcgtggggcggcggccgtcagacgccccacagagaaaaagcatgtattaaaaacaccacaaacgaacgctgtaggggacggagcgggggagcccaagagagagagaacaaggagaaaacagtgggtcacaaaaaaggaggtgaccacacaaggggaacactcggggaaaagtaaacaaagtgggaggagagaacaacaagcccaccaaaaaaaaaccgcccgggg

SEQ ID NO: 628768 - DNA, 638 bp, Homo sapiens
  misc_feature (11)..(12): n is a, c, g, or t
  misc_feature (41)..(41): n is a, c, g, or t
  misc_feature (55)..(55): n is a, c, g, or t
  misc_feature (90)..(90): n is a, c, g, or t
  misc_feature (199)..(200): n is a, c, g, or t
  misc_feature (209)..(209): n is a, c, g, or t
  misc_feature (267)..(267): n is a, c, g, or t
  misc_feature (284)..(284): n is a, c, g, or t
  misc_feature (297)..(297): n is a, c, g, or t
  misc_feature (299)..(299): n is a, c, g, or t
  misc_feature (311)..(311): n is a, c, g, or t
  misc_feature (318)..(318): n is a, c, g, or t
  misc_feature (324)..(324): n is a, c, g, or t
  misc_feature (337)..(337): n is a, c, g, or t
  misc_feature (339)..(339): n is a, c, g, or t
  misc_feature (348)..(348): n is a, c, g, or t
  misc_feature (351)..(352): n is a, c, g, or t
  misc_feature (358)..(358): n is a, c, g, or t
  misc_feature (368)..(368): n is a, c, g, or t
  misc_feature (412)..(412): n is a, c, g, or t
  misc_feature (430)..(430): n is a, c, g, or t
  misc_feature (450)..(450): n is a, c, g, or t
  misc_feature (456)..(456): n is a, c, g, or t
  misc_feature (486)..(486): n is a, c, g, or t
  misc_feature (489)..(489): n is a, c, g, or t
  misc_feature (496)..(496): n is a, c, g, or t
  misc_feature (498)..(498): n is a, c, g, or t
  misc_feature (505)..(505): n is a, c, g, or t
  misc_feature (508)..(508): n is a, c, g, or t
  misc_feature (510)..(513): n is a, c, g, or t
  misc_feature (515)..(516): n is a, c, g, or t
  misc_feature (524)..(524): n is a, c, g, or t
  misc_feature (583)..(583): n is a, c, g, or t
  misc_feature (614)..(614): n is a, c, g, or t
  misc_feature (616)..(616): n is a, c, g, or t
atttcagaacnncctttatgtacagacatcatttaaaaaangcacatacaatggngattttccaaggaacaggagctggaaataaaattnaaggacattattagaactgaaattgtcccagagaagttctgaggatcaggattccttaaatgtccttgataacctcttcaagttcttcctttgtgaacatgtgggaatnntggccaggntgcactgtggctagctcaatgtttgtagcattcagcttctcctccattacttgtttgnggatgatgagtgaaganttgatggcttctntnaaagtcataganttgtggnaaactncttgcaaggagcncngggcacccnccnncgccgngccaattgcncgggcctccccctgtcccccgcgcccccgctggggccctatggngcggcggggggcctttcncctcccctcctccccatcgncctgcnactccccgggggcggggcatggcgcctggntcngcgtcgncnccgcccnccngnnnngnngggggggncgcggcgtggggcgcgcgccccgctgccctgggctccttgtcggcggcccgggggttcngggtctccgctcgggctttgtcggttggggncntggcatcggcgattggcccact

SEQ ID NO: 628769 - DNA, 663 bp, Homo sapiens
accaggctgatgctgactttgtcaggttctgcaggaccatggctgacatctgcatgtgccgcctcggtggcacctgggcttcctcacagcatggcagtcaggctccaaggtgcagctgcccgagagctccaggaggaagctgcgtggcctcttatgatgtggtagcagggtgtcaccttctactgtggtagtcagcctgccccagttgtaagaggtgggagaggccccacatctgagtgtccacaccataatggggaaagggtacgcaccaacttctgagagagtcatctgccacagggtggcacaaggtcatggcatttcacatggttgtcacccaaagaaagccctcagccgtggagccttgccctctccagaagcgtcataggagatgccctgttacgtctgcagacaacccgtgtgggttcacagcctccaacaacaggtcagttgtatgttccctctgaggagcaggagcaggggcccaaggcacgctcccagtgtggcaccgaacacctgctgctggagatgcctgcaccgcacgtaggagggacacagtggtgagcaggcgctggtcctcattgcggctgcctgctggtgacgggatgtccgatcagggaggaggagatctcacatacagatgtcaatctggcatccaagaaaatc

SEQ ID NO: 628770 - DNA, 1654 bp, Homo sapiens
  misc_feature (127)..(127): n is a, c, g, or t
gctcctcttctgggctcacgattgacaacagcgaagcgcctggctcgtacgccagtcagtccagcttcctgggatgaccaggctccgcgcaacgggggccctctcggtccggagtgctcagcgcagnagcgtttgggaagatcagtccactctcatggttagctctgtgaatgacgtgctggttatgtggggtgtacggctacgaaggtacaggtgacgcttgctgcatccactacatgtaccttctgacctggaaggatcattggtgaaagacgaggtagactcacggagcctagggatgatgacactgtcctggatccatgaaggagctcctcgtcgctgaactcctcggtttaccgaggatggactcagtcaataggctgaagtccgtccgtcagataggcctgcacagggaacaaccgtatgtcgagcagttggacaagattgggaaaaaacctgttgcagagctggccgggtgctattttccttacgggacagagagcccactccgaggcatcagacccaagacccagctgccctgctgcctcactttcctggctagaactagatcgccccggcaatggcctttaccaagcaagaatcgtccagcggcataggctagggtcaaggcgcctgcgggttagccaaggagaaccttgcttgaaggccgggtgcccaatacgtaggcatttggaacccccgtgtccctaagcaaggcatagggcccttaaccgggcattgagaactgtcgggcccattggctggcgtccttcccgagagaccctttcaaaccaatggccaccgttgggactgctgcccggttgggtcgttttaccttacacaacgcacacggcggcttcttaggcaacgcttgagttcccccccggaacaaaacggtagaggactacgtaccaaaaagtcccaacacacgtcgaaatgcgacttacgcccgggaaggcgttggaaaggccgtttgccgcgaggaagggggcccccccccaaggcccccccaactagtaggcgcacgcggctgtttcgtgtgcgcaaaggcgtttatacggaatctgagtccctggccagatgagccttgtggcttgagaaatacataaaccatttgggtctttcacttggaagcgcacatttagggctttcgcggtatggccttaagtttgacacgcaaagtgcgccccagcggattttccgaagcaacgcgcttcacattagatccccagggcacatatgaattattccagggggttggagaaaccaacacccctatttggtcggaacacatcgcgagtgaaacacgaggccccatatcggaagaaatcggagccctgggtgccaagggcccttcatttccaaagggcgggcgcaacacactgctttgtgcccccgtgccgacatgcgtgacaggattcaatagccacaaagatgtatatcaagagaccactcattagaagccccgaataccgaaagtgtagtgagcaccaagtgacccgcgaaggcaggacacccacgtcatgagatgcagccagctcacgcaaggtgatacgtgaacatcggccgcaccaccgacacccctgtgtagtttgttcacaccctagctggaagtcagagagaagcagatagagacctaccagctcgagtatgt

SEQ ID NO: 628771 - DNA, 207 bp, Homo sapiens
cccggtaccggtcgacagcttcctgatgtcgcgagtgcatggtggctcatgcctgtaattgcagcacagcacaaggacagcttggggccaggagtttcaagatcaacctgggcaacattgtgagaccccggtctctacagacatacaataaaataaataaaaaaattagccagtgcacagtttaagtgccttgtagatcattagcta

SEQ ID NO: 628772 - DNA, 360 bp, Homo sapiens
  misc_feature (51)..(51): n is a, c, g, or t
  misc_feature (58)..(58): n is a, c, g, or t
  misc_feature (148)..(148): n is a, c, g, or t
gcccaaaccatccaggattaaaaggggcccttgtgttgccccccccctggntgcctgntaagggcccatgtgatttgcctggcaaaggagttttttcaggaaaaaccagggcagcttttgcccctaaagggccaatgcccttgctgtnaaaagtccctgctttggggagacctgatttggctgtgccaaatggaccctgaaaaaaaagtaaaagactcagaattaaaaaaggccccctggacagacctgctggagacctgatcctcagtgtccttaccccctcctaccttttttttgtgccccctgctgtgggtccagcaggtttttacttgagtacaataaaaagtttgagtcaaggga

SEQ ID NO: 628773 - DNA, 798 bp, Homo sapiens
  misc_feature (8)..(8): n is a, c, g, or t
  misc_feature (29)..(29): n is a, c, g, or t
  misc_feature (436)..(436): n is a, c, g, or t
  misc_feature (460)..(460): n is a, c, g, or t
  misc_feature (462)..(462): n is a, c, g, or t
  misc_feature (479)..(479): n is a, c, g, or t
tgaatggnaacgggaagccacgacgcatnaatgaaagccacaggaaagaagcccgtaaaacgcaggcaggcaggggcctgggggtggttttgaagcccagacacgtgttttccatgtggtcctctcatgcctgaaaggccttttgcccttacgtttacacagttattcctgcttttgaagaacttaaagtacctgaaaatgtcttcactttacgaaagaactctgccaagggttctctaaatatctagctttgtggatagttttaaatataattcattttacagactgtgatataaacatttgcacaaagcgaagccatatttctgttaatttttgtaatagagtagaaacatacaaacactgcatctaccagacagacagtctcagcccatttgctgacatctagattaattatgcattaaaagaaaagaaaaangaggtgagacagccaaaaggactntnggacaccaaggaggttncaagatctttctcttcaaaaagagaactgaaactattgttaagcccagaaagatgaagatgtacttagaagccctccaccttgagggtcttccttcaaatgtgacttcagggatgaagtgtaaggctcttcctctgctccaacctggcacctcactgcaggcatcttacaggatttgccagaggatcatggagcccgtcctttacaggcccggggctcagagctgtccccggacagttgtgcaggaaagcagacagcagtgcccaggctccagctagacatgagcccggcatatcagaaacagagatcaacgttcccta

SEQ ID NO: 628774 - DNA, 883 bp, Homo sapiens
ggaaagaggaaaaaatgaggagtcattggagagttacgagaatggcttccgggctgcagaggaaggtgtccagaagcctgctgcagaaaccccagactctgcttgcatccctggtcaagccctcagcatccacatccaccctgtgggatgggaagaagagaggggacctcccagcggagccagtggtcttcgccctcaagggggctgtgcaggaacatggatgcatgagggagcagtcgggcgagtttctcacgagagcagtgctatcgctctccttccgcctgtggctgagccgttcccccagcactataagagtctctactcgtctggccttcctctacacctacagtaagacccatcggaacctccagtgggcccgcgacgatgttgctaggcagcagtatccctgtggcaacaactgcagcacatgccgggcacatggggctcttctgcgagaggaacaagaccaatttcttcaacggcatctggcggatccccgtgcgacgagattgaccggcgggacagctttgcctggcacatgaaccgctccatcgtgctgctgctcaaggtgctggccgagctgcgggaccacaggaccctgctgaaggtgtcctccatgcttcagcggaccccagacagggcaagaagtatctgcgagattgctgaccgccaggtcctggtgcagtgggccttcatcctcactgtgaagggtgctcaaagagacgctgatcgagctcgagaaggggtcagaacggcccagggccaggtctggggcttcccggacaggatgaccacgatgtttacaccaaggccgtccttgaggtggcaagaggctcccatgaaaaaccgctggtatggtaggcgggccagcagggaagtggcc

SEQ ID NO: 628775 - DNA, 798 bp, Homo sapiens
aggctgtactggtccgaagccttatgatcgggagcccggttggcgtctggtcttcgctgtgggccccgcggagccagactgctgcccccggcgcggggagaagatggtgcctagcggcctcgtggcccgccacgcgccgcacgagtgagcccagcgcgactgcgggctgtcgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcggccatggccatagctttccgtgaccctgggctacttcttcagaatcaaggagattaaatccccagaaatggcagaggattggaatacttttctgctacggttcacgtgatttgggacttgttgtgtaatcagagaaatgaaagccctcaagcatctacacaaactgagaccacaaattccgggaagtacaaatgaaccagcggggcaggcccgatgcttccacccagttccccccaggccctggaggactcggggccgggtgaaatatctcagtctcaatcaacctaaaccctggacccaattgaaaacccttcgggagggtaatacccggcaacgtacacccatcgtgtaactcaaccattctaaggagcatcagaatgggactttcagggccagtgaagcccaagaaggagataaacaatcaccttagccttgcctacagcgttgaagctcagatgattgcgccctca

SEQ ID NO: 628776 - DNA, 320 bp, Homo sapiens
ataatggatgttgtcctagttagaagatgagtaattttagggccggatgtgttggctcacgcctgtaatcccagcagtttgggaggccaaggtgggctgatcacaaggtcaggagatcaagaccgtcctgtctaacacggtgaaacccatctctacaaaaaatacaaaattagccgggcatggtggcgggtgcctgtagtcccagctacttaggaggctgaggcaggagaatggtgtgaacctgggaggcggagcttgcagtgagctgagattgcaccactgccctccagcctgggcgacagagcgagactctgtctcca

SEQ ID NO: 628777 - DNA, 194 bp, Homo sapiens
tgattatggtagctagcactgaatgcgagggtagaagcgtggtgagccagcagcacattagataaatacctatcaagtgtgagcttagacgtctaccctcaaatactttaccgtaatgctaattgtagatcattgtcattcccttcagtcacattagggggaaagtagttggctataagtacgtcattcttagt

SEQ ID NO: 628778 - DNA, 222 bp, Homo sapiens
attatcataggaggtggagctactccccacctcccaccattatatacattattgttgcacgaaatgttatatttaccagcatgatgtttccctcatccttccaacaaaataaggtcacactgtgggtcgtatgagccttgataatgttgtcctcctgttcatctgtgcaccacttgacagactgtagcttctcttgctctcgaccggccctgcattcttccg

SEQ ID NO: 628779 - DNA, 238 bp, Homo sapiens
gtgatttatcccaacacgtggctgagaagtgattcaggcgtcttttagtcttccgaaactccttgctgtatgtgttgggcgataacattgtatttatccccaacacccaaaaaaaaaaaaaaaaaaaaaaaaaacctgggtttggggggggccccttgaatccccatttcccgggaaggttaaggcagaaaattggtttcgcaccctgtgaagccaaaactatcgagtgaaggggaat

SEQ ID NO: 628780 - DNA, 1090 bp, Homo sapiens
  misc_feature (289)..(290): n is a, c, g, or t
  misc_feature (292)..(292): n is a, c, g, or t
  misc_feature (324)..(325): n is a, c, g, or t
  misc_feature (329)..(329): n is a, c, g, or t
ttttttgacagcagcatctgtttattgacaattccaggtcattcctaacacgccgcagcaaggctctgtacagtccggcccggtggttgttagggagggtatgcaggcacacgaagacacaggtgtgtcgggaagtgcacacaaaccgttgtctttcctttttggttaaagaagaaaaactttgtgatcaatatcccgctcataagtaaaagtggtgacgtggaaacttgattgctttcatcagggcgtgtgtgcatctcctctcccatttcatgtgcagtttattggnnantgctaccgtcaccagcagacacctgtaagtannaacnaatgtcaggaaggaaaaagtatgaacaacaggaagctccagagcggctccatgcggcgctgggctcagtagaagcagacggtgtgcagaaaggtgcggccactctgtctcctcgaactcctgcagcagcatcgtcgatctcgttctccatgtcttgccgtgtgctggatacactggcagagctcacagatgagcaacgcccccagggtaggcctcctcgtggttgtcctggatgtcacacattgaccacgtgcacaggcaggcaggtctcctgttctctggaattcagatctgccaccacctggtcatacactctctcttcgcaagtgaggatcagatcaaacaggtctttgcagttcgtggaatctctctggccggggcgttgattctctcatttctgtccagcactagtgctaaaatcccattctgtgtatagagttctttgtcctttcctaagaagatcagttgtacatctggtcatatcgtggttcttgcaaactcataaacacttgggcttgtcgggagctggtcctggaagcttcatcgtgagtcccatgttcacaaaggatcggacgctgaatgcacccgatgtatgctgaggatgatcagtgcacctaccatgctccgggatctggttgcatcgagcacacacaccgccacacgcgccatgcggggacgacggcatggcggcaggccgcaaaatcccgcggcatctcccgcttgggttcccaccctaccgcggcgattccgcgagaacccgct

SEQ ID NO: 628781 - DNA, 157 bp, Homo sapiens
tctcgtgtttactgcttatttttcatcaacccatgcctttttaaaagcaaaaattatattgaattattattcatcctttcttgcctttattaaaattgtctaattaaaattctcaattatttagatgaagaaaaagcatttgacaaaatccaacatc

SEQ ID NO: 628782 - DNA, 129 bp, Homo sapiens
ctgggacgggagtagaggggtctgtgtgtagatctgagtcctccctcacattccagcctgtgccacaagccgcatcggatgaggccggtctcccttcttcactggtctcaaaagccacccaggcccaag

SEQ ID NO: 628783 - DNA, 331 bp, Homo sapiens
ataccaatcaacatataggaaggtagaagtgagtcccataggtacccaactaatgtcaccagtttccgtggtatatctttcctggagtttattgatagtgtgtataagtaattatgtatgtgttcaaatgcctttctcaacttttcttttagagctgcctcttgttaacagttccattccattgtgtggatgtactatggatttattgaaccagttccctactgattattctgttttttgcagtcttttgttatgatgaacattccacagtgacaatgttgttcatagtcattcacacacatgcaagtccttctgcaggatatatttctag

SEQ ID NO: 628784 - DNA, 252 bp, Homo sapiens
tctgtactgagacactatcaccaccaaaaatttatccctcgatatatttataaaattatttaaaataatatactataataaattcctatccttttttattgtttaatattagtatagtttaagtttaacagcatgccaaatcctttggcatacgtgatggccttcaacaatctctctattaagtatatctattgctagagtattccggaagtaaaagcacattaaagcaagtatgagatgtaggtaaccttt

SEQ ID NO: 628785 - DNA, 219 bp, Homo sapiens
ttatagatcccccgactggcgccatcacggccggtggcccgacgtcgctcttccccgacgcccttaacccgcagctgtatctgaccgcctggtatggcaaaccgactgtggagacgggggtgccgtcaaatatttacaccctcgacaccacgggactgacccaggtgacgaacggtaaggacaaggcccgctttgtgctatccccaggtcagaggtaca

SEQ ID NO: 628786 - DNA, 793 bp, Homo sapiens
catataaccatatgaatttatttagagctaactttcaaagggaagctctaaattaatttcatgatggttatatgataaaaaaaaaaaaaaaaaaaacaaaacaaaaaagaaagaaaaaaaaaaaagacaaaagaacaaaaaaaaaaaaagaacacacaacacgacaaaaaaaaccagaacaaacaaaagaagaaaaccgaccacataaacaagagagaacccacagacggactactcagcagcggccagccctccacacccacaatgccgacagacacaactgaaacaccaccacaacacacaccacgcacaccaccagcaccgccgcaaccacacagcccgacccagcccccccacccacacaccccacacctggaagcgccaccagccacgaagacacacaccgtcgactgcgcgagatagctagcaactgcagccacgacgggcgtgcgtcagacgcagcgaacctcccccccacccactactactcatcccccctatagatcctatgtattccaacataataacaactaattatctgccgcatcagcacaagatcagccaccaacacactatttactaggagcatatcgcttctcacataacatacatccaccatactactacacttacactctacttagtactaactaactacacactatactgctacatacctaacgaaaacacacatcaatacaatcaccataactaaacttcactatcaactaatatattcaatctaacaacaacctaataatcaactataattaatacaataatctcaatacaa

SEQ ID NO: 628787 - DNA, 371 bp, Homo sapiens
caagaaggcagggtcactcctccctatggctaagttttggctgtgatgatgtgcttaggcacacagtgccatttaaacataccttatcttttatctgataaatgattttttaaaaattacctgtattcatcaatggctaatactactgttcacctaaatccagtacaactaattttccctccagctttggaaatagatcagtttttctccacctgagcaccagagaaagtagttgtcccactctcacccccccaagtatatatatttgggggtctttttgtgtgaaaaatagtttctttagaaaattaggttcatcatctgtgagaggtgctcatgctgtggtgtgtgtttttgtttttagtcactttttt

SEQ ID NO: 628788 - DNA, 182 bp, Homo sapiens
  misc_feature (2)..(2): n is a, c, g, or t
tntaatatcagcggagactttatttgggccaagcttgaggattgcatcccaggagcacagattcaagttgccctgaatatacactccgattagcagaagttgaaatggattttaaaaggacaagagagctcctgagttgtttactaagaatttacattaaaataacaaactggctggctgca

SEQ ID NO: 628789 - DNA, 822 bp, Homo sapiens
ccctgcccatgacccctagcaggggccctctcagccctcctaatgacctccggcctagccatgtgatttcacttccactccataacgctcctcatactaggcctactaaccaagcacactaaccatataccaatgatggcgcgatgtaacacgagaaagcacataccaaggccaccactacaccaccgtgtgcaaaaaggccttcgatacgggataagtcctactttagttacctcagaaggttctttgtttcttcgcaggattttcttctgagccttgtataccacttccagggctagccccgttatcccccaacttaggagggcactggccttccctagacaggcagtcacctccgcataaagtccccatagaagatcccactcctaaagcacagtccgtagttagctcgcgagtcaggagctaatgaatcatcctggaagctcaccatagtcgtaatagaacacacgagaccggaaaccaatgtagattcaagcactgcttatgacaatttgtactgggtctctattttaccctcctacaaggcctcagagatacttcgagtctcccttcaccattaccgaaggccctctacgggttcaacattcttgtgtagccacaggcttccacggacttcacgtcattatgggttcaactttcctcacttatcgtgttcatccgcgaagctaatatttccactttagatccaaacatccacttggcttccgaagccgccgcctgatactggcatttcgtacaacgctgcgtctgactatttcccgtatgtctccatctatcgatgagggcttaacaaaaccaaca

SEQ ID NO: 628790 - DNA, 175 bp, Homo sapiens
aatgtactgtgcactatcaagaggttaggatttggctgaagctcttgttgggaggtggggggtgcagatggagtgggtgtagcagaggggagcacttggcgctctggagcggttgggagcttggttgtgtcttcagctgaggcaccctgaggtcgccccgatgtggtctggcggg

SEQ ID NO: 628791 - DNA, 666 bp, Homo sapiens
ctctctggaggcattgcaagatccaggaaaaacaagtgatgggttgcttttgaatgagaatgagcagtttatttgttaactggtggtattatggaaaatccaagtaaagaactgagggtcagattgaccttgcctcatagtattcgatcagattcagaagatatctgtttatttacgaaggagtgaacccaattcaagctcctgataaagacagaacagttttatagacagagcttttaaagcaagcatggaattaaaaccgtttctcagattatctccctccaaactctaaagaaggaagtataaagtcctatgaagccaagcgtccgccgttcatgagcaggttttgagtgttcattccgttacgtgatgccagaaattaggcggcgtcttaccctcagctcatgtgggagacaattgtctagtcaaagaaaagaaaaggttccaggtatcgtgtaaaccttcatggtccaagaattatatcgaaagaagagatcaagtgactggtatagagtggaaacggctcttaacacatttctaaacagtggttacttgcaagtgctatacagtattggatcacgattggaatgcaaaattgagcacatcatatgacaaaccattggctgctgtcaccaaaggacttacagaaaaaacttgccagagaac

SEQ ID NO: 628792 - DNA, 517 bp, Homo sapiens
ccttgcgcactgctcaccggcagttagcttgttcccaggatggtgggtggcgactgatcatctaggtcgtgctttgatgttgcatggtcccagagacgtctaccatcagacatctcattacatcttgttcatcattcctcgtgaggaaaagacttcggacatgatataggacttgctatatcacaaagtattgtcatatccggatgtctcatttagatcttgtacaatcactgtttaaggtaatttggcaagttattaatactcatgtcctcattttactgaagaggaaactgaaatgcagagagcttgtcttttgcccaggatcactcacccagtttatcgggaggcagcagcacggggattaagaacatgggttatgccgacaaccaaccaggcagaattccagctctgtcagtagttagctgtctggccttaggaaagggatttcacacctctgtggcttagtttccttgtccattaaatgctcataagaatagagctttcctcacagagattg

SEQ ID NO: 628793 - DNA, 396 bp, Homo sapiens
  misc_feature (3)..(3): n is a, c, g, or t
  misc_feature (29)..(29): n is a, c, g, or t
  misc_feature (50)..(50): n is a, c, g, or t
  misc_feature (56)..(56): n is a, c, g, or t
  misc_feature (87)..(87): n is a, c, g, or t
  misc_feature (101)..(101): n is a, c, g, or t
  misc_feature (104)..(104): n is a, c, g, or t
  misc_feature (391)..(392): n is a, c, g, or t
ccnagggctgggggtgaagtgcctttttngggctcctagccccccacagnagcatnccccaggggtgtggttaacaattaaatggcnccctttaagcagcntcncatcccacagatggcctaagtgttaacccagctcaatggagagtcagggtgacagccttttacatcctgccctcttggtaccctgggttcttgtccagcatccagaaagaatcaggtcacatggacttgaaggatgcagagattttattgagtgtgtaaaaagtaaagtaaaggttcctcttcaaagactttcctccccgtctaattagaaataaacagtaacttctcttaaaaacaaaatttattcaaagacctgtgctaacattcttaaatatctgctagctganntaat

SEQ ID NO: 628794 - DNA, 800 bp, Homo sapiens
  misc_feature (9)..(9): n is a, c, g, or t
  misc_feature (16)..(16): n is a, c, g, or t
  misc_feature (18)..(18): n is a, c, g, or t
  misc_feature (67)..(67): n is a, c, g, or t
  misc_feature (231)..(231): n is a, c, g, or t
  misc_feature (342)..(342): n is a, c, g, or t
  misc_feature (356)..(356): n is a, c, g, or t
  misc_feature (608)..(608): n is a, c, g, or t
  misc_feature (610)..(610): n is a, c, g, or t
gcgcggganttggtcntngggaggagctggatcgatcgttactccgggaagcactgttcaggacttnttgaacctggccgacaaggtcgagcagcatcttggaatggtgttccacaggtatctagagggaacccgaccacgtctcagaattctgctcaacggacagccggtgaaaccctgggatcctttcatgacggaccatccggggaaaccctacaaccctcccgtatncaagcacccgacactcaaggggattgaagccgaatgtcatgttttaccgcacaaggacatgctttctggcgaggattttgaagtgcttggtggccctgaaggctggacggnccagcaggggtttnatgtttatcgcaacgagcgccttctcgttgcaggcagttggctgggtctggggaccggtaggtcttggacaaaggacgaagctcaccgattggcaagaattcgtctggatatacccaactctgccgacgccgactggaagattgatatccgcaagtccacggccagaccccctgtctatcttcgagactggctgacccgtcttgccgaagctacgcgtggacgtgcgcgccgagcctttgctcacagaggcngnccaccttgcttggaaatcaacaggttgccgaagccggaaggtgaggcaggaccactgggggatcctagagtcgactgagatgaagctgagggtgttttaaaaaaaaggggaggaggggggggggtatttttttattttgaattaaaaataataaaaaacgaattaaataaaaatatacatttaatgacat

SEQ ID NO: 628795 - DNA, 957 bp, Homo sapiens
gcacgcggactatccccctaagacaggcacaaagacatgggaaccagctatacctataattcggcgcatgaggctggagtcctaggcacaggtctaaggctccttattcgagccgagctgggccagccaggcgaagccttctaggtgaacgagccacatctgagcaaggtcatcgtgatagcccaactgcgatttcgtaataaatcttcttcataatcaatacccatcatcaatcggaggcttgggcgaacatgacattagttccccttaatgaatcggtagcccccgatatggcgttaccccgggataaactacataagcttgctgacgtcataccgtcggcctctctcctactcctgctcgcatcgtgctatagtgtaggccggaggcgaggagacagggttgcaagcagtgcgtaccctccctgtagtcagggggagactactccacaacccctggcgaggcctgccgagtagtacccgtaaccaaatcttacttccttaacaacctagacaaggtggtgctgccctgctgatgcttgaggggggcgcatcaagttgtgcagttcacaaacgaagttagtcagtagtaagagtgccccgtgccatagatgccacaggtaaccagaacgcgccctcttcgtggctgactccgtccgtaaatgcacatgcaggtcctacttcctcctatactcctcccagtgctaggcgtgtcatggacatgcaaatatactactaaacagaccgcaattctccaataccactttctgtcgaacccccgcgcggaggacggagaactccattctatacaagacctattgctgaggttgacggtcaaccctgaagttaatatgcttaacgctacccggggtttggaaataatcccccatattgtgatgtacttagttccgggaaaaacagacccttgggatcactaaggatggccgagttggaacaa

SEQ ID NO: 628796 - DNA, 813 bp, Homo sapiens
  misc_feature (296)..(296): n is a, c, g, or t
  misc_feature (602)..(602): n is a, c, g, or t
  misc_feature (813)..(813): n is a, c, g, or t
ggcatttactagccagagctctgaaaggcagtgctgtcgtgtttcttgtactgcgaccaaagtaaaaatccacagcacattccccttgcaagttaggggaggccctactgacttctcaaagcagagaggcagcttatcaaactcagcgctcgaaaacttctgtttacgattgaggtgggggagatggacggccagggaacgtcacagagttgggatgttccatggaccatgttgcccattgcaaccgacacaatcgcgcggaacttccatggagtaggaggagtggtccactcccnttcgtactcacgtgcagcgtaagagatcttagcgagaggcgggttaattttgccctcgcaaacactacttaggccaagtagtgcgaagggatggcatgggcagccacgtgcctcgagccgctccctttcaatcttgatcttacatattgcatggcccttataccatgtcgtgtgagattggtgccgtagtttcgtggcatattgtgttgttaccccctactcgagccccctattgacgcctacagtctgatcctatggaggtagattccgttgttccacattacataacatgtcccatagaccccnttggagacacatagacagaccacagaatttatagagaacataacacattcatatttacaaaacaaaagagacagagataggttaacatacacatatacaccattagaaaaacaaacagagagagcagagacattataccacttggagggaccaaaacagttatatgggcgcggggacttgtgaacaattccctgcggaaggccggtttggn

SEQ ID NO: 628797 - DNA, 885 bp, Homo sapiens
cgaggcgtttcaaaaggggccccaaaaggtggggttgtacagaataaaagtgccgtctggcaaaaaaacacggggccatgggcccctccaaagtgggggcggggccaccagcacacagctggggggtgggcgcaaacaagaccaatcggggaaagccgagaaaagagaaacagagtgggggtgcgccgcagaagagaatgacctacgggcagtcggcaagacctcgtttcataatggccgcattcttgtccccgccggtactcacaggtgaaggagccccgcggcgccccccccaagcgggggaccaaacaccgcctttactctggcggagggcccaaaaaacgataatgttgtcgcgaccccctcccaggcaaaacattcttgacaatgaggcgacccagcagggcaatcccctccaccaaccaggtgagtctcctccacgtgcacaccatagctaaaaggtggccaacccggagtccccacccgtgtggcagtgggcgacaaagacaaccgcccccccgtgtgtacaaataggagcacacacataacttttttggcaaaaaaataaccgcgcgaacctgattatgttatcatcaatcgaccccaattccccaggactcctagatccgcccacaatttctagatacagatacataatgaaggcgcccacaccatttaataatagcacaactctacttcttgttcaagaagaaaacaatcctgttattattccttctggcccacaaaaatcgctgaaatgcgcttgcttttaatatttataggcgcttgatgtcaccatgcgggttttcaaaacattttgtttaatattctgcatttttccgggcaaaaaaaaattcagccaaatttaacagcccacaaaacaaa

SEQ ID NO: 628798 - DNA, 211 bp, Homo sapiens
tagaagtgcaatagcatttttttcacgagctaacattagttttcctttggtgattggttttaactggctcatgaataagcaatactttagctggacactcatgggttttatggtataaaacgggtttcttcactccccgtttatggatactttgggctcagggctaattttggttccttacaagactgctatggaaacttctaaaactagg

SEQ ID NO: 628799 - DNA, 234 bp, Homo sapiens
agagttatagcatctgtttgagtaagagacgccagtgagaggccagatcaataagatagaaaataatagatggacgttatgtataaaaggcaatgtttaaattatgcaatctagtacattcgattggatgattcctactaaattgactaaccaaaatgtgaaagttcggatacccggatggaaatgtttgataaattgtacgtgatcatttttgattaggatgtaataagtaga

SEQ ID NO: 628800 - DNA, 374 bp, Homo sapiens
gcgaccaattttatcggataaccaaccaaggaacggaatggtcataaagccgagaatcgaactgatcatcaatgcatctgttggaattgctttgttaaacaataacgtctgcactatatagcctgcaaggaaagtctgaattaacccggagttacccgcctgaccaaaacgcagccctgttgccagccagaaggatttgctctggaacatgctaccagcaggtgcaggttttgctgtcggttggttactgtcgttaaccttctcaaagaccgggctttctttcagattcatacgcaaccagatagcaaagaccatcacgacaacactcgccaggaacggtatacgccatccccacgccagcagttcctctttac

SEQ ID NO: 628801 - DNA, 490 bp, Homo sapiens
  misc_feature (27)..(27): n is a, c, g, or t
gctcctgggcctgctggggcctctgcntgcccagcctcagggggggccctggcagaccggagagagcggaggcccaaggagggcgcgccttggccccacaccaacccccagggcctcgcgcgagtccctgcctagccccttttgcccctgcaaatgcccagcccaggcaaattgtatttaaagaatcctgggggtcattatggcattttacaaactgtgaccgtttctgtgtgaagatttttagctgtatttgtggtctcggtagttatatttatgtttagcaccgtcagtgttcctggccaatttcaagagaggaaaaaaaggagggaaaggtacaagaagagagagaaaaggtgaatgacgtttgtgtagccagtaggagaaaataagatagataaataaatcccttcggggtaccctcctgtataaatccgacctgtgggtccgtgctcgaataggtagtgaaactgatagtagtttgtaaaacttt

SEQ ID NO: 628802 - DNA, 443 bp, Homo sapiens
agaataaagttcctttttgttgttgaaaggccaaaaaattaagaaaaaaacaaaaaaaaaaaaaaaacccaaaaaaaaaaaaaaaaaaaaaaaaaaaaaaaaaaaaaaaaaaacaatgaataaaaaaaaaaaaaaaaaaaacaataaaaaaaaaaatggcgcccccttggcccaactcacctttaacctctacaactttaagccagcggccccaattcgggcccaattggccaaattccccaaaagggggggggtataacattaaacggcccgcgttttaaaaccttgctacttgaaaaacctctggcttacccaatttaacgcgcttgcaacaaaatccccttttccccatttgccaaaaaccctcagggcctcgacacaacgctcttccacaacgttctcacccctaaaggcaattgaaaattctaccgcaaaatttcgca

SEQ ID NO: 628803 - DNA, 82 bp, Homo sapiens
tcgatacgactttttcttttaactttcttttctcaccgtcagggcttctatttcactactcctccccttctgtcgtcttctc

SEQ ID NO: 628804 - DNA, 170 bp, Homo sapiens
tagccacaccacgtcatggaaaacagcagtgattaacctttagcaagtaaactgacagtaacactacgctatactaaccccaggcttggtcaatttcgtgccagccaccgcggtcacaggattaacccatgtcaatagaagccggcgtaaagagtgttataagatcaccc

SEQ ID NO: 628805 - DNA, 308 bp, Homo sapiens
tcctgagtatccggaggcattaatacgggttcatagttcatcctctattagcataacgtgaagaaggttgagaagcactgtcgatgtattagaatgctagtggactgttatacagctgtctggttgtaaccattatggtagtctttttagtcttcaaagtgtctcagtgatactcagtggaaccaagatagattataaggaagcaccgtgctcccgtaacagttatataaattaggattttggtaacgtgaactaagagcgccccactccaaagtgtaacttatgtgtcaaaaggtcacttgattcag

SEQ ID NO: 628806 - DNA, 257 bp, Homo sapiens
tgctctagaggatccatgttattgccaacacccaacactgtatatgactcagagaggacccagatggtgtctaccatcttccctatatatattcatgccttgagggcttcattgtagatcaaagcaaggcccccaggaaggtgacatactcctggaagttcacctcctggtccttgtaccgggtccacgtcttccatcagccttgcaattttcagcatcctgcagcttcgagccaatggtcgtgtagggggataaca

SEQ ID NO: 628807 - DNA, 1628 bp, Homo sapiens
  misc_feature (1356)..(1356): n is a, c, g, or t
  misc_feature (1399)..(1399): n is a, c, g, or t
  misc_feature (1439)..(1439): n is a, c, g, or t
  misc_feature (1459)..(1459): n is a, c, g, or t
tgcacctgattcacgtaaatcttgtagctaggcattccggccatctacgacctactaagacgatagctagtagtatgcgcgtcatcctcgtcattggtcgttcgcgcgtagtatagcctataccggactgatagtactggtagtgaagcaatatgctagatctacagtggtctgtacagcggccacgtgccctgctgtaggcgcaggattagtgcactcatctggcgatgactgaagtcttttggctcggccttagcatcacatagggccgagtaggagccgtgcagcgccataagtgcagatcatcccagatcctcgctgaaccaccattatgtgccttacgttatgtgcagcttcctataagtcggttaaaacgcgttacttcaccaactagcgtcaagacaactcagacgtacgttgccgcgaagcgaaagtcctatccagtgcacgtcatcgcgaatggtggaggattgcgatcgtaaatccccgatacatagaagagaaggagtaatatccagggacgtctcacaatggtgaaaacccacggcggagaaagtgcgcgcaaagttcatacccatggtattcccatacagcgccttctaaaactgattaaggtttcctcaaacacgtagatatgtcgctatgagcacaaaattcttacattgggacagcatgagacgtaacgcgcacaagcaatcgagcgtccttactcatcacccggaattcccccatgttgaacaccaacagccccttcgcctctgacgcatgagaattccatctcgaaaaggctaaaccactattgagaatggcggtaacttcgaccgttccaacggagcattacccctccgaagaacatcgttctggagcgcagccccaccgtatgaatgcggcacaaaggcgagaaagagccactgtaacatccatcctgcacagcgagtcgacaacgcacagatcacgcctcaagccttcatgtaagcgtacagcctcttttggccccgtcaccgagacgattgagcgtccattatagacacttctacattaggacgccattgggcactacaaacggtcggccaaacgacagagatatggcgatgacaagtcctcaagctcagtggtgccgcatcgactacgcgacgcgaagacctgcgacacaaggagcgccagccagcacggctgacaattggctcacctcaacacgccataggggcgaacacacctactctgaggtgcgtgtcgccaccacgctcatatgtcagacctcagctcagtgaacacaagctaggacccctatacgtacacaagctgcctgcaggaggtcacacctgtgacacctgggccaactgagtactgtcaganccagcgtggctccgcacatatgcgtagctcaccgatacaccangaccctgctcgcacacggagcacatagacgatgtcgtgcncacacaccggctatgagcgncaccaccgagtgagcagctctacgagatcacgcgtactacgacttatatcgagattggtgatcacacatgcattcgccctacgagacatcggagcgccgctcagacggccacgcgccgcacgcacacagcgacacaccggaccaaccacacgcaacgcagtcagaacgt

SEQ ID NO: 628808 - DNA, 998 bp, Homo sapiens
  misc_feature (58)..(58): n is a, c, g, or t
  misc_feature (127)..(127): n is a, c, g, or t
ttgtgctaacttctatgtcaatgacggaagtactcacgagccgatctatagtttaccngatgctctctctcgcctctcgtaatgatgctgctcctgcacagatatccgaccacttgttgtgagtccntcaaatccatatgtcgcttgtgccaatatcaacacctggcgctattcgaggtgagcttctccttcttgtagtcccctcctcccggcttctctactaaaatctttaaggggcgctctccctgtcttaaacatatatggccaaaactcaccatacctaaaatgtctggccaccaattctctcctgtggcaacagaattgctctcctgtaaatctcctcttgggcaaaatcaacccaagtgtgtcttgcgcgctgcgatagcgcgctgtgcacgaaggggtgcaaaaaaggccgcggcttcatcagcggtacaccccaagaggccggggcacgctctgccagaacggttgagaacgcgggaatcttagcagcctcacggggtgtccagacagagcgcctgttcacacggtagacgcccctcccctcgctcccccactcgcaataggtggtacccctacatgccggatacactcctgcgatacggaacagcggtgtgacgtagaagcgcctccctcacgaacactccgcggcgccagaaaccctgtttctggtacgcacatgagcctcaattctctatcatttgtctgaaaaatttgagcgtgaaaatcactcccgctactgacaagtgattgtacgagcagagtcgcggactagaacaatcgtatgcgatacaaactggtcttttcttataggagatacaataccactgcggatgaactgcaatattttattccgggcttccacagccctagaaacaaaaatgaatctgctcagccccacttctaaactagcgcctcgctgtgttcaaggatccagcgatgaaaattacccattcatgaggggaataaaatttaaaaccacagcccacaaaaca

SEQ ID NO: 628809 - DNA, 221 bp, Homo sapiens
gctaagtttgaaaaataaaaagaaattgcatcacactaattacaaaatacaggttctgggaaaaaatatttttcttcattttaaaacttttttttaactaataatggcttttaaggagggggcttaatttggggggtggtaactaaaatcaaaggacattatttactttaggggtctctttttggataaggaatacatcattaggcttaaataggccggca

SEQ ID NO: 628810 - DNA, 228 bp, Homo sapiens
tctagacgatcggtatgagcagctggagaatacaactgggcttaagcgcgtgcgaggtgcgttccatggggcggtgagtcagccagaaggccccactggcatacacatcgtcaacgagccggaccccctccataaaagctgctaaaatcattaccaactcagtctgattagcacatgcagctgattgagatgcgtgtatgaataatccagggtctgggtctgaggccg

SEQ ID NO: 628811 - DNA, 211 bp, Homo sapiens
gcacgcccagctgacagtttcttacaaagttaaacatacacttaccgtatgatccagcaatcctactcctgggtatttactcaagtaaaacaaaaaactatcttcacagaaaacctgtgcacaaatgtttatagcacctttattcataatcagagacaccccactggaaatggataaacagacagtagtacatcacatgatggatacttct

SEQ ID NO: 628812 - DNA, 641 bp, Homo sapiens
  misc_feature (439)..(439): n is a, c, g, or t
atccaggagaccagcagcaggctcaagaccccaaatgttgggcaccacaaataatgtgatatgtgccaggagcacggggggtaggggtgaaagagaaaaacaataaggccttaatttttgacacaccatacactctgaaattgctgtttagcaatgcatttggccccacaaaatagggggtggaggtgggacaaaagttaaacctagatagcctcagtcctaatcacccaccttcctataccttggaaggctgctgaaccttgcctatgtcgttctcctaactcctccagacttcatctgaatgccactcagacacaaacaaaatcacacagtagcttcaagtagccctctccttcatctcagccctaagtgagctggccactgagtaataaaagaagctaccacatttatagggaggccagtctccaaatacaatggnagtgggggttgttcactgctgtgagtcaaaaattgactgttataatagaagagagttttaaaaatgtaatactgtttatttaacttcaaaaacatttcagcattctaaacatccaaaaaaaaataacagacggttgcgaaatgtgttaaagtacagaagttcttgaacctttatttgatgcagggattctttgctttggtgg

SEQ ID NO: 628813 - DNA, 187 bp, Homo sapiens
actctggagagagagttttggcacttgggttcctcttcctccaggaggagccatctgacagggagctgttatcagaggcactgaggctctcgtgcccaggtggagagcagcagccgggaggtggctcgcgtaattgcgccggctgatcgaacaggcagcgctggagctcctgcagcttcatctcctc

SEQ ID NO: 628814 - DNA, 726 bp, Homo sapiens
tcacatgtactaaaactagacgcccatctcggagattcatatacctcacaatctctgcctctcaactagaaacgcttaagcccttcttctcactcactgcaatgcttatccaatcatacgcaggcacgctgttgaaggtgcgtaattaacagccaacacctccgagactagcgcacaaagtcttagcgatagctcctcaattacccacactaggatgaataatagcaggttctatcctgtatcaatccgtaacatataacattcttaatttaactatttagtattatcctaattactaccgcattcctactactcaatttaaagctccaatcaccactgaacctactactatctctgacacctgaaagatagctaatcatgacttaatctagccttaattcgcatgctgaacctctcgcatctccctaggaggcctagtccccgtctaaccggctttttagcccaagagtgggcctaggttatcgaagaagttcacaaatagaaacaatagccgtcagtcgatccccatcaatcattagaccgaacatcagcctccttaaccgtctacgttctacctaagacctaatctacgtccacctcaagtcgacattactcccccatatctaacgaagcgtacaaaataataatgacagttggaacatttgggaaaacctgaaccccatttgtccccaaaattcatcgaccttatcacgcatactcctacct

SEQ ID NO: 628815 - DNA, 392 bp, Homo sapiens
ctggtatatataaggaaaagaggttatttggctcacacaattctgcaggctgtacgagaagcatggcacagcatctgcttctgtttgagggctcaggaaggcttcattggttggtggaagggaaaggggaacccgtgtgtcacatgatcagggaagaaagagaagcagaagagggggagggaagggtttcagatttctttttaaccaattaagatcttcacaggaaagtaaggaagtggagaacattaattccccatgaaagaacagcacccaaagcccatttccaatgaaggggatcttgccccccgttaaaccaaaaaacaaccttcccaagccccgggccccggccctcgggttacccggaaggcttcggaatttcggttaaattcatg

SEQ ID NO: 628816 - DNA, 220 bp, Homo sapiens
gccagcagtctaatcaggaaatatacaaatagtacttcagtgatcctgttcgctgcccgaatggtgtgccggttaatagcgttaatccggttggtgccttgcaagatgaatgtaatgttcagttgaatacggcaacgtctggtaatactaatttgaaacctgaaaagtccaagcaatactctttaggtttggtattccagccgacctatagaactggctt

SEQ ID NO: 628817 - DNA, 231 bp, Homo sapiens
tctttttaccacctctcccctcctcacacctggtccggcttacagtttcattccctgactagccctcccccacctgcccagcaatttactcttaaaaaggtggctggagctaaaggcatagtcaaggttaatgctcctttttctttatcccaaatcagaagtgtttaggctctgtttcatcaaatataaaaatccagcccagttcatggctcatttggcagcaaccctgag

SEQ ID NO: 628818 - DNA, 459 bp, Homo sapiens
  misc_feature (76)..(77): n is a, c, g, or t
  misc_feature (79)..(80): n is a, c, g, or t
  misc_feature (83)..(83): n is a, c, g, or t
gctcctctaccaacgtgtacaactcatacttacctggcaagggagacaccgtgatcaagaaggcggttcacccagnncnnggntcagccattgcactccgactgtgctgacccctgcgaatttcccaaatgtggaaatctcgattgcataatttatggtagtgggggactgcgttcgcgctctcccctgatcttgatgttaaaaaaatatactaacagatttaatttgacatgtgtttcaactcaagagttcaattgagtttcttgttgaggagaaatgttcttatcagatgattggcaagttaaaactcaacctaattgcctcagacatacattttgtcttctcataacccggatggatgtgtgtgatctgttattgtgatgggtgattatgcctgtcatgtcctgattatgtgaaggaaaaggcctacttctgaagtcgacgcggccgcgaatttag

SEQ ID NO: 628819 - DNA, 980 bp, Homo sapiens
  misc_feature (6)..(6): n is a, c, g, or t
  misc_feature (360)..(360): n is a, c, g, or t
  misc_feature (377)..(377): n is a, c, g, or t
  misc_feature (379)..(379): n is a, c, g, or t
  misc_feature (394)..(394): n is a, c, g, or t
  misc_feature (396)..(398): n is a, c, g, or t
  misc_feature (400)..(404): n is a, c, g, or t
  misc_feature (406)..(406): n is a, c, g, or t
  misc_feature (409)..(410): n is a, c, g, or t
  misc_feature (412)..(412): n is a, c, g, or t
  misc_feature (431)..(431): n is a, c, g, or t
  misc_feature (444)..(444): n is a, c, g, or t
  misc_feature (455)..(455): n is a, c, g, or t
  misc_feature (458)..(458): n is a, c, g, or t
  misc_feature (464)..(465): n is a, c, g, or t
  misc_feature (467)..(467): n is a, c, g, or t
  misc_feature (493)..(493): n is a, c, g, or t
  misc_feature (504)..(504): n is a, c, g, or t
  misc_feature (888)..(888): n is a, c, g, or t
  misc_feature (939)..(939): n is a, c, g, or t
gaatcnttcacgacacagaaaccaagatggaagaattcaaggaccaattacctgctgatgagtgcaacaagctgaaagaagagatttccaaaattgagggagctcctggctagaaaagacagcgaaacaggagaaaatattagacaggcagcatcctctcttcagcaggcatcattgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatggcgnacttcagtctttttacngngtttttgcagtattntnnntnnnnntnccnnantttgtaaatttagtgaccntagctagtgatcntttaatggacngtnattctnncngtataaagttcacaatattctatgtncctagcctgtncatttttcagctgcatgtaaaaggaggtaggatgaattgatccttataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaccaaggtaggaatgaggctagacctttaacttccctaaggcatacttttctagctacncttctgccctgtgtctggcacctacatccttgatgattgttctcttacccnttctggaatttttttttttttaaataaatacagaaagcata

SEQ ID NO: 628820 - DNA, 162 bp, Homo sapiens
ggatgtttccttcctcccccaatttcctaaatttcttcccttatctatccaaaggctttgatgtaatgttcatattaaagcctgaaagcccctgtattttactgaaataaactatttgtattcttgcccttttaataaaaaaaggcttgtcctttatagtta

SEQ ID NO: 628821 - DNA, 222 bp, Homo sapiens
  misc_feature (76)..(77): n is a, c, g, or t
  misc_feature (79)..(80): n is a, c, g, or t
  misc_feature (83)..(83): n is a, c, g, or t
gctcctctaccaacgtgtacaactcatacttacctggcaagggagacaccgtgatcaagaaggcggttcacccagnncnnggntcagccattgcactccgactgtgctgacccctgcgaatttcccaaatgtggaaatctcgattgcataatttatggtagtgggggactgcgttcgcgctctcccctgatgtcttgtttaatgataaactgttgcttggcg

SEQ ID NO: 628822 - DNA, 162 bp, Homo sapiens
tgattttggagaccaagctaagtcattctcagtggtgaaaagttgaaagcatttcctctaatatcaggaacaagacagggatgcccactcttgccacttttgttcaacatagttttggaagtcctagccatgacaatcagagaagaaaaaataaaaggaatc

SEQ ID NO: 628823 - DNA, 140 bp, Homo sapiens
  misc_feature (26)..(26): n is a, c, g, or t
  misc_feature (50)..(50): n is a, c, g, or t
  misc_feature (75)..(76): n is a, c, g, or t
  misc_feature (88)..(88): n is a, c, g, or t
  misc_feature (99)..(99): n is a, c, g, or t
  misc_feature (112)..(112): n is a, c, g, or t
  misc_feature (127)..(127): n is a, c, g, or t
gaactcatctcctcctgttttctttntcttactgatatgcaaatgatgtntactacgttggttgtgaccacaacnncaggcaagtgcnacaatcacgantgttgctatgctnctttgcaaaaagttnaaaaaacaaaaaa

SEQ ID NO: 628824 - DNA, 474 bp, Homo sapiens
gcattcagagagcacgtttatttacaaagcgctttacaaacatcagcttatgcctccccacagccccctgcgaggtaggtcagtagtcatatctacagtttacagatggggaaattgaggcacggaatgggggtgtggcctgccccattttaaagagaccttcccacccacccaaccaaaaattacaaaagaaacaaaaaagcactggtcctaaccttttcctttgaactccagagggtatgaccagcccttgtttaacactgcccctccccacaacgggcagcctgaccaggagccacaggggccttaaccccaggggcttgtgttcaaccttggagattggcacttggcccaacctgagcaagacaggcccatgaggcccgaaaaattaaggaaaaagggggccaggttgacttttttttgaaacatggggttaggcagggaagggacccccccttgggggcccagctttaa

SEQ ID NO: 628825 - DNA, 998 bp, Homo sapiens
  misc_feature (489)..(489): n is a, c, g, or t
  misc_feature (995)..(995): n is a, c, g, or t
tgattcctacccctcacaatcatggtaagccaacgcaacttatccagtgagccactatcactgaaaaaaatctatctctctatactatatctccctacaattctccttattataacattcacagccgctagaagtaatcatattctatatcgctgcttgcgaataccacatcttatcccgcaccttgggtatcatcacccgatgagggaaccggaggcagaatgcgtgaacgcagtggacatacttccgtattcatacacccatagataggtctcccttccgcctactacatcgtactaagttcttcactcacaatgccctaggctcactaaacgttctacgactcactctgcatttgcccaagaactatcatactcatgagtggaacaacttattattgactaatccttaacagcgatagctgtgatagtaaaagatatcctctaaccggaggtccactgtatgagcttccctaatgcgcatgtcganggccccacatcgctgggtcaatagtcactttgcctgcaagtattctggaaaacatatggaggctactcggtataatactgcctcacactaaatttctaaccgcctgaaaaaaacatatagcctacccccttccctgtgttactaatacctatgaggcatattataacagggtcatttggctaatgacaagaagacctaaaatcggggcagttggataacttctttagtgagcaaaattggccctgtaagaaaaaggcattttttaatcagagccccttgtaggtcacaggggcaggaatctataagaggcccaggagataccgcataaatttgcaagcaaactagagcagagccacaagagaaaagacttcagaggaaaatacccaatattgtggagaacagacaaaacttccccacaaataaggaatttgtacagcggcaactattaggaacacagcctttaagggcgaaacacaacatccccctactagtaggccatttctgtngcg

SEQ ID NO: 628826 - DNA, 158 bp, Homo sapiens
gctgaaggcaggacactgcaccttcgcccacataggtatataatttaaaaagttattttctagtgtgataaatgaaagacctcctattagctgggattacaggcatatgccatcatgcctggttaatttttgtatttttatgtagaaacgtggtttca

SEQ ID NO: 628827 - DNA, 1122 bp, Homo sapiens
  misc_feature (322)..(322): n is a, c, g, or t
  misc_feature (421)..(421): n is a, c, g, or t
  misc_feature (564)..(564): n is a, c, g, or t
  misc_feature (692)..(692): n is a, c, g, or t
  misc_feature (709)..(709): n is a, c, g, or t
  misc_feature (735)..(735): n is a, c, g, or t
  misc_feature (737)..(737): n is a, c, g, or t
  misc_feature (806)..(806): n is a, c, g, or t
  misc_feature (947)..(947): n is a, c, g, or t
ggctggtccggtcggaggatttaggatgcgggcgactatggccgtgggacccgtgacggaggttgaggccatggcatgcgcgtccgggagcggagtccgcgcccgccgtcgccatgccggacagctgggacaaggatgtgtaccctggagcccccgcgccgcacgccggtgcagcccaatcccattgttctacatgcatgaaatgcgttcgcacctcatcgctggtaccgaccccgttgtactcctcgatgatgagaatttctatagatgcgagtagcatcagcaatacgaacagtggtattacatagctagccactcgtgncacgttactcggtccgccgtgtgcacacgaacaatccacgtgcaggtagtcgagaggaagcggacgagtaccatactatcgtttgacctattgcttaancgcatagggccaggagaaattggcatgggttgtggacacgcagcgggatcttatccaacacgttgcttgaaccacctaagagattctatcacattcgattaatggcatggggatcccggccttcaagatggccatgttgctanggctaatggagtgtgtacagcgcagcagcaatcgtgactcagagcgagaatactcgtcattgcaaggggaagtcgagctaggcagtctacgaccccattgttgggccaaaggtcgctgagccgagtgnacctgcttaactcaggnacccttggcgggggccctaactaggntncttgaccgaagcgaatagtgcgctaggcgcgaagactacgatggcccgttaggtgattgctctgctaangaggacgtaaaaaccgctgtgcaaacatacgatgggcctgcctcgcgatgctcaacccttccattagacggcacagcatagttggggttgccgcccatgtcttggatgcttgggcatcctagcttaatggaacattgctcntgtcttgacacaactatttaacacgtccccgttgcaaaagtctttgcatatagacatagacaccaattgacacaaaatcgccttatagctaccggaggcgcgtgtaggcacctccttcagagagctctaacccacgtgaaagcgggccccacaaggtcattcacgcttgtttccc

SEQ ID NO: 628828 - DNA, 245 bp, Homo sapiens
  misc_feature (2)..(2): n is a, c, g, or t
  misc_feature (47)..(47): n is a, c, g, or t
  misc_feature (113)..(113): n is a, c, g, or t
  misc_feature (143)..(143): n is a, c, g, or t
  misc_feature (165)..(165): n is a, c, g, or t
cnagtatagtgggacacgtaacctctctcccaacccaccttgccttnacccttccccacatgaaaggattttactggctgtaaagcctatgccttaattttcccgatctttancttactgttttagagcatctctggacgtcngtatttttattttttttatttntgtttttttatttttaatctttcatttgttaaatttttaaactgtgctgcaataaaatgtgtgtggtactacttaacacc

SEQ ID NO: 628829 - DNA, 672 bp, Homo sapiens
cccaatgggctgttaccgcctccgggtttacgggcgtctgccgagttgggtcatgcgtgctgtcgtagggcttggcccgagggtctacctgggtttgcacgggggggcccggctctgaccgtaagtgcgccttcctgacttcactgctgggtgcgcggggctgggggtgcgagtaccacccgctgagagtctcttcctgggcgacctccggggcctcattcgtaggcctccttaagagagaaaggatctagaattaggaagaaggaagtgcccttatccacgatccaagcgtcttccacctgcggagctcgcttagtctgcacctcaagcgtgcggaaagtgactgccctgtatactgaggaaaaactggggctcagaaagataccatggagtagtttgaaacaggaacaaaatcttctgaaagctcggagcagaagccttaaaggtcaacatggaggacacaaagacggagagcccgagttcagggagcctgggctgccctgttaaaagccagggccatggctcagccagctaccacgtgctaagagccattctccaccagaagcctggccagacctggaagaacaaagagcatcatctctctgacacgagagtaagagttcaaaagaaacctcagcaggatagtacgtagagctcctgagccaagagtga

SEQ ID NO: 628830 - DNA, 375 bp, Homo sapiens
ggcccccggacctggggagtggaaatcaaatgggaaatttccttccattccccggtccaggggaaagtcactagttggaccctactccattaggtcccaaatgggggccccatttcacctggatcaggactttgagcatccccaggtgccccacattttgcctttggccctcaaaaaggggggtttttgtggggactccttttaccccagcaaataaaaggaattgtttgaccctaaaggcaaatggtgccctgccctactccaatgttttccatggagcctcagggggtccccctttcccctggcagccccttcagctggtagtgaaatcccttgttggacatttttccaaaaaaggtttttgggcaaactgga

SEQ ID NO: 628831 - DNA, 1021 bp, Homo sapiens
  misc_feature (763)..(763): n is a, c, g, or t
gctccatcgacgggcttgctgaatgacaacattctttgccccagtgccatagatatggtgggtgcgtgatggttgaatctgtgcccagtgtgagggatcgatggaacagacggcgccctgctcctgtggtcctggattctggcctgtgtgccggggctgcattggaacgttttttcggaagacgccgccacgggacctggcgccattgagtcggtgaccatgcaagaactgtcatctgcttgattaccccatctcgaggtgccacgccaaccacatgattgctcgaagacgaccgggtgtcgcgggacgagaatatctgcttgtatcagtctctgcttggcaacatttggtcgcagagagggaagatctcctcaccgtggtggcttagttgaaaattgcactccagagcccacgtgtcaaccaatgctgacgcatattcatacttcgcacaaactaccccgaagagcaattgtgtagtttaggcttctgggggagcacatgctccgtgagggagacctagcctcgaattgtcgaagcgctgttgtgcttgggggtccccccctggaaagtggaacacaacttctcgggagcttgtactatggcaacaggggtaatacaattgcgcttttataggaaagtaggctcgtgggtaaaccgtgcacggttatatagctctctgggcaaagttcctattttgggtccggttatcttccctttgaacacaaggaagagcatttttgcaacacgggcatggggggtggcntttggtgacacgatgtatgtcgaaaggggggtaatcgttgtgcttgacttagaaacaaggacggcataggggctggtctgggatgttaaccccaaactatcgcgaatagggacgcttggcctagcagaagatgggcggaagcaagaagtgtttctcaggttggtgaaattgcccatcgcatggaacaaggtggtccacttgggcaggggaagccactcttttagaagagggaagttgagggttttgggataccaaggg

SEQ ID NO: 628832 - DNA, 325 bp, Homo sapiens
gaagatagggataaaatggaatttatacacataatacaagaaagtttttttctgggaagagtattgatcactgacagtgtttagaattcccggtgctcagttataataacagagcaccctgactttcagtcggcttgatcagtcttttttttttttttcgagacggagtttcactctcgttgcccaggctggagtgcaacggcgtgatctcggctcaccagaacctccgcctcccgggtccaagtgattctcctgcctaagcctcccaagtagctgggattataggcgtgcaccaccatgccaggctaatttccggtatctcaag

SEQ ID NO: 628833 - DNA, 954 bp, Homo sapiens
  misc_feature (1)..(1): n is a, c, g, or t
  misc_feature (68)..(68): n is a, c, g, or t
  misc_feature (245)..(245): n is a, c, g, or t
  misc_feature (251)..(251): n is a, c, g, or t
  misc_feature (590)..(590): n is a, c, g, or t
nttcggcggcgagctccccgctgagggcgacgagggcgaggggtttatttgaataatagtaattacangattgtgaggttatgggggttctgtttacaaaaaataattcttatctggggagccattaattaatttgggatgagtttccatcaaactgggtgggtgatgagtatcaatgggctgagaatcagttatcaagtgtgcgtggcaatcatgagataaagggggggggggaaaaatactanatgggngcttggggatttttgactagtggaatcacttcattcaagggggattaaaagtgggggcattaatttagaactaagaaataactattaaacaaacaggttgtgtcaggagaacaaattctttctaaacaatacctccatttaatggcaagagaggtctcttactatggagctatcttgggatttttcatcctatgggtttctggcatgtggtcctcaattggtggggggggacattttcttttctaattaaattacttccttcctatagggagggcatagggcttgggtgggtatggaggttctctgctcttttcttcataacttcttggagggggggtnttgtctggggacttcttatctttaagggctgggggcttgggtatggcgtgtcttgttgtggggggttgagctcttcctggcagtgaggggcaatgggttgggcgactctttatctggcttggggaggaaatcggggatgggagctggggatttctggtgcaaagggggtggcctgggggctataggggggggtgacggggcctggggtgggggtgcggggcgggagctgaacttggacattaggcgggtggtagggggggacgggggggggctagaaggggggggaggggtaggcgaaaggcgggtgggcccgggttggcgtggcgcgagaacatgggggtgaggggtgatggctagcagcctg

SEQ ID NO: 628834 - DNA, 129 bp, Homo sapiens
cccgttcggcagtatgtccgtctggctgcagtgtctgagccctaggattcatctttcttttgcaccgtcaggtagcctgaactgggcattgtattcagcagaactcatcactagacatcgtactacacg

SEQ ID NO: 628835 - DNA, 658 bp, Homo sapiens
tggcacagtggaacacactccgcaggatattatccaggagaacttccccaatctagcaaggcaggccacattcaaattcaggaaatacagagaatgctacaaagatactcctcgagcagagcaactccaagacacataattgtcagattcaccaaagttgaaataaaggaaaaaatgttaagggcagccagagagaaaggtcgggttacccacaaagggaagcccatcagactaacagctgatctctcggcagaaactctagaagccagaagagagtgagggccaatattcaacattcttaaagaaaataattttcaacccagaatttcatatccagccaaactaagcttcataagtgaaggagaaataaaatactttacagacaagcaaatgctgagagatttggtcaccaccaggcctgccctaaaagagctcctgaaggaagcactaaacatggaacggaacaaccggtaccagccactgcaacaacatgccaaatggtaaggacaactaacctcctcggactcatgcctcactcatttacacaaccaccaattattaataacctagcaatgccatcccttatgagcggcgcaggattataggtttcgtctaagattaaaatgcctagccattctacacaggcaactacacctta

SEQ ID NO: 628836 - DNA, 200 bp, Homo sapiens
  misc_feature (124)..(124): n is a, c, g, or t
  misc_feature (150)..(150): n is a, c, g, or t
ctacacgaattataaacattgtagtcgggacagtaatcctggcacgtggtctcaggagtttctggcagttttcctctgttttatatataactataatatatatgaatagataatataactaatngtgcgtgagatgggctgcacacctgngttgctcggggtagggctgccatgctgcagagctgatggagtgatgttgt

SEQ ID NO: 628837 - DNA, 800 bp, Homo sapiens
tggatccctgagcgtaaaggaggcagacctgactgtgagctgcttgtccccatcctgcggcctgtcctggtggacacagagccctccgtggtgccctggggattggattggatgccagtgacctcacttcctcctctgcccctgcccctgcccctcccagcactggccacaccctgcagcctgccccagtggtctaggcccgtgtgtgtttgctgactggcagtccacgtgtggtgtgtaccccatcactttggcctggctccagtgcttgcctctgtgactcctgtgtgtgtgcatctccttcttgatgtgactgctgtcattgcacagtgcatgacaaaccacatcagtccactctgatgacgaagagtaagccagagcatagggacgagagaaattgaccgatccatagccccgccatggagccatcgctgaaagctgggtgttgacacgctagtgatgactagtggacagtggacaacactacaatacatgctaggcttaccaacccagtggagtggtacgttatccatacgagcaatgtggactcctttcgagtgctttggagactatttaggaatatggactggcgggagcagactagagaaaagcaccaagaaatagccatgggagagccccaggagaaaaagggaaaatagcatcagaatatgtcgtaccaaaccttataatccccaaacaatgtgagaaatatattacaaacaaccctagaacccctaggacaacagaatacaaggtacccacaagcggaaagaatagcatatcaccatgagaaaacaatg

SEQ ID NO: 628838 - DNA, 266 bp, Homo sapiens
aggctgactctagagatccccgccttcatcatactaccaagtaggggttctgggtaaacaacctcatgattcctgtctgaagatgccagagtaactcagagtaacttaatcttggggaatggtgcaggataaggaacctgatcagatatcaagggtggggatactcttgctaaactgactcattagggttcttgctaaagactggtttttacaagaacagagcacaggtaggtattattgaggtaggtttttatgccaggacggga

SEQ ID NO: 628839 - DNA, 379 bp, Homo sapiens
tttattaaatgaatgacatacttaattttgttctctactggtagtttgccctggcgcatttctttttatttctattagccaaggcagggttaggtgttttgttttgttttgtttttccatatttttgaggattaatgataaagcacttatcttgttggaatgagagtctactaacaaatcctgtacatcataataacagaactatcatctaacaacttgttctcaataaataaactttaaaacaacttcctttattatttcaaagggcatacatagtcatatatataaccagtaaccaatacttgtcagtgtttattttaaaatgcaggttaggtttccatttaggtttgctacctaccttaaagcccctcttcctccg

SEQ ID NO: 628840 - DNA, 768 bp, Homo sapiens
ggtgggcgtgagggggacgagacccggtgctcacctgcatctgggtgtgcagattctcaggtgagctgagaattcctcccgtgagccaaagcaggtgcgtccaatgctgccctttcctaaagagcaaaacaacaggtatccccggaaggtaagtttctcaaaaataagccgaaatttcaggatggacggtcttggtacttaaaatgctaaccatggagacacggttagctgacaaatgctgaaatacgcagatacgctcagcagtgtgtctcgctcggtgtgtcttcatgcggctgccagagcagggacagtcccccagcggcaggttctgcctgtttgggagctgcgcggctccaggtcgggcggatcctctgcttccttgtggccatctgtgtcctggtgtcacgatggcaggaaggatgagaggccgactcccacagcgaggacagcgcgtggcaggctcccagaggagagggccctgttatttacgtctttgtcactcggtagagaagagcggtggacgctgcacttcgggggccgttcagattcacccagaattgggcgtccaacctccctgccgtgctgttaatggccacactccagcccggaaaaacctgccctttgagaatgaccggttctagcttttcctgcttttgaggaaagaaagggaaaagacaccaccactggtgtctgagagtttatcatcattactgataatcacaaccgtcgtggcgagcattggaatactccagagtacaaaaacaaaca

SEQ ID NO: 628841 - DNA, 818 bp, Homo sapiens
  misc_feature (13)..(13): n is a, c, g, or t
  misc_feature (79)..(79): n is a, c, g, or t
  misc_feature (87)..(87): n is a, c, g, or t
  misc_feature (89)..(89): n is a, c, g, or t
  misc_feature (163)..(163): n is a, c, g, or t
  misc_feature (177)..(177): n is a, c, g, or t
  misc_feature (223)..(223): n is a, c, g, or t
  misc_feature (255)..(255): n is a, c, g, or t
  misc_feature (278)..(278): n is a, c, g, or t
  misc_feature (302)..(302): n is a, c, g, or t
  misc_feature (311)..(311): n is a, c, g, or t
  misc_feature (318)..(318): n is a, c, g, or t
  misc_feature (386)..(386): n is a, c, g, or t
  misc_feature (390)..(390): n is a, c, g, or t
  misc_feature (678)..(678): n is a, c, g, or t
  misc_feature (714)..(714): n is a, c, g, or t
  misc_feature (751)..(751): n is a, c, g, or t
  misc_feature (780)..(780): n is a, c, g, or t
ttgcggattctanaacggaaactttttttaattcttcccaatagaaaagtaagaaaaaattcgtgaaagcaaaccggantgcccaananggcggcggccgtaaagtgcaatgggtaagaaaccttgaataaaaacaatcaaaaggcaaaaagcctttccaaanaatggtttaacaanaaatcaatttgttcttgttctgtaaaaaatccgagtgcccaacaanacaattttgctgctgctaaaaagtctgcaaanaaaacaaaaaaaggtgctaaaanaaaaaaaaccagatgagaaaaaanatgaaaaanaaaaaanaaaagcatatccctatatggaaggcgaacctgaggatgatgtctatttaaaacgcttatacccgaganaganatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaantgttgcagacttttacgtagctgttccagaaataangcctgaacttaatcgattaaggaagaaactgaataanaaatatccaaagctttctcgaaattccantggccgtgacatccccaaaatgcttgaattatttaaaa

SEQ ID NO: 628842 - DNA, 366 bp, Homo sapiens
  misc_feature (366)..(366): n is a, c, g, or t
atgaagatattgaaatttgttcaaaaatagttcaaaatatttggggaaatgaacatcagcatctttatgccaagattctttatttagtcatggtagatggagcctaccaagaagatactgatgaataatactcatgctgttacttaatcctcaactatatgaaagcatgtgaatttggcttatgagaataacatgctatagtgggaaatacagcaattatttatttaatcagatttaagatggcctgtcttattgcatgatgaagatggagaaacatgtcatatatcaatgatgaatctcatattttatctataatgatcattgaattccatgggttctcataacctgacttaatggttttggttn

SEQ ID NO: 628843 - DNA, 102 bp, Homo sapiens
  misc_feature (44)..(44): n is a, c, g, or t
agctcgaattcaagcttcttaacgatagtacgggcgacatgggnctaaaacagcgtgtaatagtcatataaaattggtcccagaaaaccatcgaccaggtca

SEQ ID NO: 628844 - DNA, 410 bp, Homo sapiens
agagagagagagagagagagagagagagagagagagagagtgtgagagagtgagtagagactcttcagccacttctgcctttcaacttcttgtcctccacctgtactgtctaggccatcctgctactgtgctcacctttctcactctcttctcaggtcctactcccatcttgaaccttctctacgtctgctagagtctctcttctcagtctgttctttcttcctggaggagtgcatgctgcatgtgtgtgtgtgcatgtgtgactgactgtatatcctgttgcttcctgatcttctcctccctttctgtttggcactgctgcgttactatcgacgacactgactctgtcccaatcctctgacattctcggacgtcccagttctcgttacccactggccttctctgctcgc

SEQ ID NO: 628845 - DNA, 269 bp, Homo sapiens
  misc_feature (161)..(161): n is a, c, g, or t
  misc_feature (265)..(265): n is a, c, g, or t
atcccatgccatacaccagaatggctacaatgaaaaagactgacaataacaagtgctggtgaggatgtggagcagccagagtgctcacacattgctggtggaagtgcattagtgcagtcactgtggaatatactttttctaccaaagctggacgttcaccntacaatatagcaatcccacccccagtatttgtcccagaaaaatgaaagcatgcacccacacaaaggttatccacaaatgctcatagcagccgtacccataccanccca

SEQ ID NO: 628846 - DNA, 142 bp, Homo sapiens
ccgttttatctgtctatctatctggctggcagggaaggcaagaacttgatgtggtgaagaggtggtatagggtgtatagcggtggtatagcctatatcaccaaattaagaactttttgaactaaaaccagaaactctgccat

SEQ ID NO: 628847 - DNA, 292 bp, Homo sapiens
  misc_feature (202)..(202): n is a, c, g, or t
  misc_feature (249)..(249): n is a, c, g, or t
tagagtttaaattgtgagtgatggctcacacctgtaatcccaacactttgggaggccaaggcagtaggatcactggagcccaagaggatgggactacagtcagctatgatcacatcactgtactccagcctgggcaacagagccaaaccctgtctgtaaataaataaataaaaccccaccactatgtattatgggaaatttnccaccatacctgaaagtagtatgtgggtatgtaacaagcatccagtntttcattcattcgggatcgacaccgctcgggtttttgcctgtg

SEQ ID NO: 628848 - DNA, 446 bp, Homo sapiens
gtgctagtaatatgggacaatgaagtccaagctgaggtggtctcagatggagatgaggaatgtgtagggaactgaagtaaaggtcactagtattctatgctattagcaaccgagactggtagacattattgcccctagccctagtagatctgtgtgaactttgacacttaacgagagattatttcagggtatctaggtggaagaaatttccagagcagcaaacgcattcaacgatatgacctggacttattcgtgaaagcattcagttgatatgtgttcacaaaagaggtggtttaaacatttgaatttatgtttaaaacgggaagcagagcattacagtttggaaaatttgcagcctgacaatgcaataaaaaagaaaaaccaattttctggggagaaattcaagctggctgcagaaatttgcatgagcaacaagcactccaaca

SEQ ID NO: 628849 - DNA, 192 bp, Homo sapiens
gctctactgaagtgtcttttgtccaacgttgttccagagtgtaccatggcttcccagtaatacactgtgttgatgcggttcgtagcttccgacatattctattgctcaaaaggcagggaatgatagtcagacgtgttattgctgaaggagaccctgggtattgttggagaagacctggtacaacataccttc

SEQ ID NO: 628850 - DNA, 460 bp, Homo sapiens
gagtgggtaaatgtgcaaggcactgtgatagacgttgaagggaattcgactatcaaaaagaaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagggggggagggatagcattaggagatatacctaatgctaaatgacgagttaatgggtgcagcacaccagcatggcacatgtatacatatgtaactaacctgcgcattgtgcacatgtaccctaaaacttaaagtata

SEQ ID NO: 628851 - DNA, 273 bp, Homo sapiens
tcgatacgacttatatttttttttattatatgatctatcaatctatctttctatctatctcgctctcgctctctcgctctctccctcgctcgttttctttctctttctctatctctctctctctctctctctctctctgtctctcgctctcgccctctctctctctttctctctgtctctctctgtctctctctctctctctctctctctctctctctctctctctctctctctctctccctccctccctctctccccttctgtcgtcttctc

SEQ ID NO: 628852 - DNA, 208 bp, Homo sapiens
ggccccccagaatccccttaagaatttggaaaaattgggtccctttttttttccatcccccccccctgggaagtttaaaaagggatttattttttgggggggggggggggtttgggggcctttacaaaaaaaaaggggccccccccccttcccctttttaggattgggggccccaaaaatgaaaccctcaataaaggttgggttgcca

SEQ ID NO: 628853 - DNA, 191 bp, Homo sapiens
aactataggagttgcaattcaccaagtcagcccgttcacaccctatagttaaggtggccattaaggggccaggaggtggcaatcagataagctgcctcctgcctaactctcttatctccaaccattctctatagagctccagcgtagttgcgagccccagatgtatccaagaactccggagccagcatgcg

SEQ ID NO: 628854 - DNA, 564 bp, Homo sapiens
tatggggtgctgtgtgggactgctcaggaaatgagttagggaagcagcaggttggtgtcggattagtgctgggtaatatcagggcagggatgaggtcgtcgatggcctggcgctgctccagctggtgttccatctcgatgaggagcttcactccgtgcaccagcatctgcaccagctccacctctgagaagcccagggggacagcgtaggagacgtcgaacaccccggtgaccgcagccgtggtcacacggtctgtgcctcgcttctgaagtcgcagccgcgaaagcggctccgagaagtcctcatgcttgcccaggttgggcagcttgatatgcacacctgtccgcaggccggtgccccggttgcatgtgcaggtgaggatgtaggccaggtgagggtcccagatgaactcctagtccttagacttgaacagagttacaatctgggtgaggccggtgcacaagcgggtgaagacgtccttcatgtggatgccgttctgcatggagatgacctgcaggtggactcctcgttgaccacatcaggacggtgtcttgacatgtgcag

SEQ ID NO: 628855 - DNA, 789 bp, Homo sapiens
gagcggaggccggagccgcgcggcgagcgggcggcgggcggaggggagggcttggcggccgggaggctcgcgaggcccggtcccagatggtgcagcgcggataagggttactagcaatgaatagtatgactgtaatatgtagtggatcagtaaggaagttgaattgttgatggacgagctgtgaagtagagcaataagagagattatcaggcgaggaaggataaacagagcgattgtgctgaaataaagcaaatgagtgagtgaagtatgtaagtaagatgaagagaggaggacaagacatgagtaatgaaagtaacccgtggatgaatcaatgttggcccgtagaatagacacgattacaaaaacgtagatactgataaaatgtcggaacgtagaagaaagagagagaaatgatcggacacacgtgctaatagtagattgaacctacgagaacaaactaacgcattgataaagattccaaggtggtgaacactagacagtaactcaacggcacatcgaaattcaaaccgtccagtagaagcataggtcccaccgacgtcagtgccacacagtaaacgtgaacgtaaaccctcggagtgcaccgcgaccaacagcgaacagccagcagctaacagagccaacatcaacccaattgaagtcaatagcagagtgcaagaacccaatggcgcaacaaacctacacacgccataccacggagtgaagacaacctcaaagaacacctagaaagcgacgacagtcgggcggaacggtagatgacagcaaacacaa

SEQ ID NO: 628856 - DNA, 331 bp, Homo sapiens
tacataaaaatacaaatttataagcttttataacacaaagtgatatacatattttctaacaaaagcaaatattaagcaattttcttgagtaaaaaaatgatagtcaatcttaccattgcttagcaaaatagaaaaagttaaacttaataatttttaaagattatttaaggctcacaagagggaaggctagggcaggggcaagagtttaaaacattagaatccaggcaatggattgaataggaagaagacaaagcaaaagaaataaaaaatcttaggtatcattgtcacaaagaaaaccaatgctaaggatgatcttgaatacaaccttgat

SEQ ID NO: 628857 - DNA, 997 bp, Homo sapiens
actagttctagatcgcgagcggccgccctttttttttttggtattttttttaaacccaggttgaaacatttcatctattatctctgccccattccgggagggtggggtatcagttctctaacccttgttcccggtaaaacttaaatgtgtctcttttttaattctcttatatattctctgcatcttctctctctacatataacagcatttgtgggtgaccttttaaccaagtgtggctgagtataggctttttaaaaatataaaagtgtccatggctattttcagaagtttcccctcagtccattgaaattgacctgtggggcagggccgtggggggtccctcaaggggacgagaaacgtgttgaggggtatacttttaacaccaccttgaacctctaccacaagatgtggagactccatacggacggagacaacttcaggccctcacttggacactcacaaggacgcttagacactagcgggcgtgacaacgccaacttttcagagagtgtgtgtcccgcggtatacaccaacctcatatccgccaagagacacccccgggggaaacaacctgtctgtggcgaggaaacacgtgtggaatccacatatattctcgcgtgtgaaccgtcgaaagaacattcgaggatcatctctcctcgcccgagaaaaggtctgtcaacagtaattaccctccctttagagagacaaatttcgtgtgggcgcaaccacaagataacacacctttcaccccaatatatgcgttgggacaacaccgggagtcacgccccactacaccgcactacagcacaccatctcaaacgggagacacggctctaaataagcgccactcacaccccgtgggtggtaaccacgttacacacccacaccgtgagcgagccacaaagcccaccacacacccgggggggactcactctccacacagcgacgccccaccaccgccaacgcaaccccatcagggcgcccaccgcccgccacc

SEQ ID NO: 628858 - DNA, 899 bp, Homo sapiens
tgggtaccgttggaggcggcgtgtgggcgcccgtccggtggtgggcccacctcgggcgtcttaagccgcggtgagcgacttttgtggtaacctgtgcgggcgtgatccgtccccctgtgtggttgggggctccggccacgcgcttctggttgtactggtgtgcgccgctcgtctccgcgtgttgtgtagtgcgggtttccccttccggccaatctggggggtctatcttcgtcgtcggcggctgtgcggagcccttgaagtgattgcgtcccgcgcattgtcgtagttgtctctgtccctgtccactcatttcgcctgcagtggcgtttgcagcccgtcgcataccgacgtggtgctcgcgttgtgcaagaccggggtgtccatgccaagatcgttcgtcggacggcgccccgggctccggccacgagcacgacttcctgtccggtgggcaggcggtggtgcccaccgcagccccccatgtggtgagaaaaggttcggagcgtccccctcattgcgccccgacagtaaggtcaaggcgcctgtcgctcccgccccctcctcccaagaggtggcattttctcctgccggagcgcatgccgcctcgggagaaagaatccgcccacactattgttttgcctcaccacactggcactccgaagcgtttcagcacccgccgactcggtgctcccctccctctatacgagcttccacggtttaactttttcctatccctcgtggacttctccactccaccacattatgccctcttaatctctgcttataaaaaccacccatgcccccacacccaatctcttaaacatcttccaactctcatataataagctacaccccctcccccaaacttaaacaaaacgtctccttcatgcgccaacataaca

SEQ ID NO: 628859 - DNA, 210 bp, Homo sapiens
gtccaaggagctctggctgtacatcggcatcaacacctttgactatcttgacagcgaagatcgagctcaggttcgccacatagatccgtgcaggagccacatgggtcctgtgcaggaccctagcagtggtgggctgagccaggtctaggtttctgtgggggacaatgaatctcccagtgttcagtctccaggactcttctgcctaacaga

SEQ ID NO: 628860 - DNA, 279 bp, Homo sapiens
aggctattgcacagcccggtgcccgggtgctgatcctgcggacatggtgatcggtacgtcggtgaacctggacggtattgatgcacaagttgccgttcttgtcttccggggtgtagttcagctcagccaaagccgagtgaccggtaccggcgttgttccagccgttggagctttcttcggccacgccatcaaggcgctcgaccatctccatcgaccaatccggttgcagctcattgagccacacacccagggttgcactcatgatgccgccgccgatca

SEQ ID NO: 628861 - DNA, 2826 bp, Homo sapiens
aaaccccagctggaactccggccacagccagcatgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactctcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcgtcatcatgaccaagatcaacaggcgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagacagtgccaccaccagcacctcccacaagcccaccgctgtgcgtgttgaggggtgctgtgagaaggctgtgcccatgtggggccgcaggaatcccctgtatgttcagggctgtgagctgccaccctattccgcctgctccgtctttgtgggggctctcaggcttggcacagccctgacttgaactctgggtgaccctgggcacccacagaactgggagtgagggctcctcaggcagccacaaggcaggaaaactggcgcaaatttcctgggcctccctctgacttctgggcgccagatcctgccgtgcccccatcctggctgttgggggtgtcctgagcccacctcgctggcctgttcccttcagccaacccgtttctgcagtaaaattaagcctgtctgtcttgcaaaa

SEQ ID NO: 628862 - DNA, 285 bp, Homo sapiens
  misc_feature (49)..(49): n is a, c, g, or t
  misc_feature (96)..(96): n is a, c, g, or t
  misc_feature (117)..(117): n is a, c, g, or t
  misc_feature (236)..(236): n is a, c, g, or t
  misc_feature (258)..(258): n is a, c, g, or t
atcgagctcggcccgaaattctaattacgaagttcaattacacgtgatnggagacagcacactggttatagcaaacttcaccccatgctctccgtncctttgatttattcagttggncaccttcaagcgtaggatcctggtttagaaacatcacacaaactggatttgtcatattacttttatttctgccctgcataattttttctaagccaataaggtgatgctagctcaatgtnttgggatgatctccaatgcttntgaccatggttagcgtaattagggtta

SEQ ID NO: 628863 - DNA, 856 bp, Homo sapiens
  misc_feature (844)..(844): n is a, c, g, or t
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggcctttgcctgggctgctgtcttcatccctggggtggcaatgcctgcctgcatcttgacgggcctcctgtcggctgctggaggagctgggagctctggagttgagtcaccctgggaggtgacaccagaagggctggatcccaggtctagcaacctccacgtgtcctggagggtgccactggcaaaggaggaggagctgtgggattggcgaccatgctcctcagggtgcttgggagcctggggtggctttggggacctgtcttctttctgccgaggtgatttacaggtcaccgtgtggatgctgtgttgtgtcttcgggccttgcagggcgttaagtccgctgcccacctgtgctgagcggggctggtgctttcccaagtttcttgaaggagcctcatcctcggcactcttggcgtcctgagatgtaaaatggggctgcacctgtcccaaaggtgggctgcgatccaaaggcctcctgggctcctcgcctggcttccgggcctcangggcaggaggga

SEQ ID NO: 628864 - DNA, 1805 bp, Homo sapiens
  misc_feature (1793)..(1793): n is a, c, g, or t
aaaaaacaaggacattaaattacataaaaataaaaaatatgaacataaaaaaacaccataataaacatttaaaaacatgaagaactgggagaaaacatttaaattgttgtcaccgaaaaggcctaatttctatcacatataatgagctgctacaaatcaataagaaagaccacaatctaatacacaaatgggcaggtaactgaagaacagggaaaggaagtggctcctaaacacacacgaagatgcacgacctcccagcagaggcgctgatgccaatcctgctgccaccggcaaaagttccgtgtggctacaggactctcagacactgctgctgggagcagcctctgggtgggtggcggaggctgaggcgatgctgtccaccacacgtggcacgcgggcagccttgactacgcaagcccctggggcacgtacacgtgtgttttcacacacactgcagcctgtaaggttactattctaacagtatctgtgacggtaaaggactggaaatagcctaaaatgcgcatgaaggagagaatgattaaatgaatgaggcacaccctcatgacggaagacagaagctgtaaggtaagaaggggacgccctccatgcaggcacacaggaaggacgcacgctcccgccccaaccacatcacacgtcccgcaactccagctgcctcgaagcagcatctgtttccctccccccttctcgctacatcacagacccatgcagtcctcacaaggtgcacccttcaaacagacttttctgaaaacttcctgagaccagtagcaggagctggcactgtgacctgctgagtttaccaggcctatgacttaggtgcagagaagagtctcagggcggcaacgtccgcgcagcaaagcaggacgaggatgaggatgcggctgacacttgtctggcccgtgaggctgagcatcactggggtcggcctggctcttccccgggagcatcgctggggtcgacctggctcttccccaggagcagggccgtctaaagtgcaccaatgcccacgcgtctcacctgggctccattctaagtcagcctgcgcccgggtgtacagtgctccattctaagtcagcctgcgcccgggtgtacggtgctgcattctaagtcagtgtgcgcccgggtgtacggtgctgcactaggaaatggcatggtttctgcccttcagggctttgcaccataacccgggaaacactcaggtgccaaatgagaggtaaagagactccatgcattactcaaccaaagtgcagggatttcagggtgcaggaggcacgcagggtgctgactctccacatgcccctcggagagggtggccctcgccagctgccagctgtgggcagctcctggggagggcagtctcctatctggagttgagtcaccctgggaggtgacaccagaagggctggatcccaggtctagcaacctccacgtgtcctggagggtgccactggcaaaggaggaggagctgtgggattggcgaccatgctcctcagggtgcttgggagcctggggtggctttggggacctgtcttctttctgccgaggtgatttacaggtcaccgtgtggatgctgtgttgtgtcttcgggccttgcagggcgttaagtccgctgcccacctgtgctgagcggggctggtgctttcccaagtttcttgaaggagcctcatcctcggcactcttggcgtcctgagatgtaaaatggggctgcacctgtcccaaaggtgggctgcgatccaaaggcctcctgggctcctcgcctggcttccgggcctcangggcaggaggga

SEQ ID NO: 628865 - DNA, 192 bp, Homo sapiens
accaagttcagtcaggttgactccctcagtcgtctaccaggtatttatctccgatcctcagtgactctcctgtgtgtcctcagctactctcccagcacgcccactcttcagcgggaatcagttgcaagcacccggaaatcaccaccatactcaccaatttcactgcgttactccccggtctctctcatgtct

SEQ ID NO: 628866 - DNA, 170 bp, Homo sapiens
  misc_feature (147)..(147): n is a, c, g, or t
ggctcggtacttgcatatggcaaggccaaggagttgtgtaaggcagcggacatgtgcaggatatgaagatgaaccacgtgacgaaatagaaaaagctacctatggagttgtgcccctacgcaggtacttggccttgccatatgcaantatgcaggccttgccataataca

SEQ ID NO: 628867 - DNA, 263 bp, Homo sapiens
  misc_feature (165)..(165): n is a, c, g, or t
cccctgtagacccagctcctcaggagtctgaggcgagaggatcgcttgagaccaggagtttgaggctgcagcagagagctatgatcgcgccactgtactccaggtaacagagcaagaagaccccaactctaaaagaaaaaaatagacaagaaaaaagaagttgangccagaccctgtggttcacacctgtaatcccagcactttgggaggccgatgcggatcgcttgaggccaggagttcaagaccagcctggccaacacagc

SEQ ID NO: 628868 - DNA, 493 bp, Homo sapiens
gcctggcttgttcaactgcaggcaggcaagtggaatgaggcttgtcatggtatgtaaccggaccagcataaccagcagggtcaatggcaggacaatgtaggatcctagttgcgatgtcctgttcaggcagcttcctcgtggggttaaaaatcaaggtgatgtgtattatggtaacccactgcggtgagagaaacttgaggcaagattgtattcttactgggatctgggtgagtgtggagtccagaagcacaacatagttctcgccatctctgagcagtggggggaaatggaagaacagagactggccaagggaaactgtctggattggattgtcgaggttttcgcttttgtaaagcttgacccataacgtaggaaggtattcagaggaagtgatcacatttccacttaaatcaaattgattaatctgccggaaaactatgatgtttacatcatcgatgtcattattcccaacctcaatcaccctatggtgggg

SEQ ID NO: 628869 - DNA, 148 bp, Homo sapiens
  misc_feature (6)..(6): n is a, c, g, or t
  misc_feature (10)..(10): n is a, c, g, or t
  misc_feature (125)..(125): n is a, c, g, or t
ggtgantctngaggatcccttcttatggcaaggccaaggtcagaagatgaaccacgtgacgaaatagaaaaagctacctatggagttgtgcccctacgcaggtacttggccttgccatatgcaantatgcaggccttgccataataca

SEQ ID NO: 628870 - DNA, 183 bp, Homo sapiens
  misc_feature (160)..(160): n is a, c, g, or t
cggtacccattgcatatggcaaggccaaggagttgtgtaaggcagcggacatggtgcaggatatcaagatgaaccacgaagatgaaccacgtgacgaaatagaaaaagctacctatggagttgtgcccctacgcaggtacttggccttgccatatgcaantatgcaggccttgccataataca

SEQ ID NO: 628871 - DNA, 241 bp, Homo sapiens
  misc_feature (218)..(218): n is a, c, g, or t
ggacgcagtgcagctgcatcctgcaggtgactctaagatccccttgcatatggcaaggccaaggagttgtgtaaggcagcggacatggtgcaggatattcgtggcccctctggagttgaagagacgaagatgaaagaagatgaaccacgtgacgaaatagaaaaagctacctatggagttgtgcccctacgcaggtacttggccttgccatatgcaantatgcaggccttgccataataca

SEQ ID NO: 628872 - DNA, 373 bp, Homo sapiens
actatgaatatacactccaagccaaaagaaaaaggtaatcacgtgaacctgtactacatacctttcatctctcttagatgacagtaatcgaacaatttaaggtacaaaacaaagaaaagcttatggctgaaccctgacttatttcactatagagaacactagagatatatactaccgacagataacaaacccaatccccattataattgaatttaacattagttaccatgaatctctatcttaaatggatatgtcacacatatttacgggtttcaattaggcaattcatgttttcaaatgctctagaacaagcacacctaacatttcatcattattgtccccttctttcagcttatctcattcctatgcatcg

SEQ ID NO: 628873 - DNA, 178 bp, Homo sapiens
  misc_feature (178)..(178): n is a, c, g, or t
ggacgcagtgcagctgcatcctgcaggtgactctaagatccccttgcatatggcaaggccaaggagttgtgtaaggcagcggacatggtgcaggatattcgtgggaagatgaaccacgtgacgaaatagaaaaagctacctatggagttgtgccctatcttggccttgccatatgcan

SEQ ID NO: 628874 - DNA, 1424 bp, Homo sapiens
  misc_feature (1)..(1): n is a, c, g, or t
ntcctcctcctacagtgggctctgctttgctcgcccgcaccactgttgtttgttgctcctctccgccgctggggagggggggtccttattcggccctctcatagctgaagggatgttttttttgttcctttctcggggagatttgttgatgggataccttctcctctgggccccgtgctctcgacagtgatgttgctcccacctggtccaccaatgttggtgtgttttctggcgccccacgtgttggttctttccccgctggggagccccctgtcaaagagccttgggggtggtcgccccacccgcggtggtggttttggggggtgtcgtcttctctccgcggatgtagtgtgggtccctgctttttggggcccccccactaggtgcgctcttgtgtggacccccgcggaggtatataattgtccccccaaagggtcggcccttaggagtctttctgtgtgtttttggtggaacccaccacttgtggggccgcccaaatataccgcggggcgccgttttgttgttggcgccccccaggggcctcccccttattggatagtggtcctcagtgttcctccgctcgcggggctccccgcgtggaggttccccccgggtgaccctctgtgtttgggggggcctcccacgtccgccctcgtatctcgcgttcgttgcaccgcttgttggcccccccccactctttcgggggacccccaacggcaccacacacccccacagggagagagacacctgtctgtaatagacaccctcgggggggcttgctataaaaattgggtttgagagaacccgcgggttatttctttttgtcggtgggagacacacctttgataacagtggagacacttcgggggacacatatatgtgggagagccccacctctgggcctcgtgtgtagatagtctgtccacgcagcacctctatatatagagagcacacgcccacgctgtgagagactcgcgcccacagcttttctcgtgctatatctcgtgcgagatatgtgagatgtagagcacatccgctgtgtccaacaggccacccacagaagagagaaagcgccgatatgagccccgagagcccgcgcacacaggccgagggctcctctctatatgctctggcccacggagatggagagtggtcttaaggcacaaggcgtaacttcccaaaggcacccggatccacccacgaggtcctcccctctttcctcgaggcccgaggtggccacgggaccacctcgtggaacgttctttgttcacgaaagggaatacacggttggggggcacgcccccacgtcccctttctgtccccgctccagattttccccaaagaccctgaccacagtaattctttcttctattgtaaggtttcccctttagtttgcttcccgatgattaaatctaagtcccttt

SEQ ID NO: 628875 - DNA, 677 bp, Homo sapiens
  misc_feature (323)..(323): n is a, c, g, or t
  misc_feature (419)..(419): n is a, c, g, or t
  misc_feature (654)..(654): n is a, c, g, or t
tccaaaagtgctggggattacaggtgttgggcccaccaagcccggccttggaggtttaacctggtggaatctcaagggaggacatagcctgtcctattgcagggaaggtgcggccctcactcccgtctcagcctgggggcatgagaactctgagcacaaagaggacggagctggtccccagctttctggccaccctgtgagtttcttctcctgcacctgagcctcagctcagctcttgaccaagttggcctctggtggctcattctccaggctgctccgggctctctgggtgcccctgggcacacctacgtggcttcctaggncggaggctgcatcacggaaggcgggcacacaggcctcacttgggcgagaagagacccagagacgcatggccttcctcctgggccggctcccgaccngagcccatctgagctcagcccacaggaaggggaggtgccaagaaccccaagcacaggtggctgcaggctggtgggtgccgaggaggccactaggaggctgagacggtgagagccagggccaggcagtggcctgagagctggacagcctctgggtatctccacaccccacccttctcctgcctttcagaagataaacgcaccgcgaacgccccgccgcccaggcctcgctaccttnagtactcagggtctgccgtcgtg

SEQ ID NO: 628876 - DNA, 334 bp, Homo sapiens
tcaaaaaattcggattgccataaattatacaaagccttttttcaacacttttttccttccacttaaaaagctggaatccaacatgatgggggtgatgccaaaacaaaactggtggttcattttatttagggtacaaatacccccttaatcacttgaccctttactgaatgcaaagcaagatttaccatttttgccctctttgtacaaagcttaaccaggaaaccagggggggggggacttcttggttttccttggcaggggagttggcccccctgcaaccctgtggtgttgtggaaaaaacaacccattttttgtcggttcccataacccctaa

SEQ ID NO: 628877 - DNA, 770 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaacaagccttatctgccttatttgccgtgattacatagatcagcccatttaagtta

SEQ ID NO: 628878 - DNA, 136 bp, Homo sapiens
atcggaacaccttgcatatggcaaggcacaagcatccctctggagttgaagagacgaggaagatgaaccacgtgacgaaatagaaaaagctacctatggagttgtgcccctacttggccttgccatatgcaagtag

SEQ ID NO: 628879 - DNA, 538 bp, Homo sapiens
  misc_feature (405)..(406): n is a, c, g, or t
ttgtgaggtagtctagagatcccttaggaactcaaagccacaccccaggggctccactcgaaggcccggggaagcagtctagctcagccgtctaagtggaggtgactgatttattctgaccatcctgactcttcacgacactgctctcctccaaccatgcacggctttaattgtccatcaagcagggcagggaggaaccgtaaatctttcctcccgctgctccgagctgagcctgcttgacctgcaattgccagcccctcgcctgcgtgcagcctggagaagtccgctggctctgaaggtgaaggaggggagtgaggaaggggaacgcaggagaggcagaagggggtcaggaggggaacagagagagccaggcagcaggagaaagcaagcagccgacatggccannctcccgctctcccgccccggggccctgcggaggaatgaatgcctcagcccgacttgcagcctcgaggggccccggctggggcgtctacaacacctcgcctcccaggctcctgctctcaagcagcgggaccct

SEQ ID NO: 628880 - DNA, 1411 bp, Homo sapiens
aaaagaaaaaaaacattacggctaggtacgaggcctgcgtgttatcatgatctccatggacagacacccacctactaacagttgctatgctacctactatacttatctagctccaggcgtcatgaacttaggtaatcccagtatacccaatatgctccagaggcactagcctacccccaccaccgactcatctgatatcctaatacacaggccccatcacaggtatatggaggagtgacctactataagcccgacaccagacagacaggatgcagccaaagacactcacaccaacccaggaggactccaacagaacagaacaccaaacaagacacccactcacacacaagaggacgaacacacaagggaatatacaggtaaaaacaagaaacatgaatatacaaaatctaaaaataataataaaaagacaaaaaagaacaaaaaaacacaaacaacgacaaataacagaatggacatacactatcaaaaccaaaacaggagcatcccaacgaatatacggagaagaaggaataccgaaacacataaaacaacaacatgaaatacagaggcagagcccacacatgcacaaaacaacaagaagagaaaaaaaagtaatcattgtacgaaacaggaacataatacacatagaatagacaacatacatagtacacacatcatttacaaaatcaattccaaatgagacaaataaggaaataatgaaattatataaagatcagacaaaaaaggatgaccaaagaaataatcccaagattatattggagatacctaatacatacaaaaaaatacaacaagaaaatacaagaaagagacatacaacaaacagacgaaaaaaaaagcaaaaagaacaaaaaagaaacaccaaaaggaaacaatacaacacaggatatgaccagcaccatacagatgaacacaaataaaaaggacatgacacacgtatccaaagaaacaacaaaacataacatgactaacaaatatagaagtaccggataccagaactatatcaccacatgaacaacacaacagtaaacctaaccataatatatgataaatcaacaacgacagagataaccatacaaaaagatacaatgaacacaacaatgaaagagaaataagtagaccacaacaaacacgacaacaaaatcacatagacatacacataaacgatgaaataaatgaaacaaacacacaaaacaccaaggacaacgaaataagagagaacagaaataggctaaatacgtagcgaaaacagcacagtagaaagcacaaaaacataaacaaagcaacataatcaagccaatagatagaaagaaataaaacaagacgaaaagacgacaagaaaaaacgcataaacaaaaacgaaatgataacaacaaaacacaagaaagacagc

SEQ ID NO: 628881 - DNA, 755 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaaacaagccttatctgcgggggtcacggagctcggatattc

SEQ ID NO: 628882 - DNA, 107 bp, Homo sapiens
gtttcggcacagcgcagtctggccacccgcttccatgcgtgtcgggtccaagatgatgccgatgtttcttaccgtgtatctcagtaacaatgagcagcacttcacag

SEQ ID NO: 628883 - DNA, 700 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccgggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaaacaagccttatctgcgggggtcacggagctcggatattc

SEQ ID NO: 628884 - DNA, 565 bp, Homo sapiens
  misc_feature (8)..(8): n is a, c, g, or t
  misc_feature (64)..(64): n is a, c, g, or t
agagaganagagagagagagagagagagagagagagagagagagagagagagagagagagagangaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaaacaagccttatctgcgggggtcacggagctcggatattc

SEQ ID NO: 628885 - DNA, 136 bp, Homo sapiens
tacacgctctcgaagttggatcactataccaccttaataattgtactgagagaaactgcttatgtacacattgcagatcaaatctacggagtaaaaatgttagtctacatagatgagtggtatcagggtggtatag

SEQ ID NO: 628886 - DNA, 376 bp, Homo sapiens
cgagctccgtaccccgcagataaggcccggatcgccacatgtatcacagcctgtacctgaaggtgaaggggaatgtgttcaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaaacaagccttatctgcgggggtcacggagctcggatattc

SEQ ID NO: 628887 - DNA, 985 bp, Homo sapiens
  misc_feature (195)..(195): n is a, c, g, or t
gagatcgcaccattgcactccaggctgggcaacaagagcaaaactgcaaaagaaaaataaaaataatactaaaaaaagaacagtacatctcacagaaaaaaaaagtacatagtaaataagtacatgaagaaagaggccactttggctctttgtaccagtcaggtgggccccccaggaacaacatgtcccttctcnttttggtgtggcatgggccactgtgggattctgggttgcattctccgggctcgacagcttcttcggtgatattcttgggacctggtaagtcttgactcgtcttattgaattaatttagcttcagccccttgtatgtgcctccccggtgccaatgcttcctttgggccaaacttttcaccttgtagcttctgataagttcttttgaggccaaggcttaaggcaggcattcttattcaagtctagtcgcctttcagcttcctgattttgactcccggggccaaaggcgccggtgtggccaaagcttgagccacacggttttgtcaaagacacgccttgtgaaccttaggcagcattttcctttccctttcccagtccattaagaaaccctggaacccagcctcgtaaagggcaccactttcagaacaggctatctctgctggcaaagagctttctgctctgtgattcttaagattttcactccaacctcacctttggtgttcacgcttccttaatctccttagagcgtagaacaaagaactccgggatgtgatctcagactacgagagactgttaccagcttgggtgcccggggtgaggaacttagcgagcactggggttacctttcgagtttgaccctacaatttttccaccattgacgctggtacatttttccggatttcccttttttggcctggccttattttactttaccagaaatgtctttgaacgatttgtcccttattggagaccttctccaggattccttaatttaagggcggaatggttttcc

SEQ ID NO: 628888 - DNA, 925 bp, Homo sapiens
aggcttccagagaagatgcttccgccctcttaagggtgtccctccaccactgtggggccataataaggaaagtggtttttgggtttaggaccctcccacatgggagtaccccccatggaaaattcggccacaatggccaaatttttcccgttcatctcaggaatgtccgcgatagcttttcatacacaaagattgggccctgaatctaattccgctaaaagggcactggtgaaccagggttccaacattctcccgcggtcttttgtaatttctcccgggaatataaccaccctttgtgggcctcgcctcgcgatagaggggcacggtcacacaatggagacactaagttatatataaccgggaaataggggataaacacgccccattgtgtcccgcatagatgccccaagagaaaggggtcacaccatgtgaatgagaggaggaaattgtagggagtttttgtccaccagcgtctgtttctccacgaaaagaatattccgctgaaaatctctataagaaagatatccgatttctcccacacaatggtatttcaccacggccgtgtataccgtgaaaggtgataagggggaaatgttggtgtcacaaagaaccatagcgcgaatttttcactggagaacacacaatccaccacaagtctgtaaaggcacagaacaaagggcccgccaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaaacaagccttatctgcgggggtcacggagctcggatattc

SEQ ID NO: 628889 - DNA, 270 bp, Homo sapiens
cgagctccgtaccccgcagataaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacccagaaataaaacctcccactttgtctgtacatactggcctctgtgattacatagatcagccattaaaataaaacaagccttatctgcgggggtcacggagctcggatattc

SEQ ID NO: 628890 - DNA, 660 bp, Homo sapiens
ccgggagaaggtgctgatgcaggagcttgtgaccctcattgagcagcgcaacgctatcatcaactgcctggatgagtgaccggcagagggaggaagaggaagacaagatgttgtgaatgccatgatcaagaagaaagagttccagatgggaggctgaacctgagggcaatgaagaaggggaagttcaagaccatgaatgatgtttgaaactgctaggaaacaaactgtgatgccaatgagcaatgtcccccatgagacaatgatgctaacagcactgatgaagccagttgtggtgactgccccctcctggagcagctcctgtgtgctgtgctctgttttgaagtggtggcgccctgctcccctcatgatcagtcatggagtgaagatgactaatggggacgggatcctctgtggtgattggcctcttcctcctcagtggacctctgactgctctgtggccaaagaatctcttgtttcttctccagagccccagtgcagcggtgattcagccctgcccaacctgattctgatgactgcgtgatgctgtgacgtgacccaatggggcaactagtggtcccatgggtccagggaggggcgcctgctgagcacttcctgccctcacctgaccatgccctgccatgagctctgggctgggtctcc

SEQ ID NO: 628891 - DNA, 598 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccgggtacagccaatgcccgaatgccagagaaggtcacatggatgaggagaatgaggattttgcgccggctgctcagaagataccgtgaatctaagaagatccgtctcggcaccaaggattacagcctgttatcctgcgggggaacggccatcgcgcctaaattcaccaggtcttttccgtctacccacttgcaactcctgtggggtcattgacttgtatgatgccgaccgttgccctatttcccctccctatttctaacgctccccaccactcccgctttccggcctgcacccgccgtcctcgttaagactacggtaatgcttatataatttacgactttttcttt

SEQ ID NO: 628892 - DNA, 220 bp, Homo sapiens
ggtggatgagaggctgggagaatagagcagctgatattggactctggaggtgaacttcacctccctggtggcagattaccctttaggtgtcatcaccaaggtttgtgtagagtatgccaggtttctttcactttctttccttttgccgtttccagtgggtgggagttctgggtttggtggtgggtctagtcaggttcatgacctggcctctaaatgtatg

SEQ ID NO: 628893 - DNA, 428 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaaggctacaccaattccgaattcagagaggtacatggattagagatgggattttgccctctgctcacagatacctaatctaaggatgcttgcccactgtataaacctgtcctgaggtgaggg

SEQ ID NO: 628894 - DNA, 343 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccgaaaacaccttgcccccgaaggcaagacaatggcatagtaacggaggtcaagccatcccatccaaaagtcaatgataggaatgagtttcg

SEQ ID NO: 628895 - DNA, 538 bp, Homo sapiens
catctacctatgagtaggtaatcatactggagcaaaaatggaactcaatcaaaaagggctgtttgtagtgtacaattcaaacaaattgcttataacaattaaaagaataggtcattaggcttattcccaaactatgatataaaatcaaactcccaacatgttgttctgtacacttaaattggtttacactctgcaatatctcctggtacttagaataccttgcaatgtaatgaagaaaattagtttgttttgcatgatttgaacctctgaaaagtaatatattgtacattaaaataatcaagcaaggaatcaaattgccagttcctgtgagatgataggcattgaagtatagatgcctgaactcatccatgaagcaatccatgctgattgcttcaatctgtaaattatttgaacttataaataggaaagccaactttcccaaaaatatttgacaataaaattaatcaagcatatgtgataaaaaattagttctttattttgtgcatatactcagtgataagcagcactttaccagctg

SEQ ID NO: 628896 - DNA, 349 bp, Homo sapiens
tatgaggcgccgatccaagagccaggcggtcataaaggccaacacaagccataagcagccagaaccacaaggccgaggtccatgtgactatcacagggtcacgctcgttgccacagggtaggaaaagcatctcagccagacgttccgtcaggaactcgcatcgccgtttaccctgagatcatgctcgtcgagtaaattggatgggtccaaacgatttgtctctaacttcgaatccagtagatttctgacaggcacggatacgagtccctggagtgtgtatgacctactggagcagcgaagtcgcggacatctgcgtgagaagcctttggagacagttcgcgctgtctct

SEQ ID NO: 628897 - DNA, 129 bp, Homo sapiens
tcaactactatgcgtctatggtataatacgcctcacacttcatctcaagcacctactcaatatatagcctaccccgtccttcttctatccctatcaggcataattatgacaagctccatctgcctatat

SEQ ID NO: 628898 - DNA, 319 bp, Homo sapiens
ggatcccccagtatctgctcactcacagccttttaacaacctcactaacaggccgggcaccgtggctcacgcctgtcatcccagcactttgctctgcgtggatcacctgaggtcaggagttcaagaccagcctggctaacatggtacaaccctgtttctactaaaaacacacaaaattagctgggcgtggtggctcgtgcctgtaatcccagctactctggaggctgaggcaggagaatcgcttgaaccagggagttggaggttgcagtgaaccgagattgtgccactgcactgcaagcctgggtgacagagtgagact

SEQ ID NO: 628899 - DNA, 107 bp, Homo sapiens
  misc_feature (32)..(32): n is a, c, g, or t
caaacgtaattattgagaaaggaacggagagnaaagagagagggagcgtgtaaagggaacgagcaaaggcgagtaacgggaacgagaaagggaaagagcaacgtcta

SEQ ID NO: 628900 - DNA, 290 bp, Homo sapiens
  misc_feature (1)..(1): n is a, c, g, or t
ncccgaaaggtagctgttactggtgcagacactgtaacatataaaatggcctccacctgtaaaataaagctcacagatcagtgagaaagacataagtataaacaaataatcacaatctacctgtgctgagttgtgaaactgctatgggcgactgctggaccacacgacagtgcctaacttcttcctaaactgaaacgacggaaacgtgcactaccacgggctaggacaccagggcggttggacggttactatctcgacacgctggttgcttgacactgactgacctgacc

SEQ ID NO: 628901 - DNA, 179 bp, Homo sapiens
attctctttggctagctgtcctagctcagatacgtggacttgttgtaagaagatgaaggcgtgagggcatatgggtcacaaatagctatgacttcagtccagagagccctctaatgtaaagaagattggtatttctcatcccaggaaatcagtggcttatttataacacaataaggtaa

SEQ ID NO: 628902 - DNA, 227 bp, Homo sapiens
aggatccccagtttttagtaatggggtcctctcatgttagataatcttcattaaatgattcgagcggaaacttgatttctgatttcatgacctttcatcattattctaatgtcttatcattgttatcgttttgctcgtctagcctcgcagactatatgataatgtaatataagatacagtcaaatcataaatttatgctcatagaacagagatataaatgggcgtac

SEQ ID NO: 628903 - DNA, 241 bp, Homo sapiens
agtcctgtccgtggtcgtcatctccttgttgggccgcattcagctttagccattggagtagcgtttaggttcctgtactgtgtcacggccactctgtgttggcgcttgcgactcgtcgggctcggcccaccgctgcttcgcaggcggcaaagacctagtatggcaataggcacactattggctacgcgggagtgggtgttgagggttatgagagtcgctataatgaacagcgataggcaat

SEQ ID NO: 628904 - DNA, 189 bp, Homo sapiens
  misc_feature (18)..(18): n is a, c, g, or t
  misc_feature (25)..(25): n is a, c, g, or t
  misc_feature (97)..(97): n is a, c, g, or t
  misc_feature (175)..(175): n is a, c, g, or t
accgaacactggcttcanagccgantttgtgcattgctgccatgaactttgacctgagccgggggagaggatggcagccgactttattaaaaaaaanccaagattgtagtggtagtcctaactccataacgctgaggaaatacatcattttcaccccagtggcttttaaatcccncttatgaattttag

SEQ ID NO: 628905 - DNA, 386 bp, Homo sapiens
taccagtggatcacgcttgtactccagcactttgggaggcgagggcgcgactaacgacggtcaagacgatagagatcattctcgccgatacggtgaaactggatctctactaaaaatacaaaaattgggcgggtgtggtggtatggaacctgtagtcccagctactcaggaggctgcggcaggagaattggtttttgacatcctgacacatgtataattgccgggagcgaaagttgcagactacgtttcagacacacacacacaaaaaatggaatctgagctggtgggggccagctgaaatctgggaacacacagacaccctggttaaaaataacatccagacatcattgccagacggtctctccagggaatacctctagagtcga

SEQ ID NO: 628906 - DNA, 823 bp, Homo sapiens
  misc_feature (43)..(43): n is a, c, g, or t
  misc_feature (180)..(180): n is a, c, g, or t
  misc_feature (220)..(220): n is a, c, g, or t
  misc_feature (232)..(232): n is a, c, g, or t
  misc_feature (295)..(295): n is a, c, g, or t
  misc_feature (300)..(300): n is a, c, g, or t
  misc_feature (302)..(302): n is a, c, g, or t
  misc_feature (325)..(325): n is a, c, g, or t
  misc_feature (332)..(332): n is a, c, g, or t
  misc_feature (336)..(336): n is a, c, g, or t
  misc_feature (411)..(411): n is a, c, g, or t
  misc_feature (430)..(430): n is a, c, g, or t
  misc_feature (451)..(452): n is a, c, g, or t
  misc_feature (475)..(475): n is a, c, g, or t
  misc_feature (481)..(481): n is a, c, g, or t
  misc_feature (546)..(546): n is a, c, g, or t
  misc_feature (550)..(550): n is a, c, g, or t
  misc_feature (552)..(552): n is a, c, g, or t
  misc_feature (578)..(578): n is a, c, g, or t
  misc_feature (738)..(738): n is a, c, g, or t
  misc_feature (813)..(813): n is a, c, g, or t
gagtcatcacatgccctctagaacccagatccccatgccgggncctcttctctcctgcacaccggtcgttgcgagggagggcgtgttcaggccggaagggggtgccggttgcgttctccgcgcctgcacgggtatttaatgtggcacactggccaggctcctctcctgccgccgcccagnagcagcacgggcgcgcgtgtggcgctttcttcagtgcccnccaagacgtggncgagagaggaggcacagacgtgcggagagagagagggcaagagaagtcgtaattcgagcagtnagttncnacagaaagtgcgctggaatcggnccttggntgcntctgcgcgtggaagcaacccacttaagccccaggagaggggacagaggagagactgggatgggggtgggagtgcncagaaggcacccaggaganactggctgcagaaatggggtnnctgatcttgcaagaaaatccgcntgcggngggcaggttggcctgagaatcccaggggcagcttcagacattggggggactcagacccacccccncagncngcagctgtggcagtcagaggtttggnaatgtagccagggtcacctggccatggcccaggggcagggtgcaaacaagaaccctggtgcctcccgcccctcctgctgagccatggtgccacctaagccatctagaaaggctcaactttttgggagacatctgcggcagggccactggaggcaggagantggggtgctggcctctgcgaggcaggtgcagctctgggagaacagaattctccctctcctcctcctctcacacantgtggctcca

SEQ ID NO: 628907 - DNA, 666 bp, Homo sapiens
ccattttgtttttgagactgtatttcccagcatatatctcctaacctttgatgactctgtactttgtttttgagactgtattccccagcatatatctcctgacctttgaagacactgcatttgtttttgggactgtattccccagcacatatctcccgacttttgaagacactgcatttttttgagactatattccccagcatatatctcctaacctttgaagactccatatttcgtttttgagactgtattccccagcacatatctcctaacctttgaagaatctccattttctttttgagactgtattcctcagcatatatctcctaacctttgacgactctgtatttcatttttgagactgtattccccagcatatatcttctaacctttgaagacactacattttgtttttgagactgtattccctagcatatatctcctaacctttgaagactccagcctctgactttgctgactcagaaatcaggatttggaatttttaaaattaagaagagagacctgactccttgccaggaattctcagaatcatgtgattagccttcctcctggagaaggcctttgcagttgataccctgagggagtgaaggaggaatcagagaccttagtccctcaggtcgctaataaagctgtttttttttttaa

SEQ ID NO: 628908 - DNA, 90 bp, Homo sapiens
ctagaagattcagcaaagtacttttgtgctcttggagacccccccttcctcatactgggggatactgtgggggccaccgataaactcact

SEQ ID NO: 628909 - DNA, 234 bp, Homo sapiens
  misc_feature (118)..(118): n is a, c, g, or t
tttataacaccgaaaccaattttgaaatgtcagtcgtccagcttgccaaagaactaatgcacctgataaaagcgaccaataacagtttaaaatgaaaaatagggctaataatgttaangatgaacccaccaatgatatgaaatgcaggatgaggttgaaccacataatgaattttatactgcagtcctaaatagccttggaaaaacagaaactgaccttaaaaccaagaacccc

SEQ ID NO: 628910 - DNA, 252 bp, Homo sapiens
cgacaccaggagtactcgagattggccgaacgcgacctggctatcataaaggcctatcaatcgcgctccttgcggcacgagttttacccggcccgttggcgagtcaaacaccgctgatgtcacttgagcggtgatctgtccgggaagatctgacctgatgcccgtaatgagagccgcggaaatgattgttccggcctgcacgacaaatggcgacgcagggcgcgcaatcctgttaggtgccgtggtccttcg

SEQ ID NO: 628911 - DNA, 433 bp, Homo sapiens
cctatgtgcaccagcgacatgtcctatggtgctattattagtgttgaaccactgaagggagtcagaatcacctccagcttcaaacaagttgggaagttcattaacctgtgtgtattctaagtctcctcgctttcgagctatatacctatgttctatagccaacactccactagggtaacttaaaacaaaatagtaatttatttacaactagcaaagatgtcaaaaataacaggaacaatatatcacaaatccaagatttttatgcacaaaaggcaaacagtatatacacgaaacaaaagatgaacacacaatccatagggtaaacttaatttgaccttagctaaacagttacagaatgtggcaaaatggttatcatttatattagtcaccctgggccaattaaacacacacacacacacacacaatcttttac

SEQ ID NO: 628912 - DNA, 125 bp, Homo sapiens
tttatcccagaagcactgtctgtgtcttggatggtagcgagacaagatggtggatccccagactcagtgtcttgtatacatagggaaggggcatacatgcttcagaatggggcaagcggccgcaa

SEQ ID NO: 628913 - DNA, 283 bp, Homo sapiens
gggttttttttttttggtcccccggttccctgttttaaaaaaaggggccccccaggtccttttttgggggtttggcccgattatattaggttgggtgggggaaaaattttatggggggatgcccccaaaagggggggtccccaaatttggtaggccccggccctttccagctcctgggccttttggggggtttggcctccatagggggcttccttttttttttggaaggaacccctttggttttaaggggtttgttaacctttaaggggtttatacttttgga

SEQ ID NO: 628914 - DNA, 935 bp, Homo sapiens
  misc_feature (7)..(7): n is a, c, g, or t
gatctcncttaattccagatagtcgttccctatatatgaactttcggtcggccgacccactttctttgaatctttctccgtgacacttaatataatgtcgcccacgtaacatatttctttcccgcatcaaattcgcatgcctcccccgttcaacagaaaaagaagactgggttacaaaaaaacacattgtactggggcaaacaacacttgccaccgtccccaagacaccctcgcgctaatcttttaactgcgtgccatcccccaaagaccacttttttttccgtgttcaaacagaagctctcccttctttgtgtcccgcccacttcaacttcactatctataccccagattacccaaaagcaattgttaaaaaggaatcttataaattatcagacctttctatacaccaactagtccttgccggcccgcaccccacccattaggcaacctctctgttgtatgaaacccacccactcctgcagcccccccgataaactcttttaaaccatcgtatatgaaccatcttcaccggcgcggaattattccaccaacacaaaagaaaaacgggggggtgttacaatatcatcgttgaaaaatcttctcgtcccctctttttataagactcctcttatgtgtgcgccccacaggaaacaatcttgcgtaagtatcctccccaagatatctccctataaacatttcaggttaaaaaacatgtggcccatccctgctttttgtgactaaaaccccgacctagtagtcataactccaccaccagagatctttcgcagtaaccaccggaccatttattattttagtaagttcatacgtactcttccccgcgttttttctcgacaggctcgccggcacacttaacacttttgagaacagcacccccccaaacaatcgaaaattcgctctaaacagcaaacaagaca

SEQ ID NO: 628915 - DNA, 506 bp, Homo sapiens
gatgaaaagagatgaaataacagaaaataagcctgaaagatcagctgctaaatgtttatcaatgccgaatgtaccttgtggtaattacgaagaaaactatagtaggagtacatgaagaacttgctaaggaaagtgttaaactgccttctttgagggtctttaaaattaggctaaagaatcttctatctgaaataatttagtcctgtctaaagactgattagaaaagttgtaatgacgttagaagggttctttcagtcctaatatctaagcatgagcagggcagagaagtttaaaccaatgtggagtttctgcatgagtatgtgaaatttaagaaactaagttgaaacgggctcagttcagtaaagcaacgtatgtaattttatttcatcctgtttccaaaacatccctattcctaacaaactgctggatatactatttagcagaaatttccggcagttgtaattccactaattcacttttcaatgttgttttctttaaaataaagg

SEQ ID NO: 628916 - DNA, 707 bp, Homo sapiens
acagtaaattacacacacacacacacacacacacacacagcacacacacacagcgccgagcatctgtctcgggtaccagagcgagcagctgtggatctcagatgacagcagcagggaagaaactccacgtgaagggaaaaaacccaatattttccattctccacaagagaaaacaggtgcaagcccccagggactttactcgtggggcgtggctagtgtgtgacgtgtctcggatgaatgtgagtgacccagtgcacagtggagtcaaatagtgcgtgctttccctctgtgtctcacaagctgtgggtgagctcgtgtctctgcagggttagaatgtcgtgctaagagatcactagtgtgaagatgtacttggagaaacgtgaaggtctcttatgtgtaagtgtgtagagttagagtgagccatatattttcgtgccgtcttcgcgggactattcatgcagtgtgtcccaagctattcccttggtgaattgtcgcgtgagtggggccagtaagagtgaagtgtgctccttgaatccgagccccatctggggcttctctaacaaatctgtagtatgtatacggactccagggagagagggtgggcttcttctctcatgtgttccttgtggacacatcgtgggccacagatgtgtgacccgtgtgggtgttagtcggtgtatatgtataaactccgtgcgtgcttttcc

SEQ ID NO: 628917 - DNA, 955 bp, Homo sapiens
gccacgttcgcagacgccaccgtcgaggaaaaccgtgtgctataagcacatggtcacaccccaccgtgttcttcgacattgtcgtcgacggcgagcccttgggccgcgtctcctttgagctgtgtggcagacaaggtcccagagacagtcagacagattttcgtgctctgagtcgactggagacgcaaaggatacgtgtatcagggcttcctgcttcaccagaattgttccagggtatatgtgtcagggtggtgacttcagacgccataatggtactggtgggcaaagtctcactctatggggagaaatctgaagatgagaacttctatccttaaagcaatacagggtgcctggcatctgtgatccaatggcagaattgctggacccacgctcctaaatggttcctcacgtttgatccagtcgtgcaactgacaccctacttgagatggttcgagattggcaagccatgtggctggttagtggacacagtgaaacgaaaggcttgacgtatcgtgcgaaggccatgtaagcggcgttagtgggtccaggacatggtaacgagccatgaaaagaatgattgccatggctgacgtgggacaacttgtaataagttcgactatgtgtctatctcacccaacaagatgcattccttctgacgctgaggagagccccgtccaacgccattggttcgatggactcctagaatctatgtgcctcttgaaatccctggtccatgtttccgtgtgcctccatgctagctggatgcgaagtcaggtctgatatgactaaactactacatgcacaaacaacaaagcaagcgggggcgcgcgccgaaaatacacaacggtggcggccagaaaacacgccaggccagaacggcacgaggcccaaaaacgggcacgacagaggaagtaagcgcacccccgggacacaaccaacgcaatctccttcagcg

SEQ ID NO: 628918 - DNA, 342 bp, Homo sapiens
atggaacgagatatgattgagatgaacataacagagtggctcctcttatacttagagacagagtttcacttgttgcccaggctgaatgtgaatggagtgatctcagctcaccgcaacctccacctcccaggtccaagcgattctcctgcctcagcctcctgagcagctgagatcacaggcacgcaccaccacgcccggccaatccttgcatctttagtagagatggcatttctccacgttggtcaggctggcctcgaactcccaacctcaggtgatctgcccacctcagcctcccaagtagctgggactacaggtgcgtgccaccgtgcccagctaattttt

SEQ ID NO: 628919 - DNA, 1138 bp, Homo sapiens
gtctcagcctcccaagtagctggggctacaggcacctgccaccacacccggctaatttttttgtatttttagtagagacggggtttcaccgtgttagccagaatcgtcttgatctcctgacctatgtgatccacccgcctcggcctcccaaagtgctgggattacaggtgtgagccaccacgcctggtccaagaacccaaacttttagatctagagtgatgtcagcatgaccattgatttcctgaggcccaggggtgaaggagctgaggacagcagaggggtgaaggcacgtcagctacaagacagcagcagctgatgcacaaggctcccaagtgcctgaagtcacccggaacttgggacgtgctcagaagcttacaaagctgcctcgaggtggggaacacaaattaatccaagagcagatccctgatccctataaaaagtgtactagatgcagtggggggcattttcacatgagcagggcaagggaccagacagatacacagaacggacaaacagctcttgcggattggggactaaatgctcagctttatgcccaaaatcttaagtgacttaagcatcacttattagctcacgcattctgtgggctggaccactttggtatggctcacagggccagggactgtgcttgggtcttacctgaagcagcaccctgcaattgtctgcgggtcaaactgggggtatgggaaagaagacgaggagctagaccttgtcttcccttcccaaggaacggcacgacaggggtaccactggggctcggacaagcagacacagaaggcgaactcgcacagcgacctagtcatccctaccaggaaagcaagccaggctatcacactggaatgggccgacaaacaaggaaggggacaagacagggagacactaggtcgttcccgtcccgagggaaatggcagcgcacagggtacgggcgacctgggctaaacctatacggctgggaggcaagcacaggagcctcccacggggccaagacacagagacagaaccaatacgcccaccaatagcaacagattcctagacagccctaccggtgcaacaatcagagaacactggtacaaaatcaccacattgagcccagatggcaaagtcaagaccggcagaagcc

SEQ ID NO: 628920 - DNA, 333 bp, Homo sapiens
ctttgactacttctcaggctcagacagaaaaaccgcaacccaagcttaggttgcactcagtaggcctgttgcttgtcatggtctgggtgccgccatgctgatgctgttgtgtgtgtaggtttgtgtgtgaatgctagcatgggagtgtgtgtgcttgtgtgacagtgcgcctgtgtgagtgtgcatgtgtccctgtgtgtgtgacaagtagttcaaacagacacctctaattccagttacatccacagggctttcctttgccttcctcatcagtatttgtatctttcctctcactgtgagaggcctggctcccagtcatatcaatgttttttt

SEQ ID NO: 628921 - DNA, 207 bp, Homo sapiens
agagagatctagcgcgcaggggtccatacatagagccgtacatgcccaccaagcaaggcccggatggagcagcacagccgcgtgctcttggcacagagagagcgtactacagcgcaggtctccggagggccgtactagcaccacctacaaagacctaggacagcccacggcagtacatgacacgctgggcagcgacaagcggcatga

SEQ ID NO: 628922 - DNA, 504 bp, Homo sapiens
attgggctgcttcaaaagaatgactgccctcaaattgaatccttgcccggtgaaccctttcccccaagaggccccgcccaagtccagtcggttggtccttaaaatgaagaattcggaacacaacctgttgttgaaaatgtgacctttaaacccccccaaggaatttttgcccttcaaagttttcaaccacttttatttacctaaagaataaagttattccgaattaaccaatgaatggcttccaatgaaagaaaaaaaactgcccttttccttttgggcccttaaaaggccatttttgcctttattttttaggctaaggaaggtcctcctccatttttttacaaaaaatactttggtgccttaaagacatttcccttccccctttccttttgagggttttccttttcctttccatttttttaccataaaggggatgttcccttttgtccccttccccacctttaaatttggggtccttttttaaacaggaaaaaccaaaccaag

SEQ ID NO: 628923 - DNA, 193 bp, Homo sapiens
gtgatcagcggtctatgctactttttgtagataaacaacatacaaatcatttctcttgaaactaccacaagtctctgctttcttcaatagcaaaattcacagagctacatccttgctatctttaattcctctcttcccatggtctcttaaacatatcccaatttggctttcaaagaaagcactcaaccaagtc

SEQ ID NO: 628924 - DNA, 1780 bp, Homo sapiens
  misc_feature (415)..(415): n is a, c, g, or t
  misc_feature (987)..(987): n is a, c, g, or t
  misc_feature (1153)..(1153): n is a, c, g, or t
  misc_feature (1164)..(1164): n is a, c, g, or t
  misc_feature (1166)..(1166): n is a, c, g, or t
cccctccctcgttctgttttgtgtggacgtgttttcatcattgtcttgcttggtagcagcacgcttcgtcgtcgttagttgcgtgtttactgctgctgggtaggggtcctcttctcctctgatcttgtgttgtgttgatgcctgtgtttgtgtatttgcatcgcgtgggtgctctgttgtgtatattctcctccgttgggtggtttcttcttgttgtctggtgtggggtggtacctcgcccctccgctctcctcctcgccacaccaacactggtggtgtcgccaaacctggtgttctcccggcgccccaagtttcgcccgcggtggtggggttgatatatgtcgctcggtcccccacttgtctttcccgcgggtggtgtgtgtctgctcccctctgtgtcgtctcatccgagagngtgcgcgcgaggcctcttttcttaagtggggggtgtctcccgcccgggtttcgttcctgggacccccgtggttcgccagggacccccctttgtgggtccccggcgccccgaaaattttgggtgtcccacacacacccacgggacaccgaagagatgttgtcgtgtggtattaaaaccctgagatggcgccccccacctctggggttttcttttgtgcccccctcccccggtgtcgcaccacgccccacatgggggatgttataattcctgtggtgaatgctccaagaaccagcggtttctcgttgtttcttcgaggaagggtgttccccctctcgcgcaacccctccgttgttgggccctccctctttaaaaaaccttcgcctttttcttcatcgccctctctggaagaaaacgcccaccccaagttggaaccctcgcccctcgtgcgccctggtcgagataatagcacccctcctccgcgccttggtaaaaataattttgggggggtttggggtatatagcacacgcggtccccccattttgatacttttctttccgccacaggagaaagntcctccccacacatttgtttcccccatataatactcacagcgtctctacacaccacacgcgctcgcgccacatgccccatattgttttaaaaggagcacatttctcccgcagcaattatagcgagcatcctgatatggatacgccatcatttgtttacaccgtttntttgaggcacntnttttgggggggtgtttatatcttgcaccccacacgcacacacccacagtgccccacttttgtgagaaatagaaaacacccacgtgcgcccccctggagatatttacaccacagatactcacgaatatgtgtctcacacacacgcgcgtgtgagatacttttgtgtgtgttgacaccacatagagccccactgagaaggtgacaccacgagaaccttggtggtggtgttctccacagatgggtgtttttcttacacaccccacacataatagtgttgtctccactcgtgttcacacccacagccgagagcgcccaaggggtgtctcccacctggacgccccaaaggccttgagggcttgcgccacttctacgcacttgccacaaccacaattgtgtttcctcataaacgcacttcctctttatttcttctgattttatccctcgggtgtctgcctccacacaccctggagatataggaagaattcttctggaactaagctgctcgtgaaccacgctgcccctcatcccgcggcccttaatggagattttggacccctttttttctctgggattccccgcccccccccctcctatagagatgacttttaaagggaa

SEQ ID NO: 628925 - DNA, 790 bp, Homo sapiens
agtccgaggcatgcggatcacttgaggtcaggagttcgagaccacctggccagtatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaagaaaagaaaagaaaagaagtatagaaattgggatccttgggtcggggttctcccaaattctttggaggtgtccagggtcaactggtttcagcttggtttgggaaaccccttgccggaagtcgcatatgggcgtgttcttcactttgttcccagggttggaggaccagaaagtagcctctggtttcggaggaggtgggaagtcaagtatcactttcatttgtaactggggactggtccaggaccacttttgacaaaagggctggttcccttcaagggtttctggaagggaaagttctatcactatggtgtaacttggacttctgaatagtttgttaaatgagggcttatttgggaaaaatgcggagttacttcaagtgtttcgcaataccttcaaagtaggtaatatccagagacagtggtggggaccagatggcttagagaactttcgggaatattctgtgtcgaagattcttaattagtgaatgtcttggacttaaatttagcaaaaatgtgcaacattatccttgggccatttcttaaataggga

SEQ ID NO: 628926 - DNA, 543 bp, Homo sapiens
aaatttaacagtggaaggcaacaattgacttagtagaaacaatggatgctgattaagcgtttagaaggagagcggttttcaaggttatatggtttggtaatgttccttccacgtacatactaagttcgtttggtaaagaggtgtgtggtgccagttgttccacatgtcgtggtggcagtaagcgtaataagaaccaatgtggactctactactacgatccacggttgggttgtagactgcactgtcctcgtatgttgaattcaagtgattgtaattaacaagtgcaacgttaggcgtaacgctgggttcaggttatcgtagttaggatgcatgcctgtaagtgtcaatggggctcatggctgctatcccagatgagcaatggaagtgtagcgcacgtctcctcattccgggtgtcattaatgtgaatgcagcataagtagagtcaggtgaaaatgggaactttgatcaatcaacattaacacgaaactcttattgggtaaacaatttaaaacataacaaaaaaaaaaacagccccacaagaca

SEQ ID NO: 628927 - DNA, 974 bp, Homo sapiens
ggctctatcttgtgccggaagtgggaagagagaaaggttgtgatggcggtatagctgcatccgaggtgctggtgaacagcgcgaggaggggtccctcgctgcgggggggaggtgggccgataagaaagcgcgaacagagattgcgcaaatccgggggagcttgcaccttgatgggaaatttgaagctcgtaaattaaatcaccaggaagttggtggaaggaagataaaagatctaagaattaccctgcaatttggggagaagccaaaaaagagctcgttggggaggtgggggaaactaaaggggaggagggaaaagaaaaggggatgtggggcaaggagggacgaaagatatgagaaaaggtgaacgtgggtgaaagatcagtgcaagaagattgcagaaaagatgggagagggaaaacagagggaggaaaaaccgtgtgatcggggatttacaagatttatgctgctggccaagttacggccaggtatccatcgggttgaccaagcggatcaaacttggatgtgggaaacatttgagagacttgggagaaaactctggagaaagatgttttcccaagcaatcaaataggtttctttcatgggaacaagtggtgccttacaacagaggaattggacagggtgggtcattagatttgaaaaacagtttggaaaaaggagaaaattatgggggagaacggttcttataatgatgagtcgatttcgaacttatttatgaacgggaagtgccaattcacaagacaggggaagattctgtgggaattaccagtgaattaacggatttggagaggacagtgtctatctctcagaaggttaagaagctgaagtgaaaattggtcaaacaagttttgtgattcacgaaaaagaatggacgcgtcccagataaaaaaggtgtgagattgattacaagggggaagatgggggggcacctcaaatttatgtggtgtgtgaagcga

SEQ ID NO: 628928 - DNA, 222 bp, Homo sapiens
agctttgaggctcactagagatagggctggcgcggagtctagagctctgccaccaactgactgagggaaactgagccctttatctctctgagcttctttgtcatcttctgaaaagttatcatactaaacttaactaggtttgcctgcatgatagccagtttaataatagtaatactagagtttacgattctttacgtgtgtactcttgaacgtgttaacacc

SEQ ID NO: 628929 - DNA, 406 bp, Homo sapiens
tgggactggagaccgggctccatttttcaaagggttcccgcagctgtgcaacctgggtttttggccagtgaatcaggaatatttgcttgggcttttgaccagtttgaaagtcgatttctaccagctgaagctgataaaccccttaaagtatccagagggggtgccccccccccagaagaaactcttcccgtcagctggaaccccgaaattttcaagagaaagagtttttaatgaatggggaattttttctctttttttttttttttttttaattaaaaaaaaaaaagcttggggttcttggggatatcccgtctttttgggcttgggctgggaatataaaggagaaattcccttgcttccttcattgttgtttcattttttccaataaactgtcccctgtccccta

SEQ ID NO: 628930 - DNA, 511 bp, Homo sapiens
aatgagtggtttgccagatttgttgaaacggcaaattgcaaagaaagctgctgcgctggatgtgtacaatgcagtgagtaccagtttccagagagtcgtacatgtgcaacaaaaggatgatgggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtgttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaagaactggaggctgatgtcagccataaagaaaccaaaaggaaactcgtagaagcagaaaattctaagtca

SEQ ID NO: 628931 - DNA, 153 bp, Homo sapiens
agctggtagctcattgagttgcattccttctcacttgggtggagttgtaggattctgcctctggaaatgtgccatccttctgaatattggacccaggaagaggagtgtactagagtggccagctctccgccagctgatcacaccaagagagaa

SEQ ID NO: 628932 - DNA, 862 bp, Homo sapiens
gtatatacacacacatatatataaatatgtattcatgttcttaaacttacatacctgttaggagtgttgcagtctcaaacaaaataagagctacaaaaacaaaattttaagtcactatatgattataaaataataatattatttaataatctttggcaagtagaaaacctacgttatataatggacattgaagagaccaaatctatgaactttttatcttaaaagaactcttattttcttgtgataaatttttcaaaaagaaagcaaagtttgcttaaaagcatttctcactgatgtttctgcatagtctaattttttcctttcacttcatgatttacttatcttgcctttaaatttacatccccaaattcttcgtagacaattacaaatgtccttcctcctactttagatatcacgtagctgtaagttttcatttcttaatcatacattatcttactattatttagtagctagttcaccccttaataattttccactgaactacggattctttccagttaacatcaattctactgtagacatacccaaatattaacatagaattttcaagtaatctcaaagaatcctaatagggatatccgtcctgtttatacattgggagcttaatgtttcttctaatgtttcccatgtcaaattgccctaccagatgttttagccagactgctctttggatggtcctccttcgcatcctaaccggtctttcatccccgtggtccgggattagttgtttccctctcatgtctaccaggggatggcgttttcccccggaggcccgggccggcgcggcctgcttgtaggaggggcccggtctcttgggcgttcttccttgggtgcgtacatc

SEQ ID NO: 628933 - DNA, 734 bp, Homo sapiens
taatataaaagcaccttggtttattcacttcttaaactttgtaccttttcactttcttgattattaggtataaaatatgggatttacatgtagaaaaaatatttaatgggcccaggagtccggcttcttttagtgggcaatggtaattcggtgcaaccctctcagtaaggtagattaagaaaggtgtgtatctgcgtatgtgtctgtgcatgtgcacacatgtgcattgggagtgctaggaagacaattataggaccaaattccaaaataaaagaaaatgaaatttagagaaacatgaacctggtatttagctcaattttttgcctttaggagtatctgccaattcaggaagaagtggtgggtgagatcaagaagttgttgagagttttgggaaaattcatagaattgaaaataaaaatggggttcaaatttggctaagagacatgggtaattcaccaacagtttgaattaggattctggatgatctagacccctcaaataaggggaaaatattttggcaacttctaatttaaattctggataatatgaaggtcactcgtggtctatggatagccctagaacacttggcttaaagaaaaatcaagctactctagaggataagaaaattatccgtggaccttaaatccttttggcatatttttatatggaacctgtgcgaacaatgagggcaactgggcaatgagtaacagatgatgttcgtgaaaagaagagaa

SEQ ID NO: 628934 - DNA, 1138 bp, Homo sapiens
  misc_feature (1138)..(1138): n is a, c, g, or t
gggctggccacccgagacgcggcgcgcacgctcctggcctgcgcagcccggccctggcctatggctggctcgccccgcccgtctcccgcgatctcgcgtttcgtgtctcggctccggtcatttttactgccccgcgagaagagaagttcggccctggtggtggccccaaagcccatagtgaatcccttccggcccggggtacagcgatgcctcccccggcgagcccgtgggtcccagtcgcgcatcatgatgggtccgggtgtggcgagattcccccgatcgtcctccggaagatctttcccctgtctccatctcctcttgctggggatggtgaggagtgcatgaggggttgctctgcggagggtggcattccgagccgttcggagttccccgttgagatgtcttaagaaccaggccgcaagaagcaggcatctctgactcactcacatactggcaggcgtcccctccatgcatcccacatacaagcactgccccaatccccagcgatggcctcactgtcgtaacgtaggtcataggcgctactgaaatagatcacccagaatttgaatcctgaccctcccacaatgcaaagccccaggagagcccaagaccaaggatggcaacatgaaactgtaggccagggcatccacatagtggcatgtacacaaggctgactggcctagccatagccatctcacaggagcacagccgctacttacctgcaacacccaccccgtggctagcaacaacccgagggtcagctgattcagacgctccaggcattccggcactggtgaccggccctaatgggaatatcaggggatcactggtccactatctgtcagcgctaccgggggcgtgccccgacacaagaaccccaaaacaccggcaatatcccgggagctacggagacactgacccacaggacaatacacacgtgacaaaacacaacaaagccccacgaagcgactgcaggtaccaaacctcgcgccacgtaaaaccagagccacaccgcgcacagcaacacctacacaacgctctcgagacacagtgcatcagccacacacgatccccgcacaacaacgcagaccccaaacccaaccgccacaccccacgagcacgcagtgtccgctctcgn

SEQ ID NO: 628935 - DNA, 147 bp, Homo sapiens
cggacatgcgatcttagatacaggtactacttagctggacattcgcaattatcattaaatgattctctaaatctttgtgtgtgtgtgtgtatgtttttcttcgttagagtttgagtgtttagctttgtgttttggagatggagtttc

SEQ ID NO: 628936 - DNA, 294 bp, Homo sapiens
ccatcatggacacgagtcgcgtgcagcccatcaagctggctagggtaacaaagtgctgggcaggaccggttcgcagggacagtgcacgcaggtggagtggaattcatggatgacaccagccgctctatcatccgaaatgtcaaaggccccgttcgagagggtgacgtgctcaccctattggagtcagaaagagaagctcgaaggttgcgttaatcttgcagctggtggggttctggatatccactacttagcccacggaatgatctgcaactgttaaataaagcatttatatta

SEQ ID NO: 628937 - DNA, 418 bp, Homo sapiens
  misc_feature (149)..(149): n is a, c, g, or t
  misc_feature (155)..(155): n is a, c, g, or t
  misc_feature (158)..(158): n is a, c, g, or t
  misc_feature (181)..(181): n is a, c, g, or t
  misc_feature (380)..(380): n is a, c, g, or t
tggggggacaaaatgggcacccccccactgtccccttcaaagtgaagggccgttggggttggggtgggaaccccccatcccggcccccagggggaatggggtttgtttccgcccctggcctaaaaaagttgttcataaggggtggtatnaatgantgnacaccctcagcccgggggtgcantgcccccctgggcaattttgccaaggccccctttgatgccatttttaaaacctacaggtacctgcccccccccctttggaaggagactgtattccccaagtttccctatcaggagttccctgacccccttgtcaaaaccccccccaaagtttccgtgcaacgggactcaggctcccacgctgtgggtccacacaaaggngtttttatacaaagaaaaataaaatgaattaagggtga

SEQ ID NO: 628938 - DNA, 1315 bp, Homo sapiens
ccctatggtagggactccagcacgaggtggaagtccatatggacaacaggtgggagttttaggggcctccagggcagcaggcacacacctccatatcccggaccacatccagctggaccccctgatcatacagcatgccaacaacaccacatgtttgtagctcccccaccaaagacccagcgagcttcttcactcagaggcactactgaaagtacattgaaggactcagtgcggagtccaacagcattagccagtgggatcagacactggccgctcgaagacgcgacgtccatttgtcgcacgaccaggagagccgccataccctctcactggctgaaaagcacaaggggcccaaaccagcatggcagatgccctctggacgccttcgagatttgctgctccgggacaacctcaacattcgacaagcaatacaacctagaacaatgtttacatcacatccattcacgtctctcattctccatactagcaagccattcaagcagtgctggatcagtagcccataatagtctcactgcgctggatggcacggcaggcacaaacaggagcgaataaataacacatatgcatctacacctgtacaatcacataaggcccacatactaaaaatattaccgggcaacacactttctctgatacaagagcctactttaccaactatagcattcagcttccatactccacggctggccccgtttaatcaaaaccatacaaccacagaaatactacgtggcacttcatgcttgcccatgctcggtactaccaaaccaccggttcaactaacgtagggaacaagaaacacaacacacacaaccagaccaacgcaaacaaaccagcgaacaaagcaaggagaaagaccaacgagaaacccaaaacaaaaccacacacacccggacaaacaacacaaagacacatagccacacacccgagcaaccaacgccgatacaggaagcaaccaaccacaatacatacacccaccacgccaaccacacaaacaaaacacacaacaccacacacaaaactacaacgcgagacaaagaagacagagcacacacgagcgagaacaagcgacagaacagaaggacgacacacataaaagcaaacgacagggcaagcagaccacccaggaatcacaacccccgaccagaccccacccgaagcacgaactaaaacggcacgaaccgagggcagacacagcacgcccaaacaaccacacagacaaatgaggaaaatcaatgaacacggaaaaatcaaccaccagaacgaacaacacgcccatctccctaccgacgccaaa

SEQ ID NO: 628939 - DNA, 188 bp, Homo sapiens
atcgatgtatgatggttactcatttgacgctgctgtcacccagcaaccctaaaagagaattttgtacattctgtatcccacagacctgagcaagccaggcctggcttgctcaggtctttgtcttgaggaatggtaagatactaaaaaagtattgataacagatactgagcagacctgagcaagccagg

SEQ ID NO: 628940 - DNA, 159 bp, Homo sapiens
gctggacggagaacggcagctctttgactctagatgtcctgagtttacaggtgtaactcgtagtcgtgcacgctgatgcctgccagctcttctgacagacttcggcatcgcatcacgggctggcagaagacgcttcagcttcgcagtcaggattcagcg

SEQ ID NO: 628941 - DNA, 92 bp, Homo sapiens
agctccctttgcagtctggaagaaaaaggtattgcagtcagaactgtgtactgatgatagaaagcctctggtagcaataaaaaagtgtcctt

SEQ ID NO: 628942 - DNA, 349 bp, Homo sapiens
tctagaggatccacgatatgtgtctcactctgtggtcaggctggagtacaagtggcacaatctcggcttactgcaacctcaacctccacctcccgggttcaagtgattcttgtgcctcagcctcccatatagctgggactataggcacctgccaccatgcccagctaatttttatgtatttttagtagagaaggggtttcaccatattggccaagctggtcttgaactcctacccaccttggcctcccaaagtgctaggattataggcatgagccactgcacccaggctagcattttctttctaaagcacaggtccaatagcatcactccctgcttccagaccttccac

SEQ ID NO: 628943 - DNA, 355 bp, Homo sapiens
  misc_feature (27)..(27): n is a, c, g, or t
ttttaacacctaaataactctaagttntgtacatgacatttacacaataagaatacaaagaggccaggtcctgtggctcatgcctgtaccagcctttttgggagaggccgaggcaggtggatcatctgagctcaggagctcgagaccagcctggccaacatggtgaaaccctgtctctactaaaaatacaaacatttgccaggcgtgggtggcaggcagctgtaatcccagctactcgggaggccgaggcaggagaatcgcttgaacccgggaggcggaggttgcagtgagtggatattgcgccaccaaactccagcctgggcaacagagcaagactgcatctccaaaaaaaaaa

SEQ ID NO: 628944 - DNA, 125 bp, Homo sapiens
gcttgatgcttctggtcgctctagagtatccccctgcctccccattcagcgacactcatctacacactacacaggtgcacccacctcgatgagaccgcctaagccccagctgcggtgggtccgac

SEQ ID NO: 628945 - DNA, 587 bp, Homo sapiens
agtaacatgattaatttgagctcgtacctctcatggagctggtacgcagtacaaagtaggcgtgcattcttcaccaatcggcggccgcatgtggcaccatgcactcccaccagcaggggcatgtgctgcggatccttgctaggaattgtcaggctcccgaattcttctcctgcggctttccccatccctggtttaaatatttatcccacaaaatggggagggagtcaaacagacttgggataggaggagtgagtgccctggtaaaaccaattacttagctaaacctttggctaaaactctaggaagggaggcacaaaatgggacagtgtgggtttttttttgggcttctctaggtaaaggtttaatttaacttcagcttgggtaaaactattctttccttcttttttctctcccagagttctcaccacctcttcccaggctaaatccttcatgttgcaggagacagagaatcccaggtgagacccggacttttgctcctccctcccttccttttttcaccatgttcaggataaattatctgggttaggttcctggagggaaaagggcagagaggccctgacttgaat

SEQ ID NO: 628946 - DNA, 345 bp, Homo sapiens
  misc_feature (46)..(46): n is a, c, g, or t
  misc_feature (113)..(113): n is a, c, g, or t
  misc_feature (183)..(183): n is a, c, g, or t
  misc_feature (219)..(219): n is a, c, g, or t
  misc_feature (251)..(251): n is a, c, g, or t
  misc_feature (267)..(267): n is a, c, g, or t
  misc_feature (306)..(306): n is a, c, g, or t
  misc_feature (337)..(337): n is a, c, g, or t
atcggagtcttgcaggctaattcccaagggttcacacctccaggantggatagatcctctccagataacagcccagtgcactgggatgttacgtcaaccatccatcacaactnggggtcaacatccccatcatcactgaactagtgaacgatactaatgttcacgtttttgggaccaacgacngatgatgatgaccctgatacagaactgtacctcacngcagccctttgcctgtgggacagcatttgccngtcagtgtcctggacncactccatgagcgcgacgtacttcaattgacaagtatcntcacccttgatacggaccctgggtgaccggnagagccac

SEQ ID NO: 628947 - DNA, 638 bp, Homo sapiens
gggcttccaaaattatgcagccagtcctaagccaggtgtggtggtgggcccctgtaatctcagctacttgggaggctgaggcaggagaatggcttgaacctgggaggcggaggttgcagtgagccactgcactccagcctgatgacagagcaagactcagtctcaaaaataaataaaaataataaaacctccataagtaatcctgaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagagagtaagacgagagagagagagagaggaggcggagaggaggaggggcgggcgcaggagcgagggggggggggggggaaggagggggagagcagaaaggagcgggagaagagcggcgagggcgaggaacgaggcgagaagagagggcaggagggagagaagggagacgaggagagggaaagggagaggaggaaggcacagcgggagacgaggaggggggacacgggaagcacaaaaaagagacacgaccgcgcaaggaccaccgcagagaaacaacaagggccgcggaggccgagaagagacgacaggggggcccggggggaggggg

SEQ ID NO: 628948 - DNA, 336 bp, Homo sapiens
  misc_feature (169)..(169): n is a, c, g, or t
  misc_feature (200)..(200): n is a, c, g, or t
  misc_feature (334)..(334): n is a, c, g, or t
tgaggagccggcagcgggggcggctgtaactgtgaggaaggctgcagagtggcgacgtctacgccgtagttggaggctgtggggggtggccgggcgccactcccaggccgcagaagtgacctgcggtggagttccctcctcgctgctggaaaacggagggaaaaggttnctggccgggtgaaaatgcctccctctgcttnacggggctgaagggcccgaaatctaaggcctccctaatcgccccggcctccgttaaaccccaagtctaaaaatattacccgaaaattcccatctccggccccggggcctgggggctccgctgaattgatcggtnct

SEQ ID NO: 628949 - DNA, 139 bp, Homo sapiens
agtgtgtgcgggtttagaggatccctaagaatatgatacgtctctaaatcttcccatttaatagcttagttgggctggtggggttggattggtcagttcctgatgcagagcgcaagaccggggggagcgcaacaccggg

SEQ ID NO: 628950 - DNA, 169 bp, Homo sapiens
agtctaaaaggcttatcgagctgatctgacgagttcttgaagtgtactggaatcgttgatctgcctgtgaactttagttcacgctgaatacagtcttctcagattttcatgactgtaagggtgtgaaaatggaacgcatccttgatcttaggtccatctgacccatctt

SEQ ID NO: 628951 - DNA, 250 bp, Homo sapiens
aaaaaaaaaaaccttttaaaaaccccccctttaaaccaaacccttttttggtttttgcccaaggggttttccaattttgtgggggggttgttttttggagaggaaaaaaattttttcccccctaaaaccccccctttttttcccccctttttttttgggttgggggggggggggggggggggggtttttttttttttttttttagggggggggggcccaaggggaataaaccggggggttgggcccttta

SEQ ID NO: 628952 - DNA, 473 bp, Homo sapiens
cacgaggcctcgtgccgcgtgcgcgcctcgtgcatgaccgaatcctcgaagtcgtagatgaagctgaccgcgctcttcaccttgcgcttggcgtagccggccagcgaccagtagccggcgatgcccagcgtgcggcgcagccaggacagccgcgaattgatgctgaccagcaggttgtaggcgacgtcgccgagcagggcgacccagcggtggtggcgcgtgacctggtcaaagtcgtcgccatgcaccagccagtagcggcggccatcggcagcctggtggatgtactcgcgctgcagttcgatgtcgccgaacacggtgccggtgtattcgcgcagcgcctcgtcgtgattgcccgggatgaagacgacctgggtgcccttgcgcgcgcggcgcaggatcttctgcacgacggtgttctgcgacggcgtccagtgtatggagcggctcatcgcccagaaatcgatgatgtc

SEQ ID NO: 628953 - DNA, 389 bp, Homo sapiens
gggggttcagggctgtggacagcagcacctgcctcccctggcagggcggatatgattagtatgagagagtgaagggattacacagaccttcttaaaagactaccaggccaggcacggtggctcacgcctgtaatcccaacactttgggaggctgagatgggcggatcacctgaagtcaggagttcgagaccagcctgaccaacatggagaaaacctgtctgttctaaaaataataaattagccaggcatggtggcacatgcctgtaatcccagctactcaggaggctgaggcaggagaatcgcttgaacctgggaggcggaggttgtgtgtgagccaaggtagtgccattgcactacagacagggcaacaagagggaatctccgagtca

SEQ ID NO: 628954 - DNA, 313 bp, Homo sapiens
  misc_feature (66)..(66): n is a, c, g, or t
gaggacgccgaactgggcctgcgggtgttcgagaaaggcctgtcggcggcgaaccaccacgaaagntacggcaagggcctgatgcccgacaccttcatcgacttcaagaagcagcgtttccgctgggcctatggcgcgatccagatcatcaagcgccacaccgccagcctgctgcgcggcaagaacaccgagctgacccgtggccagcgctaccacttcctcgcgggctggctgccgtgggtagcggacggcatgaacatcttcttcaccgtcggcgccctgctgtggtcggcggcgatgatcatcgtgccgc

SEQ ID NO: 628955 - DNA, 318 bp, Homo sapiens
gctcatacctgtaatcccaggcacttcggggaggccgagggcaggtggatcacggggtcaagagattgagacgattctggcacaacacggtgaaacctcgatctctactaaacaatacaaatattagttgggcgtggtggcatgcacctgtagtcccagatattcaggagcctgaggcagaagaatcgctgtgagcctgggaggcggagcttgcagagaggccaagattgcaccagttgcactccagccgtgggctacagaggtgagactccatctgcaaaaagaaaaaagacaaagaaaacaagaagaaaagagaag

SEQ ID NO: 628956 - DNA, 281 bp, Homo sapiens
  misc_feature (4)..(4): n is a, c, g, or t
  misc_feature (11)..(11): n is a, c, g, or t
  misc_feature (17)..(19): n is a, c, g, or t
  misc_feature (47)..(47): n is a, c, g, or t
  misc_feature (53)..(53): n is a, c, g, or t
  misc_feature (70)..(70): n is a, c, g, or t
  misc_feature (242)..(242): n is a, c, g, or t
  misc_feature (248)..(248): n is a, c, g, or t
  misc_feature (252)..(252): n is a, c, g, or t
  misc_feature (257)..(257): n is a, c, g, or t
  misc_feature (262)..(262): n is a, c, g, or t
aganattgatnatgccnnngaactacaagaacagagggattctttgnactcangaaactacaggaagtanaaattcggaacaatagacctggagggacaactgtctgacttagagcaacgtctggagaaaagtcagaatgaacaagaagcttttcgcaataacctgaagacactcttagaaattctggatggcaagatatttgaactaacagaattacgagataacttggccatgctactanaatgcngctnagganagtgnaatctctgtgcccatttcc

SEQ ID NO: 628957 - DNA, 344 bp, Homo sapiens
cttgaactacacggggtgttcacagaggacgacgaggcaccgtccatcagtccaactgtaattctttcctttcttgtgattattaaattttaaagaaaagaggtttctactacaagctatatactgcagcttaaaacctcagtgttactttttcacttgatacacaattcaaattaatttacgacaaatacttttcacataaatgtatgtaggcacatataaactctacagctttactgtaggggcgaggtcttcattgggatcatgattctggattccatttcctgaataagtggaactgtgtaatataccatttcctcccagccatgtttgtgccatgctgc

SEQ ID NO: 628958 - DNA, 839 bp, Homo sapiens
ggtagctgaaagagaacgtgttttggatagtctgcaacagataactcgatcgtaatgtaatgatgtcgagatgaaccaagcgtaaatgactcttaacggtgtcgtattgtggcagtattgcacatatagaagtctcaggactaggagacagataagcttgatttccattttacagaatattagaaagttttctctgtcgagtatacgaagaatcagggaaggagagataaaaacctaatgaaacttaattttgcgtataatgtcgtggtgttggaagaaaataatgtgtgtagaagttgtgcgttattagcttaaataccttatagtacttttaaaagatcatccttggtaattattgacttatcctagatccatgtacaattcagacttttatcttgtgagctttaataaagaatttaaaaccatctcatttcagaataaaataaacggaattacaagttcatgcattagcatttttaagtgaaagttctcttaataagattgccttttgtctaaccgaaatagggcatacagattagttggatgggaaagtggtaaagacttgagttgtttaatactgtgcctatttccaaaaagaagacttgaatgttggctttttacatgatgctataaagatgttaagtggaggatacaatagtcttaaaaaaaattgttgggagtaagtaatacgtccggaacacaggtgagataatgaatgcggagttaatggtaaaggcaaaattaattttggaacctttttgttggttgacaaacaatgaggaacggttcctcaatatattatgggccaggagaaaacggacttaaagatatgtgtaaca

SEQ ID NO: 628959 - DNA, 301 bp, Homo sapiens
  misc_feature (4)..(4): n is a, c, g, or t
  misc_feature (11)..(11): n is a, c, g, or t
  misc_feature (17)..(19): n is a, c, g, or t
  misc_feature (47)..(47): n is a, c, g, or t
  misc_feature (53)..(53): n is a, c, g, or t
  misc_feature (70)..(70): n is a, c, g, or t
aganattgatnatgccnnngaactacaagaacagagggattctttgnactcangaaactacaggaagtanaaattcggaacaatagacctggagggacaactgtctgacttagagcaacgtctggagaaaagtcagaatgaacaagaagcttttcgcaataacctgaagacactcttagaaattctggatggcaagatatttgaactaacagaattacgagataacttggcctagctacttagatgtctaacgtaagggatactgtaaattctggccccaaatcaagggccgagctcgatt

SEQ ID NO: 628960 - DNA, 197 bp, Homo sapiens
taaactttactcttttgagaatttgcgaaggcagggaacagagccttgcccaggtaagtatggttcttcttgtcaagtgacccaacccaacccaatttctagccacacgaatagttaggaaatgccaaagtgggaatttgtttaaccctcattcaaaggagattgggacctgcaacacaagcaccttttgggtccag

SEQ ID NO: 628961 - DNA, 164 bp, Homo sapiens
ctattcgtctactgagtagttattcgattggacagctgccagcagagctgtgtcctcagcgtgctgtccagttactacctacaaggttctgaactagggaacaccccatatgaaaaatctgggtttcaggctgggtgtggtgttgcatgcctgtaatcccagca

SEQ ID NO: 628962 - DNA, 328 bp, Homo sapiens
  misc_feature (4)..(4): n is a, c, g, or t
  misc_feature (11)..(11): n is a, c, g, or t
  misc_feature (17)..(19): n is a, c, g, or t
  misc_feature (47)..(47): n is a, c, g, or t
  misc_feature (53)..(53): n is a, c, g, or t
  misc_feature (70)..(70): n is a, c, g, or t
  misc_feature (260)..(260): n is a, c, g, or t
aganattgatnatgccnnngaactacaagaacagagggattctttgnactcangaaactacaggaagtanaaattcggaacaatagacctggagggacaactgtctgacttagagcaacgtctggagaaaagtcagaatgaacaagaagcttttcgcaataacctgaagacactcttagaaattctggatggcaagatatttgaactaacagaattacgagataacttggcccccccccccccccacacacaaaaacccnacatttcagtgccaattaattaaaagatacactgtctctcttcataggactgtttaggctctgcgtca

SEQ ID NO: 628963 - DNA, 137 bp, Homo sapiens
catgcaagcttgtgtggattgagagatgaaagcctgccgtatagtgtatcttgtgcactatggtgaggagctggggaggaggagatggagcctgccgtatatgtatttagtgcactagagagaggagctggtgatca

SEQ ID NO: 628964 - DNA, 102 bp, Homo sapiens
gctgtctactcatgcatttcaaggaaatcacttctcttctaattacaagcatccagaaagagcagtcatgtggagaattgtccagaagcacttggtctcagc

SEQ ID NO: 628965 - DNA, 296 bp, Homo sapiens
cgctatacgagagggcaaacagagtatacttgcatctcacacatatttacacaggtcttttttctagatcacagttgagtttgagttatggttccttttatactggtcacgtgtgttactcactttagaaaactgttagtcctagccagatcctaagaggcacgcaattagagtacatggaacaaagtaacagatggctactttggggcctccattatcagcctttcaaaaagacaaaaaagatctatttcaagaaacaccacggccgggccaccgtggctcacgcctgtaatccc

SEQ ID NO: 628966 - DNA, 410 bp, Homo sapiens
ccccttaatctgtctcattgcggagagggaacagtgggcctcaacgataacatctggggacaagaaacagaagactacctgtgtctcaagtcttccttgattagcttttgggtgcaaacacacacatactcttggctcacaactttcaaaatatgggttgcatagcaacgttatttccttctgaaaaataagttttccctccttttttgcatattttaaacatatacatacacacacacagtcactgtattttacatatcctttttttcttttgcaaatggatattttttgagttcagtgagcttccctctccaagacattacaatgtaaacatggtgtaactctcggacaccacagtatgtttccggaggggtaacggcggtgaggaaatcagactttgcctaacaaag

SEQ ID NO: 628967 - DNA, 95 bp, Homo sapiens
gagaggtgggacacggggagaggtggggggattgcttgagtgtcatgagttggagacgagcctgggcaacaacatggcgagaccctgtctatatt

SEQ ID NO: 628968 - DNA, 126 bp, Homo sapiens
ccttcctggtccctcttgaggacagtggggatgggattggcacggccctcaccccgggtgcccatctccagcccgggcttcaaactgctgctgaggcggggctgggagccaggaatggggctggga

SEQ ID NO: 628969 - DNA, 160 bp, Homo sapiens
tggggatcatttagggattcaggatcacgatttctaaacatcagggatcaaatggttgcagatgccgttgctataagtaatgtagccggatgcagctcgtaaggtaaagcagggtactttccctggaatttccttgttaaataaatatctgtttctttga

SEQ ID NO: 628970 - DNA, 284 bp, Homo sapiens
gcataccagtgttattcaaaatgaagactagcacaagtgagctaatgaaaacatgatacttggctattccactgcacttgaatataatattttgataattagatcaaggaaaatgacctcatcttacataggtaccgacgccaaaatccttctaggttatttgagcacattcctaggctgtcacggtgtacagaacgggacaaagaacatatgtacctatagttgtaaagttctaacctacgttggaaccctgtattataaactacgcgtccagtaaccatgct

SEQ ID NO: 628971 - DNA, 1749 bp, Homo sapiens
tcataagccctgccattactgcttgtgaggtgttagcagatttttgtggggagcttcagattccctgcttgtccagtgggggtgatacctgctagaatcacagctgtgagcttctgtagagagtggatggaaagagtccttggtaaactctaaggtgcctggtaactgctacctgtagaaagaaattccttcctctaaacgttgcatcctgagggtcacgtctgtgtctcccaacaagtggttttaatgtgtcttctagttttctctctctacagcgctgagctcatggatcccaaagaacttgtcccagagctgcaccatcagtaataactagtggcacatttttgtcttctaggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 628972 - DNA, 1744 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctgctgaagatgaagatggctgggctgaacgccatccagacattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 628973 - DNA, 1601 bp, Homo sapiens
  misc_feature (296)..(296): n is a, c, g, or t
caatatgttggctgtgatggacctgcccgcatgctacatgacatcattgaacttgtgcagcaatttgggagaccatatatttcccaaggcatcatcacaggtccagatgaacacacgaccatcccaggagcagctggcaatggtgctggtgggcaggctgatggagggggcccaggccacatctcaaacccagtcactgtgcttccagcttctgctctccttccactggccatccttgaagaggttgtcacagccacctgatggaaacttcttgatgtaattgggtttctgcctgnacagctggtctatgaggcttccagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 628974 - DNA, 293 bp, Homo sapiens
gtaataacggggagcagcgatgggagcagaaaatatgtataccaccaggagaaagaatctgtcaatctgaaaggcaaagtctcaaacaaataggtacccgtaggtctaagacagtaattgaggcactaaaataagaagcatggttataataaattagagaggaaagatagatgagacatacaaataaggacttaaacaaggagtatggatttcagctaaatcctgaccatctgtttctcatatcccaactctttccatttgtgactcccattctgaatgcgtaattggggtta

SEQ ID NO: 628975 - DNA, 1880 bp, Homo sapiens
  misc_feature (296)..(296): n is a, c, g, or t
  misc_feature (448)..(448): n is a, c, g, or t
  misc_feature (451)..(451): n is a, c, g, or t
  misc_feature (465)..(465): n is a, c, g, or t
  misc_feature (468)..(468): n is a, c, g, or t
  misc_feature (470)..(470): n is a, c, g, or t
caatatgttggctgtgatggacctgcccgcatgctacatgacatcattgaacttgtgcagcaatttgggagaccatatatttcccaaggcatcatcacaggtccagatgaacacacgaccatcccaggagcagctggcaatggtgctggtgggcaggctgatggagggggcccaggccacatctcaaacccagtcactgtgcttccagcttctgctctccttccactggccatccttgaagaggttgtcacagccacctgatggaaacttcttgatgtaattgggtttctgcctgnacagctggtctatgaggcttccagggattccatcaacgtaagagttccgctgatgttttggaaatgggtcactgtaggaattaatcaagtggtagtgaggacttgataactgtggagtggattctgggattctcaaagatgtgacttcctgnccntaagttggagctanatncnattccatgaatgaaacagcactgttcatacctcctggtctctgcaccctctgcctttattcacctggaaatgaagacacacctcagttaccttatctgcagagtcttctttgacccacttgtcagccaatttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 628976 - DNA, 499 bp, Homo sapiens
attgacttgtgcgtgtacggtggtaccccactgtctcccacaccacaagagatcagcttcgggcaaacagggggggcgtgccttgatggtgctgtcaggcgaggatgccttaggccaggcacgtcccagcgatgttctgctggctgaggtacaaggtgggaggagaatatgcctcattcgttactcaatcaatttcttgcgcctgcaagaagcgtcgcagggggaagacctgccaggtagctagtccaatgagacagaacatcgaacaagatgctgaagtactaggacccgagtgctcgttgactcgtcggtatcacgcatctcctcttctctcttcttcatgtaggcaaaatcattaacaatagattctgaacggtcttctaggcgtcgcagctctacctctaatggcttgagcttctcaactcttgcaatctcttcgctactttttcgcctccacctccatgctccatgtctaggatacagcagggagaggggatcc

SEQ ID NO: 628977 - DNA, 119 bp, Homo sapiens
ggtcgacgagggggtgatctaaaacactgcttgtcagcgctccgagcttctattgacttgggttaatcgtgtgaccgcggtgggctgagcacgaaagttgagccgaaccactggtggtt

SEQ ID NO: 628978 - DNA, 164 bp, Homo sapiens
cgagattgtgccagcgtgttgctaacacatccaacacagacaatgggtccacgtcctgcagctgcagccggtggagctacgcctgctgtccgcaccgttcggacagtatcaatattgctgcagagagttcagcaatgcctcagtgaacatctttaatgcaccag

SEQ ID NO: 628979 - DNA, 194 bp, Homo sapiens
tccaccgcctctacatcttcttcactgccctcttcactgactctggccttcttcttcttcactataaggctctaggtaggtcaggagatcaagaccatcttggctaacacggtgaaaccccgtctctactaaaaatacaaaaaaattagctgggcgtggtggcaggcgcctgtagtcccagctactcgggaggc

SEQ ID NO: 628980 - DNA, 2712 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaatgatgatgtcactgtttttaatgtgcaggtattgaattatatggtctgacttaaatcataactagacttgagtgggctgaataaaccacttcactaacttgaagttcaaaggatgaaataaagaataaaaattgggccttgttggctctcacggtggaactttgcggccgttcctttagtgagggtaattatgatcctcgtacggctcgtgggctgggg

SEQ ID NO: 628981 - DNA, 1019 bp, Homo sapiens
  misc_feature (937)..(937): n is a, c, g, or t
  misc_feature (941)..(941): n is a, c, g, or t
  misc_feature (943)..(943): n is a, c, g, or t
  misc_feature (953)..(953): n is a, c, g, or t
aaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactgaattagagagtactgaaccattattcccaagggaaatacagggttgggttcctatgaacctctgggcacagtttcatcaacccatcagtacataaacttgttacatgtgtttctgtttgaagacaccttagtatatatggttgacccattaacactgaacttagcccacgacacttattcctgaatgaagcttacctcagtttctccaggcggcacatcacagtcttcttgcacttaggaacacttggcactgtgcgtgggggtcactttaagcagcaaaatccacaaaaatgcaaaagacatggcactaaatagactgaaaaggatacttgtttataagaactgaaacaagaaggccttgttccacctcagctgggaacatggagagcaggcaattcaaattttttcacatgctgcatgtccgcaaatggctgaaaagccagcagtactgatactggagtngaantnaatttagcangaggtaattccccttcgggtctgcaaaatggattgccttcttgtgctgttttttttttgtcccccc

SEQ ID NO: 628982 - DNA, 541 bp, Homo sapiens
ttgatatcctatctcagatgacactccctagctatctctcccgaacgtccgcatcgcacctccgctccatactcgttgcacaaagaagatctctagcttgttcagcagctcctcctcactcagtctgaggctgacaggaaatccagtgacctacaccctccggtcactcaactggctggacacctggattgtggtgatccatgggactagctccaatggctggagctgcatccggagccggcactcctccatgttgatcgtgtgctccttatgttgcagcacctgttcagccactttggggtcatcaaaggtgatcagagcagagcccgcgtagcagagggcagtggatccgcaaattggaaactatagacttatgcagctatccgggtcctgctgggtgtgtcctccgaataccagggggatcttgggcactgaaaatggtacctggcagtaggggaggggagtcggagtgttcctcactcccatctatgaggaaggcatctccgattccattccattgatgctgagtgccggagataaa

SEQ ID NO: 628983 - DNA, 2648 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaaaaaaaagagaaaaaataaaaagaaaaaaaagggggggggggctaaaagaattccccgcggggggggccaattttgggggtaaccgcgtttttttttgaaaagggtggccaaaaggggggacggattaaaaagcagggggggggcggtttttaaca

SEQ ID NO: 628984 - DNA, 476 bp, Homo sapiens
aaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactga

SEQ ID NO: 628985 - DNA, 165 bp, Homo sapiens
atcatctcaatgcgtctcagactacacttgaagcagctccgaagtagagcgtcagcgctgggtgacagccttagaactgccaaggccaaggctgtgaagatgctggccgaatcagacactaacagcacatctggagacccggtggagaagaaggacgaaacacct

SEQ ID NO: 628986 - DNA, 2869 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaaaaaaaaacaagaaaaaacaaaaaacaaaaaaacaaaagaacaccacgacccgagcgacaacaccagaaggaggccccataccacaacaagcacaccgagccgagccagagaagccagcgcgcacggcggaacccaacagaaaaacgaaaaaaagcaagccaacccaaaaaacaccgcacaacagcacgcaccacaagaccacgccggcacgcgcggcacaaaacacaaccgcgcggaacacccacgcacccactccaggaagcgagtcaacacacccagtagagtcaaacctcacacgggaccacccaaacagcgcacaggcacaccgccacacgctgcagaccccccccgggtgagcgcgagccgcgccaaaacc

SEQ ID NO: 628987 - DNA, 2633 bp, Homo sapiens
  misc_feature (2633)..(2633): n is a, c, g, or t
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaagaacgaacgatgtaatggactcggtggcctcaccgggggagctctagggccggtttccttttagtgggggttattgcttgatccttttttactggcttcctttcactccgcgattcagtatgaggcgaacggattcagcn

SEQ ID NO: 628988 - DNA, 155 bp, Homo sapiens
  misc_feature (23)..(23): n is a, c, g, or t
  misc_feature (54)..(54): n is a, c, g, or t
tttgctattacattttattttanttttacttctcaaatgttaaggaaacctatnttaaatataaagatataaatataggggaattacataatgataaaagggtcaattcaccaagaagataaacactgaaatataatatgcaactaacaaagatc

SEQ ID NO: 628989 - DNA, 154 bp, Homo sapiens
gccaggatgaagcggtcgttttaagttacgtgaatggtgatcgttgccctccagaaaccgatgaacggctgtccccgtgtgtcttccctgttgtgtggtctgtggttgtgttgttgtgttttgtgttgtcttttgtgtgttggttttttgcttt

SEQ ID NO: 628990 - DNA, 405 bp, Homo sapiens
tgggctggataaagaaaaagtggtacgtatacactatagaatactatacagccataaaaagaacaaaatcatgtcctctgtagcaacatgaatggagctgaaggtcaatatcctaagcgaaataatgcaggagcagaaaaccaaatattgcatgttctcacttatgagaaggtgctaaacatagagtacacatagacatgaagaagggaacaatatacacaagggcctatctgaggatggagagtaagaggagggtgaggattgaaaactacctattgtgtactatgctcattacctgggcaatgaaataatctgtacaccacatccccacaaaacacagtttacccatgtagcaaactggcatgtctaccactaaatctaaaataaaagttgataaaaaataaa

SEQ ID NO: 628991 - DNA, 382 bp, Homo sapiens
tatgtcactgactccgtgggggagacgagagagattgtgaagccactctactgggggctcacttttttcctctttacaaaaaagatggaaataaagcggttttgcacatgttgcaataatgctgtgcatggggagtgtttgggggggaaggagagagaaggaaggagtgggtattcccgtctaacaagaaagcagggtatcaactcctattgttctgcactggatgcattcagctgaggatgtgctgatagtgcaggttgggcctcaacaggatgacagcagagtcctcgagcacctgggcctggttgctccaaacgttgccaagacacattatcaggccctatttctagagggattactttgaattgaaccggatagcttg

SEQ ID NO: 628992 - DNA, 1387 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggccccacacggtgcgttggcccaacacggtgcgttcgccaacacgttgcggcccaa

SEQ ID NO: 628993 - DNA, 1505 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaaggtgggtgcttggtatgagctgtggtgggctgatcttggacgagcctcttttgaactcactgtggtctgtggaccactttctggctggagcctcctgttaaaggatggtgagggaggatcagtagactgggttggctctgtcccctggtagagtgggcttggccgtgttttgaggggggcttagcctgttttacggcttattccggcgaggcctcgacctttttggggaaccgggaggcctttttcgcgcatccgcggggggggggaccctccaggggggccgcgaaactttta

SEQ ID NO: 628994 - DNA, 847 bp, Homo sapiens
gagcctatgagttcagacttggggggctccatctgtccctccctgaggtccctcatcttgtccctgctctgattctgtcagcagcatcctgaactactccttgtgctggggacgccatgcctcgcaaggctgcccaccaatagtcctagcatgtcctggggaagactcccgcaagaacttcgtcgcgggataaggccgctgagaaacgcttcagtgagtgcatagcctcgcgaggtcactccatcagtcgcactcatgcatctgcttgctcttccgctgtgacccgactagctcattcagtgtatcacggaagagggcaggcccctgtgccccctctccccttcccatggggcgtgacgaactaactactccgaccatggtggccgctatacctattgctatctctgtgaaacactaacgagcattgggactagacatggaacgtggccttgagggggcggctgaccgagagggccccgttgctgcctgggagctctagcgcacaagacggccgccggggtcacggacaggaacctcagcccagggtgctgggctttctccttcgcaggagtcccccaaaatccacacaaggactcgagcagccttccactcagccagaggagggtcgggctcccccgcctgctctcggtggtggcgtctggcccttcctgccgtttccaaggcctccggaagcaccaagccagttctcagttacctcctctggccggaaggcctcacgttgtcctccagagctgctctgggcccaggctggctccgtgaccagctgatggcacgtgctgggcagcatgggctccaaagaagcatcccaagtgtctccagccaccca

SEQ ID NO: 628995 - DNA, 532 bp, Homo sapiens
tgctgcaggacagacatgggtgttctatggctgtcaaggggttcaagcatttcaggtgatctgcaccgatcaaaaggtgttggggacatgctctgacaactgaagcacctcattctggaactgttgagtgctactggaggtgtccgtgaaccacaatgatttcttgttgctggaggagtagcagatcgtgaacgatcagaactactttcagatgcagaacgcctgccgatggctggaggagatcttgttaaggaccgtttacccccagctgttcgtggagtacgggatctggagcggcggcggatagcaagtggtgagcgacttccggaacgtttgcgtggtaacagtggcgttcgagatctaaagcggcgccgaatagctggaggtgtccgggacctaaagcggcggcgtgtcactggtgaggttcgagagcgggaccttcttcgagttactggagatgtgcgagatcgaaatctccttcgggtgaccggagatgttctggatcttgatcttctggaccggcgttcgcaaa

SEQ ID NO: 628996 - DNA, 223 bp, Homo sapiens
agggggttccctgcctgcagccccccattagcctttttccaaagggccggggggccggggaagggccaaggtcccccggctggttttcccgggagttgggggggggcccccccccagggggcggcttttgtccctggggtttgttttccctggttgtttgcgggttgggttttttttttggccaacccccatggttttcccataaaagatttccgatggccca

SEQ ID NO: 628997 - DNA, 312 bp, Homo sapiens
ctcccagccccccagaggcaaaggaggcagtaaaccctaccgtctctggtcccttcgtggtcgccaaaaatgctgcgggaaactgaggactggtgagaccgatacggagaacaggaggattgtttattttaggtgcaaaccggctcagtggactcgcatctaaaaagctgagcatgaaacaaagacagagcgaggtttttatgagcagacttacaaaagtaaaacagaggcagttaattttaggataggtgacataatttatagtatagcataacttgtggccttgcatagctggtggccttgtagctgtat

SEQ ID NO: 628998 - DNA, 379 bp, Homo sapiens
ggtgggctaacagcccagcagaggtctagttggggcattacaacaacggtgggggaggaggcacaggtggattctctaaggcatggagtggagggacaagatcagactaggtctctgggtcctgagagcatgagggggctgggtctgacacgttatttcaccgggggcagaaatcctccttaaagacaatacaaggctagcttccagcagctcctcgtcatttccggtggaaaaaatccgggggcaggggaaatagatctcaaaacggcatcgggggccggagtgcgggggcttaccccgtgtaatcctagcacttggggaggctgaggcgggcaggtggctggagtctaggagttggagacaagctgggccagcaggg

SEQ ID NO: 628999 - DNA, 244 bp, Homo sapiens
  misc_feature (30)..(30): n is a, c, g, or t
  misc_feature (32)..(32): n is a, c, g, or t
gggggcaaaaaagggggggggaatttgggncnggggatttaaaaaagggttttttttcccccccttttttttaaaaagaaccccggggccccctttgggtttgggggcccccccccggggggggggggggggggcccccccccccgggggcccctttgggggttggggggggggggggggttccccccagggcctttggtttttttttttggttttttaacccccaatttttttttttggggga

SEQ ID NO: 629000 - DNA, 254 bp, Homo sapiens
tggggtatgtatagcttaggttaaacttgcgttattgctacaggttaagcactgcgttgtcccgtgagggatgtgagcataggctaatccgtttcgatgcagcattgctgcgatgcttgattgcatgtccctttagatcgtggtgatataaaaggtgaactcactggaacggggatgctgtgcctgtgtaatcttactacagagctaatataaaggctagggaccaagacctatggggggacactcgaggctag

SEQ ID NO: 629001 - DNA, 261 bp, Homo sapiens
agtacagggctgtgcagagtctggcccaggttgtagggacagttgccataagaagccagcagccaggtatggtggctcacacctgtaatcccagcactttgggaggccgagaaaggtggatggctagagcccaggagttccagacccatctggacaacatagcaaaaccctgtctctacggaaaaaaaaaaattagccaagtctggtggtgcacgcccgcagtcccagctacttaggaggctgaggcaggagaatggcgtg

SEQ ID NO: 629002 - DNA, 473 bp, Homo sapiens
  misc_feature (225)..(225): n is a, c, g, or t
acacctgccccaagcgtccacagaccgagcgccgccgcccggcacaaggaccaaccatccggcaacttcttcgcgcgtcaagtgcattgggggccgaggtcctggccgaatctgtaaacactcgactgacacttgttcattcctccgggcggaaggcctgtcccaaggtcggggccggcaggaggcgccctggaggccgcacctcattgccggggcaccgggaancggggagcctcaccatgggttccaggttcactcgcaggaccctggcgccctgccgcccgtgccgccagcggcgctcgccccacacgtcgctgccgacgcggatggtggggaaggtggtcagcgtcggggtggccgccctccagatctcctccaaggctgcgcccgaagcatggccgggggcacggcttgccgccactctctcgggggcgcgcggtggggtggcgcggcattcctcctcggcagcggcc

SEQ ID NO: 629003 - DNA, 414 bp, Homo sapiens
tgtggttctggctaactagtctgcttggtgttggtcaggttgagccgcagatagtccaacgtgctccaggatctgctccagaggtcagctgggccagcttgctgctatagctcctcaggctcggtctctggcgaggcaggcggttgttcttgatgagacagggacttgatgtgctcggccagcaggtcgtcatgtttcatgcaccagtgccggagtatgctggtggtgaactggtcgtcagtgatagacgggccggctcagtaccatcttcaccatctcctcgctgggcttttctctacggagatgaagcagtaggcaggacagggcctctgggtgctcctatgtatttgaggtgctgcaggatggggataatggtctccaggggaatatggtgggccagaaccacaaatatcg

SEQ ID NO: 629004 - DNA, 819 bp, Homo sapiens
gactaaaagtttcctctacaagttctcattacaccacacgctgctagcttaaagattaactgcatcttttacaaaccaggagtgggcttggcttgtacaagcctgtcattgaataaattggactgggccttagaaattgcccagtagtcatgaatttcacagaaagtctgagtcctgaagggttaagagatttattgaggacttccaggatatccacacagtcgggggaagtcagatcttttgactcccaagtctaaacttctttcctctgtgcagattccagggaaaattccagggcctcactgtatctgattcactgaggtgtgtcctgttggtactggctgggacagggtggagatcgtgtgaaaagaggtggtattgctttcagtttgcaagggtatctgacttgcaagagtgactgtaggaagccatttttggttattgctttgggaggcactgccctgagcagaaggcaggatcctaggactgggccaggaaggtaaaggtgtgatgagaatttcatttatttgtcctggggtaaagccagcctcgtatataatggtatttggatttctaacattttgcttactcaatacagttgtatttagttagactctgcagtgccttcctcagcattacattagactaaggatcatcttttctaatatccctgtgtccagtacttttttgataactgctcagacatagttctcacattgacttagggagaggttcaagatacgtgttcttagaaatcttagatcctagttacctctttgaacatttgaggctctcacatctgttaatctacgaaacctg

SEQ ID NO: 629005 - DNA, 172 bp, Homo sapiens
cctggtggtacctcctccatgctatacgtgctcttggtgttaaaaaaaaaaaaagaaaaagaaaagctttccttggtggctggcaattgtggcacacgcccccagttctccacttggcagtgagggtattcccagttaaacgccctacagagggccaggtggttctggcaga

SEQ ID NO: 629006 - DNA, 605 bp, Homo sapiens
ttccacgaggaggtggagcaggcgtgaagttctccctggaattaccaggtcatcactggaggccactacgatgttgaatgctatgtagaggacccccagggaacatcatctatagagaaacgaagtaagtagtagtgaatgccttcacgtaccgggctgaagtcaagggcgtttatcagtatatggctatcagataatgagatttgccaccttctctcacaagaccgtctactttgactttcaatgtgggcgatgagcctcccattctccctagaacatggggaacagggtcacagcatctcacccagatggagtccgcctgcgtgacgcatccattgtaggctctggagacaacggtcgatttgtacttcccagtagcgcacttatccggacttgcgggaggtcccgatggacccgtgagctccgaagcggataggaagccttagataagccgagtctcttactgggtctcgttgagcagagacgatagccctgttgcgtggtcgagcttcgagttcaggtgctactagtatgaaaagcttccttacacagaaaaaccgacccatcgagccagggcagtccacttcctagaccccggcatcctg

SEQ ID NO: 629007 - DNA, 1359 bp, Homo sapiens
gcattggccttggccatgtacacgatctcagaagctgtcacatgaggagtgcttctatctgggagagtggtgtgcattcgtccgctagtcccgggccacaatctccgcaagcttgactgtatgtctccgaggatttggaccagcagagcctgccaagtgaaccagaggagaccctaatgccgggacctagtgggagggagaggagggagagctggcccctcccgaatgatcctactaggccgtcctcaagctctgtcaagggcaaaggccctggaatctcgaaggagagagagagagaagtagtgtgggatactggaggaacatccgttgtagcggttctcatccctccatctcagtgagtgaacacgcaacttcaatcggggcagggtccccccaagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttcaccaggagtcaccggcatgccctgctgcctctgaggaagacaggcctcacactgaggattgagtcgctgcatcacggggagctggagcagctgaatgcagagctgggcttggagccagagacaacgccaaaaccccctgatgctccacccctggggcccgaccatccatgctctggtacagtacagaccaagaagctcaggccgtggcagagccatgagccagccgttgaggaaggagctgcacgcacagtaggggcttccttggctaggagtgtagctggattcctcctttgctaacactctggggtggggcaactgtgtggggaagctggctgtcggatggtagctattccacccctctggccctgactgccctggactgctgtcctgggcatggtgcagtaccatgtgccataggacaggcctctcaaatgcgtaaactaatttaccatgacgcgttagaggaatgtgaacaagccctaggggaagtcttcaccaccagactggcgcttggctccccggacacatcatcctatactcgatcacactatgcacaacgcctgatcgggctggcccccaccaaacctcatatcataagaaccgcagcgccccgccgcaggacacaaggagcgcaggccagcacaacacaggcccggccgggccctcacggcgacgcagcgcgccgcgagaaccacacccactgcaccccccacgggcaggcaccagcgcccgcggacaaagagggcgggcccacaccgcgcggcccctcgcaccatcaaacccccgcggacaaagccgggcctgtgca

SEQ ID NO: 629008 - DNA, 553 bp, Homo sapiens
tctaagtccttcacacccatttatttattcagtcctcacaacacaggctttcaataaatgatggatgaatgctgaatgaaaatatagtatcctttattttttacaaatacctcagagaaaaatagaaaatatgtctaggaatatacttactccaccttgtagagattaaaaacgtgaacataaagactcaaaaccctgacaatgatatggggaaagcagtgttcatttgggtaaattctgagtgatgcatcttaatatgaagttagttttagtcactaagtgtgatatttattttactttaagtagatttattcaaggtaagatgcctgggaaaattgactagattccagtgatcatcaccccaaaccttgtgcattctgttataactgttacttaaagtggttccaagattagtttgggaaattatcagttaaatacatttcagtcaatagacagtatttttttgtttttaactattggatttctcagcagtcctaagatgatgatgatatgtatcttggaccatgaaactctcttttacattaaaaaaaaa

SEQ ID NO: 629009 - DNA, 133 bp, Homo sapiens
atctgcaacgaacaactcacagcaactccatgctagtcagaggctacttcattgttgtcttataagatgtagaagattaacagatcttggcaataaataatgaagaggccaccctgtttccagtgtagaaatt

SEQ ID NO: 629010 - DNA, 583 bp, Homo sapiens
  misc_feature (1)..(1): n is a, c, g, or t
  misc_feature (12)..(12): n is a, c, g, or t
  misc_feature (22)..(22): n is a, c, g, or t
  misc_feature (45)..(45): n is a, c, g, or t
  misc_feature (47)..(47): n is a, c, g, or t
ntcggggggatntcaatatggnttccaccaaaggtttttcttcananagggaaagggattcagagcagagagcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctaga

SEQ ID NO: 629011 - DNA, 138 bp, Homo sapiens
gtccagaacttctaccaatcactggaacgtcattgctgcatggatttggggacctgcagagaataattctggcttgggctggacaatcctgaacaaaatcacagcccatgggtcagtactgagctccggcgtggacct

SEQ ID NO: 629012 - DNA, 868 bp, Homo sapiens
cggcacgaggattaaagccatagattaactacttacaactaaaaaacactgaggttttccaaccagcagtatcacagatcacaggtattcttgtacagattaagtgactctagtattcttttttattaggcaaaagagatttcactagcagacctccaggagaattatattgaggcattaaataaattagtgtctgaaaatcaacaactacagaaagatttgatgaataccaaatctcagctggagatttctactagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagccctgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctaga

SEQ ID NO: 629013 - DNA, 147 bp, Homo sapiens
gtaactttgtgatgtgtctgctttgttctcttttagaatgtgggcaaaatattggagaacagtaccccgttatgcaatggtaaaggaagtaatgcagataaggttcaagatagtgagacatccctgtcggtctccaagaaagctgat

SEQ ID NO: 629014 - DNA, 533 bp, Homo sapiens
tgctagaagtcgacgatgcccacttctgctgagctctggttttcacttagacaattcatccttcacggctctctcttcctctttagacatacgcttttcatgtatatagaagtattttcgtgttcgggcctgcaggttgaaccatgtgtaggcaaaggctcggacgtggggccgacagtgcttcgatgacaggactgaaacttcactcctgggtgacgaccgacgcggagacatacataacctgccgggcgctggggtatgcgtgtgcgtctgggtgtgcggtttggacggtgtgcgtgacgtgtgggtgacacgaggagacacacgagggacgacgacggacacacgagagacgacgacacacgagacgacacggggggagaaaaaaaaatcaagcctgcttcttgcgttcacatttcccagtccggctcaagtgcagccagccagccatgcgcttatcgccgtccatgagctgaactttaaccccgcctagagtttacctacactccaatatacctgcatactgtaccaag

SEQ ID NO: 629015 - DNA, 342 bp, Homo sapiens
  misc_feature (291)..(291): n is a, c, g, or t
gttccgagttttgcattcctgtctgactgacactcctattcttctcaaggacagtgtatttttgtagtataatcactggttaatactaagctttttccatggagtaatgtttagctgctataaccccattttggctgctgcttgttaaatactgtgtctttgggagttaaaaaacacagttgacttctcttttgctcttacaagaattttcaaaaatattgagtcttagagacttattcatctctccccagggatacatacttgattggtcttcaatagactagacagttnagtcacaggtggctggaacatctatttttctacaaaactggatgcatgaac

SEQ ID NO: 629016 - DNA, 451 bp, Homo sapiens
  misc_feature (10)..(11): n is a, c, g, or t
attttttctnnccctattgcaaaccagaataaattcccaacgataggggtcaaaagttagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctaga

SEQ ID NO: 629017 - DNA, 424 bp, Homo sapiens
gacaaaaatacaaaaaaattagcagggcgtggtggcaggttcctgtagtcccagctacttgggaggctgcggcgagaagagtggagtgaacccaggaggcggacttgcagtgagctgagatcgcaccactgcactccagtctgggcaacaagagtgaaactccgtctcaaaaaaaaaaaataagtaaaaaggaagacttcactgagatgtcatttgagtaaagacttgagctgggtgctgtggctcaggtctgtgatcccagcactttgggaggctgagatgggaggattgcttgaacccaggagttggagaccagcctggacaaaaaagtgagaccatcatctctacaaagaataaaaaaattagctggatgtagtgatgtgctgatgtgtgcttgtggtcccagctacacaggaggctgagg

SEQ ID NO: 629018 - DNA, 359 bp, Homo sapiens
  misc_feature (25)..(25): n is a, c, g, or t
gcgactactactactactaaattcncggccgctcgacgttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagaaaattttctcatacgaatatttattatcataaagtgatacttaccttgctgacttaaatgtgaatagctatgtactaattgaaataaggattttatgatacatgttgaaaataaagtaactgcaggaactttcttta

SEQ ID NO: 629019 - DNA, 148 bp, Homo sapiens
tctagcctcgccggtgtggtgggtcccataatcccagctactcaggaggctgaggcaggggaattgcttaaactcaggaggcagaggttgcagtgagccaagatcatgccattgcactggcgaggctaggacactggcgaggctagga

SEQ ID NO: 629020 - DNA, 363 bp, Homo sapiens
ccaggactgcccagtgacaaatgggagggtggggtttcccatgggttcagaggcaagaagttacacatcgcattttaaaatgtatattcccaggctgggcatggtggcttacacctatctatattcccagtactctggggggacgagacaggaggatcatttgaactcagagttcgggaccagcctgggcaacatagtgagaccctgtctctaccaaaatttaaaaattagccagcatagtagcacacatgtgtagtcccaactacttagtgggaggctgaggcaggaggatcggttgagcccaggaagtcgaggctgcagtgacctatgatttgccactgcactccagcctcggtggcagtg

SEQ ID NO: 629021 - DNA, 939 bp, Homo sapiens
gggaagcatactcggtgagccactggggagctttgctacaaaggccgatgtacaggccttcaggcgggccttccaacgagtgtctccgctgcaccgtgtgtctgcactggttctggccggtcaagtgtcctggtcctgtccacccacctggcaacccgatgcgcaacgcgctcgcgggtgctctgcccatctgctccatgctggccctggtcgacctctttgctggccctgactctgcccttcgcggcagccggggctcttcatgggctgcagtctgggaacgtgccacctgccgcatcatctctggcctctattcggccatccttccacgccggtttcctcttcctggcctgtatcagtgccgaccgctacgtggccatcgcgctgagctgcgtcccagccgggccgcgggcctccacctcccgtgccgcgccctacttggttctccgtcatcgtgtgggtgttgtcactgttcctggcgctgcctgcgctgctcttccagtcaggatgggctagctgggaaggccaactggactgctgtcgcctcatcttccctcgagggtctcacgcagagggtgacgggggcgagcgccgtggcgcaggtggccctgggtttcgcgctgccgctgggcgtcgtggtcagcctgctacgcgcgttcttgggcgcacgctgtggccgcatgtggcccgagcgccggcgtgcgctgcccgtcgtggtggctctggtggcggcttcgtggtgctgccactggcctatggctcgcctgttgctggatccggcgatcctactggtgcgcgccagcggatggcctgccgcacgcaggattctcctgctggtgccccggctttgccctcccctgggctcaaccgtttagcttctggctggttcgcggcggggctccggggagggccccgccccccgggccccgcccctctcgc

SEQ ID NO: 629022 - DNA, 293 bp, Homo sapiens
cggcggatcactttttattattgctagttagaaaatgtcatgaacagtgtatcttagaaatataatattctacttatttacacatgtcaaaatttgtgtctcttccagtgttccttgcctgtatctccccttggttcaatagctaccagatttttggaagaggaggaactgaggtctcatcacattctagagcgcttggatgcccatattgaagaacttctctctcttacatacacataacacctggtaaactgtgggtgatgattttctgtttgcaaaacactcgagtccag

SEQ ID NO: 629023 - DNA, 125 bp, Homo sapiens
accggctctttgggcggcaggacactggagggtggggacgcgtccacattgtgacgcccagtcgacgttacgtgtggccgtaggcgtgcctggagctctgggccagctgccagccagagcggggt

SEQ ID NO: 629024 - DNA, 204 bp, Homo sapiens
tgttgtgaccaaaagtctcccgagatagtgtcaatatggcgcccaatgcaatgaggtatttgggaatgggagccatgtctaaacacaaaatacacttatgcttcataaacacttagccacatacacataacctgaaggtaatcttatacaatattttaaataatttcatgcatcaaacaaagttctgaatgtgtatttactgtg

SEQ ID NO: 629025 - DNA, 1005 bp, Homo sapiens
cggcacgaggattaaagccatagattaactacttacaactaaaaaacactgaggttttccaaccagcagtatcacagatcacaggtattcttgtacagattaagtgactctagtattcttttttattaggcaaaagagatttcactagcagacctccaggagaattatattgaggcattaaataaattagtgtctgaaaatcaacaactacagaaagatttgatgaataccaaatctcagctggagatttctactagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctaga

SEQ ID NO: 629026 - DNA, 1367 bp, Homo sapiens
  misc_feature (296)..(296): n is a, c, g, or t
  misc_feature (448)..(448): n is a, c, g, or t
  misc_feature (451)..(451): n is a, c, g, or t
  misc_feature (465)..(465): n is a, c, g, or t
  misc_feature (468)..(468): n is a, c, g, or t
  misc_feature (470)..(470): n is a, c, g, or t
caatatgttggctgtgatggacctgcccgcatgctacatgacatcattgaacttgtgcagcaatttgggagaccatatatttcccaaggcatcatcacaggtccagatgaacacacgaccatcccaggagcagctggcaatggtgctggtgggcaggctgatggagggggcccaggccacatctcaaacccagtcactgtgcttccagcttctgctctccttccactggccatccttgaagaggttgtcacagccacctgatggaaacttcttgatgtaattgggtttctgcctgnacagctggtctatgaggcttccagggattccatcaacgtaagagttccgctgatgttttggaaatgggtcactgtaggaattaatcaagtggtagtgaggacttgataactgtggagtggattctgggattctcaaagatgtgacttcctgnccntaagttggagctanatncnattccatgaatgaaacagcactgttcatacctcctggtctctgcaccctctgcctttattcacctggaaatgaagacacacctcagttaccttatctgcagagtcttctttgacccacttgtcagccaatttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtgggcaccattgattgaagtctgggccaaactcatccaataacgctcccggcttttattgggactctcctccccggggatccagattgcccagaaactttatcagtctgaaggccaggcaggtgataaggttactggcgtatgcaccgggctcataactgttggccacacctgatacgccaacaaacgtgagagtgcctgataaaatgttatgggatattagacaaataaacccaatgtag

SEQ ID NO: 629027 - DNA, 821 bp, Homo sapiens
  misc_feature (88)..(88): n is a, c, g, or t
  misc_feature (90)..(90): n is a, c, g, or t
  misc_feature (120)..(120): n is a, c, g, or t
aagaaatctctttctgatctgagtaggttgctcattttgtaaattgtagccttattagttaggctattaagcaaatttcctacatttntnttggaaagagaaaagttgctacaatttttnatttgttttgttttctaatctaccatccaggccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctaga

SEQ ID NO: 629028 - DNA, 628 bp, Homo sapiens
tagagagctgctaaatgtgttattatcagcgatcagaaagtcttctggtctaccacacatgtccctccctactatctcttcagtatgtgtggctgaagttagcctctgtgtgagaaaacaatacaactccccttctccacacacgttactttccagcccagattaataagtatcccctaccgctaatccgcaactactatgatctactaccttatagtagagaggaaccacttctttttattattgaaatctgctggtttacttgatgtaattctcactgttctgtgtgactaggagctgaccacagggtgtcatcaattcagattcctaaataatccctttctctgccacaacccagtacctccagctggtgagccctgggccagattgttatgatcttcaggtattataaattttagttacatcaattactgtacaattaatccaaatgctaattatatgtggtgcaagaagtgtcttatgtaaattcagggtatggataagctaattaagatatccatctttggtggctctaagtgtataatttgtttttaaataaagtgtacaaatataacataacatgctataggtgtatcatgaattggaatatatgtcgagaattgggata

SEQ ID NO: 629029 - DNA, 102 bp, Homo sapiens
  misc_feature (2)..(2): n is a, c, g, or t
  misc_feature (75)..(75): n is a, c, g, or t
  misc_feature (93)..(93): n is a, c, g, or t
gnggggggggttttgtctttgctttgctttgttctttttttaatttttttgttcctctggttgaaatttctgggntgttactggggggggggngggggggtg

SEQ ID NO: 629030 - DNA, 566 bp, Homo sapiens
  misc_feature (25)..(25): n is a, c, g, or t
gcgactactactactactaaattcncggccgctcgactgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctaga

SEQ ID NO: 629031 - DNA, 208 bp, Homo sapiens
  misc_feature (178)..(178): n is a, c, g, or t
ggatgagtctctgctgcaggcggcagctgcgtgtggtgcatctcagctgctctgaagagtcggatctgccctgagtagtgactcttacgtgtccggtagctggctgatggtgctgacagcgtgattctgctccgggcaccagtgtttttcatttggctcccggctgtgctttgttttnttctgctgacatctcttgttgaggtccctc

SEQ ID NO: 629032 - DNA, 1401 bp, Homo sapiens
  misc_feature (401)..(401): n is a, c, g, or t
ggtacacgccgtcccagccatcggctagcgcggccctgagagcgagacagctaggtggtgctgtgacccgtggagtctaattccctcttccggctcccaccaatttgtcttgcgccttggccaccacctcccacgtccggatgctcgggtgctgctagagtatgccgaggtccccgtaggctcgatccgctacctggcgtctcagttgctgggcgcttatacacggtgattgtataagtgcacgacaggagtccgtgcactcctctgacctcgatctttcggctaggcttggacgtgcgtcagcggcctatcgtcgtcgccgttgctccaccgggtctagcccgtgggcgatctgagggcgataacatagctaggttgcatcctacttgcaaaggtcctangagctcgcttagggccgatttccccccaccggccattctcggcgggtggaccggttggaatgctctcgcattgggctaacacccatcccccaaattccccttgcgccatggccggggacgcagctttcgagaacgcggctgttgtaccccccaggggggagttccaaccttccattgcgggtggacagttcccccctttggtttcctctcccgcgacggaaccgaggtttggtctcggggaccgctcacgtgtggtttcgattaggctgattcgagcgcctatgggagcttcctttttgtcgcaatggcccagccccctctcggcccctgggtccccctcgctatatgttatcgccggcatctttccatggtctacattttaagggtggttttaaccgcaacgaagatacacacccaaggttatacgccacggagtggattccacatataaacagccccccagaaggccaacggggtggagcctcaacaccaaaagccccggggacggaaaccttaaggtgttgcgccacagtagtgttaggcgctattggttcaaatccccccatagggaaggccgtccactgtgggcaagacggtttacgaccagagtaaggctaaaccttttggagtggccccccatctcgagagagggcacccacaggaaaagaggtaacgatttgtgaccacaatatacgcccctttgagtttgtaattgcccaccggcactatctcccacaaccagagtggtcgtcccccccaggaaaacctcacgctgccgatgaggggggtggtcacgttgcgggatcagggcaacagcgaacgaagggcctctgttagtccccggataaagggactccgccgtgtttgtgcgcccgtaggagtcatgtgtaaaactaccaaatacgctggtttgacgacaacaaggctaggtgacacgaaaactacctggtacgcacccgatcacagggtgagtaccacaccaccgacggcttcaaaggag

SEQ ID NO: 629033 - DNA, 1142 bp, Homo sapiens
cggcacgaggattaaagccatagattaactacttacaactaaaaaacactgaggttttccaaccagcagtatcacagatcacaggtattcttgtacagattaagtgactctagtattcttttttattaggcaaaagagatttcactagcagacctccaggagaattatattgaggcattaaataaattagtgtctgaaaatcaacaactacagaaagatttgatgaataccaaatctcagctggagatttctactagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagaaaattttctcatacgaatatttattatcataaagtgatacttaccttgctgacttaaatgtgaatagctatgtactaattgaaataaggattttatgatacatgttgaaaataaagtaactgcaggaactttcttta

SEQ ID NO: 629034 - DNA, 720 bp, Homo sapiens
  misc_feature (1)..(1): n is a, c, g, or t
  misc_feature (12)..(12): n is a, c, g, or t
  misc_feature (22)..(22): n is a, c, g, or t
  misc_feature (45)..(45): n is a, c, g, or t
  misc_feature (47)..(47): n is a, c, g, or t
ntcggggggatntcaatatggnttccaccaaaggtttttcttcananagggaaagggattcagagcagagagcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagaaaattttctcatacgaatatttattatcataaagtgatacttaccttgctgacttaaatgtgaatagctatgtactaattgaaataaggattttatgatacatgttgaaaataaagtaactgcaggaactttcttta

SEQ ID NO: 629035 - DNA, 1186 bp, Homo sapiens
gagtgatgccttgggcatgcttttttattttattgcttttttaaaaaacagggagttgaagtccaccctatttaaaaagccccaccattgggagaattacaaggggttttggtgcctggaattggtatgtggttgggcaacgcccaatgccattcgtgctaactggattttgggtatcgagtggctattccaagaacatgaatggaggaatgttgggccgaattacagcgtggttgtgcatgggagtggtggtggtgggggggggtgcgctctcagaaagacgcggccagtaagaacaagcgagggaaagtgaagggtcccaggcacactacccgtgcccatggcagggggacctcttacgagctctcgtgggtgccagcagcgggatcccgtggaggggtgacctcagcgcagggcagactgtggaaacagtggcggaggtgctccaaagggcatccttaagtggggggcaagagcaaagaaaacccaaacaggataaaccttttcaaaagactttcataaggagtgaatatgggaagtgccccagccctcacagtgtgtttgcacatttgtgccagaattataagaagttttgggttttaaacatacaggtctgtgtcagggatttcacggtaatgggcaattatgggaaaggtgattgggtgatggcaataaatctataaggggtaactctggggcaaagcagagggtctcaagccatttgccccagaaccttggaacaataaggtgtctgacataaagtttttacgaaacttacacactttgtggaggaccgaaaatatttttggtggcattggactgggaggaggtgtgtaagagtccaagaaaacttgaatatactggaaggaaaccaggaagggggctttgaaagagagttaatcgtaaaaccaaagaaacaattcggggcacccggggggcatctaaaaaccagcggttcaattataaacacggggcgggtaattcgcacagaggaaaaagggcgctacaaggtgtgggagacctcgggtgcacacaaggggtgttagaacaaccaccggagaagggacccacaaagagagcacaaaagaagaggcacatgaacaacccaaaccaaacatgcccaaagaggagcacacaagacaaaggcggacaaacccacaccaagacagaaaaccggaagcaaacc

SEQ ID NO: 629036 - DNA, 263 bp, Homo sapiens
tgatgcggtgatacactaatacacttcgggctacagtacccatggcagactgtaatacttacagtgaacggtgtctacccacagataacaatggctgttgactcctacgtctcatgttagaccctgtaaaaaggtaaggtttatcgctgtcattttaccccagtacgcttatagactaactggagatatacattggtgataagtatgagcgtgaagtacacagatctaaaaatattagtcttagaacaaaaatgacactcatg

SEQ ID NO: 629037 - DNA, 453 bp, Homo sapiens
gtcgacgtttttaatttaattttatgagtactttttaattttatgggtattttgtctgcacgctttgttcaccaggagagagctatgcattacttagtagtggagtcacagatggttgtcagctgccatgtaggtgctgagaatctaaactgcgtctttagaaaggcagacgactaaactgctaagccagacctctaccctgggcagctgatgtgaaaacgtttctcacagttctggatactttgtagttccaggtcactggttatctgggaacctctacttcctgatttgtgggtgactgtctttttttgctcacactgtgggaagggtgcagagttcttgggatttctcttgtaagaccctttgctcttgtcttgatcacctcccagtaccccagctcctcccaccatcatatcagggaccaggagaggcagacagcacaaccatcagtcc

SEQ ID NO: 629038 - DNA, 1357 bp, Homo sapiens
gattctacagaaggtgaagcccggggacatggtacagagcctgttctctctgtgaacgggagaagaaactgttaggctaggatttcctgtggatccactgaaaggtgctccatagtagctggccgatcgacaactggattgtagcgtgcgatatgcccattatggctgtgtgttacgagaatccaagaatcttcagagatggcagacaagtgtttaccgagcccatatttggacttggactatcgaacgagtagcttctaaatgcaaatggtggttggagggtcaggatggagacaaagaccgaaaagtgggtatgctagtagcctcagagagtagcatcatcttgtggcagtgttcaggatgggggcagtggaagctgagaactaggagtgtgcacgcctggcgtgtgcctgtagattctctcttgctacatggagcccaaccacagtactaggtgggacacagacgatcataccaagggcacatgtgggtgcgtcgtagggaccgctggacgacatcacaaccactgagcaagtgttcgcaaagactgtcagtagcttataagtgatgttaatagaccataagagtgggagtcactggtccgatcttgggtccggaattgtcaggcccatgggacatcaagtagtagttgacactacgtgaatatgaacagacagggctggccccggttgacggacaatcggcacgcatagacaagacatctctacagtttgaaacagataggcaacgtggaacatcaatgaactcctagcgaggaagaaggatccgcaacagacaacctagggagccatcaaaggaagctaggcccaggtgcaacaagcgccgacaaagagaaacggatggccacggtcagactagccgaggggaaaccgcagacacacagaccaagatgtgagaacacagagacgaccacgagacagcacaagaaacggacagattaggcattggaaccacacaaccccacgagagagaacaagactgaggacgacaagaaggccacacacagagtgatgaacaagaagcggtgagacgagagaacacacgcaaagagaatcaccgaggaacagcaaacaaagcgagcgcacgaatcgaaaaacaagaacacaaggagaacgagaggcagggcggcgactacacatccctgctggatctgcagagacagttaacgctaggaacacgaacacagaagaaatgcagagacacgacgcacggagagccgacagacacgtagagcgagagaacaaaaagacacacccctagagcgaaggaaaaagcaggacagtaagcacaagaagtaagagagcacaccgacgcaacgagcaccaacgaagtgcaa

SEQ ID NO: 629039 - DNA, 895 bp, Homo sapiens
  misc_feature (218)..(218): n is a, c, g, or t
  misc_feature (233)..(233): n is a, c, g, or t
  misc_feature (254)..(254): n is a, c, g, or t
  misc_feature (257)..(257): n is a, c, g, or t
  misc_feature (260)..(260): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (284)..(285): n is a, c, g, or t
  misc_feature (293)..(293): n is a, c, g, or t
  misc_feature (295)..(295): n is a, c, g, or t
  misc_feature (316)..(316): n is a, c, g, or t
  misc_feature (322)..(322): n is a, c, g, or t
  misc_feature (340)..(340): n is a, c, g, or t
  misc_feature (381)..(381): n is a, c, g, or t
  misc_feature (386)..(386): n is a, c, g, or t
  misc_feature (392)..(392): n is a, c, g, or t
  misc_feature (394)..(394): n is a, c, g, or t
  misc_feature (405)..(405): n is a, c, g, or t
  misc_feature (407)..(407): n is a, c, g, or t
  misc_feature (414)..(414): n is a, c, g, or t
  misc_feature (416)..(416): n is a, c, g, or t
  misc_feature (418)..(418): n is a, c, g, or t
  misc_feature (421)..(421): n is a, c, g, or t
  misc_feature (423)..(424): n is a, c, g, or t
  misc_feature (426)..(426): n is a, c, g, or t
  misc_feature (445)..(445): n is a, c, g, or t
  misc_feature (465)..(465): n is a, c, g, or t
  misc_feature (474)..(474): n is a, c, g, or t
  misc_feature (492)..(492): n is a, c, g, or t
  misc_feature (495)..(495): n is a, c, g, or t
  misc_feature (503)..(503): n is a, c, g, or t
  misc_feature (515)..(515): n is a, c, g, or t
  misc_feature (526)..(526): n is a, c, g, or t
  misc_feature (532)..(532): n is a, c, g, or t
  misc_feature (538)..(538): n is a, c, g, or t
  misc_feature (541)..(541): n is a, c, g, or t
  misc_feature (543)..(544): n is a, c, g, or t
  misc_feature (547)..(547): n is a, c, g, or t
  misc_feature (549)..(549): n is a, c, g, or t
  misc_feature (556)..(556): n is a, c, g, or t
  misc_feature (558)..(558): n is a, c, g, or t
  misc_feature (561)..(561): n is a, c, g, or t
  misc_feature (564)..(565): n is a, c, g, or t
  misc_feature (574)..(574): n is a, c, g, or t
  misc_feature (576)..(576): n is a, c, g, or t
  misc_feature (590)..(590): n is a, c, g, or t
  misc_feature (594)..(594): n is a, c, g, or t
  misc_feature (604)..(604): n is a, c, g, or t
  misc_feature (610)..(610): n is a, c, g, or t
  misc_feature (632)..(632): n is a, c, g, or t
  misc_feature (745)..(745): n is a, c, g, or t
  misc_feature (759)..(759): n is a, c, g, or t
  misc_feature (804)..(807): n is a, c, g, or t
  misc_feature (811)..(811): n is a, c, g, or t
  misc_feature (831)..(831): n is a, c, g, or t
  misc_feature (884)..(884): n is a, c, g, or t
tactgttgtggtcacctctggaaaatacattctgctactcttaaaaactagtgacgctcatacaaatcaacagaaagagcttctgaaggaagactttaaagctgcttctgccacgtgctgctgggtctcagtcctccacttcccgtgtcctctggaagttgtcaggagcaattgttggctgtttgtactgtttgtgtgaattgtggttttcttgcttnaccctttatgcttgnggacacacaaggggctgcaanatnctnccggttttgtgggnggantncaannggggggtnangggtggatggggggcttgttnccttgnggtgccccacggtgcccncctggttgtgggcttttgtatgcccccgattaaccttgcantggantaaaantncttttgattgncnggtccangntnatnanntncactgggtgtgggccatgncgggtggtttgtgggttttncaacctttnatggtggcttttggaccntcngtttgacntctttaaaatgntttttcttgtncaaaantgtcanttnanntanangtttttncnaancannatccttccntnccgtcaacacaatncccnaaaattttanccttgnaaccatctggggtattagtatnccctgacctgagtgaattcacccgtgacaaaactgacgtgaagattcaatggtacaaggattctcttcttttggataaagacaatgagaaatttctaagtgtgagggggaccntcacttactcgtangagatgtggccctggaagatgctggctattaacgctgtgtcctgnnnnttgncccatgaaggccagcaatanaacatcactaggagtattgagctacgcatcaagaaaaaaaaaagaagagaccnttctggtgatc

SEQ ID NO: 629040 - DNA, 163 bp, Homo sapiens
gtactcaggaggctgggactacaagtgcatgccaccatacctggcttgtattcaaatttagagtgctttttctattctctcccactttaatatttaatcacataaaagttcggtattccacgctgagcgctcggtcgctaccataaccagttggtctgtgtgt

SEQ ID NO: 629041 - DNA, 270 bp, Homo sapiens
cccgaggtgcgactcgagtggagaggtgtgaccactgtggcgagatggtgggaccacggggagaggtgggaccacgggggggcgtgaggatgctgggtgggcgactcagtgccgcttcttgtgcttctgcttaaggcgttctttgccctttcgactcttcttctggcccctctcgtggtgggtggggtgcttctccttgctgcgtggatagtgagtgctgacctggcttctccatcccaggtggtacctgagcatcgaatatcgtaatca

SEQ ID NO: 629042 - DNA, 923 bp, Homo sapiens
gctaaattgaaggtatatttcgcactttccaccatgggtccagaggggcaaacgttggcaagagccgacgaggacaagttttatcacttggcgaccgagacgggttcccgttcccgatctgctttcattgcgtgatccatgcatcaagtcgcacgattttcaggttcctgcgagaaatgcccgtaggccttggctggacctgtgtgctgcgccagggggatgtgctgctatggtagctgtccaaggtttatgcctgtatccagccttattgtgtggagtggcacctgtggttccaagtcaagtcctctccccaagtgtggtgactctccagtgaggagcatcacaaggagaacgtagtaggcaggcccgtgaggaaggagctgaagacctggcaaggttgatgttgtgctcaatgatggggcccccaacagttgcgggctagctgggtccatgatgcttagctcacaagcgccagttctgacactgagtggctctacagtctggcttgtgacttttttggcccgtggtggcagcttcatcacaaaggtaaaccgttctcgtgactatcagctctgctatggatctttcagcagctgttcgcgcgtgtccaggccaccaagccccatagctctcgcccttgaatctgaagagatctatggagtcttgcaaggattcctggccctgacaagggtcgacgagtaaattcttttgagccccaacattttatgccttcacagggaagcgtctgcaacgtccagggcttaaagaaccgcgtactgggaacttggggttcacctaacagaacagcaagaccaagaaggcctggaaagggcttatgcctggagcgggtcgcaccctcacactgcgtcttagttcaccggtaaccttcagtttcagctgaattgcctccggaaggttggcca

SEQ ID NO: 629043 - DNA, 532 bp, Homo sapiens
aacttcagatcattgcatcggtctgctaaaaactccactaaggctttccatcatgccccagccgagtccatgtccttagtgtggctcctaagggcctatgtgatctggagaccctgctacctccccaaatctaactcttgccaccttggcctcactggtggtccttataagtggcaaacacaatcctgtctcagagcctttgcgctcactgttcccactgcctagaatactcttctctccgataaccatatagctcactcacttcattatatcttttcattttctactgaaatgtattcttatcaacaaagccctctccgaccacattacatgaaactgtaagtcccctgcaccacccaccctgtcactcccaatcccttttacccttatttttttccaaagcacttttcaccatctaaaaagctacatatttatcgcgtctccagcctgtaaaaacagaagctctgtgtgggcagcaatttctttgttcacagctttagccccaggatttagaacactacatagctcatta

SEQ ID NO: 629044 - DNA, 171 bp, Homo sapiens
catgtgtgtggtgcccgcttctcaacgcggggagaggtttggaacccagtgctagagccaggctgcttggctcaacatccgtccattactccttacgatccaacagagatggcttcacagcgttaagcttcggttttccgttggtgaaatggcacatagttcagcgtctga

SEQ ID NO: 629045 - DNA, 717 bp, Homo sapiens
gtatacataggaggactacgtgtgttgcatctccctggtgctatatgctcaactgtgactaaattcagctactgcaatggctaacacagtaacagaaacctgatctacgacgtaaagttcagtaagccaattagtcacaatcttagagaacttgctctatcgatttcaagaagatcatccttttttatcacacgatcactgacctagtcaagaatttcaaaaaactaatagctacaattctgccctcaaacaacacgtgcttccacagcttgactagttcattgtgtttacgtcaatggcaatcactgagaactcgaggactattatggctgctcataatctgcataggtataaacgaggatcatttctacctagggatagccaaagcatgggtttcaacacgtttgtgtacttataatatattctcaaagtccagcagctgactttttctagaacgctttacagattccatgaagatataaagtctattctcttcaagtggagctaaccaggataatctttgtccccaaaggcaaacctgttaaaatacatagatcattcaatcttcacttgtggaaatgagttttacgggaagggattgagtcttggcacatgactttcatccagatatctaacgacataatagaatgcataattagctctgtgcctcatgcattattgccttctaaattacattacgactaagggcagacataa

SEQ ID NO: 629046 - DNA, 196 bp, Homo sapiens
gctgaggtgactctacaggatcttggaacgtctgaagcaggaattgcagagcttaagagctgtttgtgtcccactgttagccgctttgttccctcatactattgtgtgggagagtcttgatatcccatgtgggattggccacgggtttggataaacgtggagaatgcttagtttttataggcacaagaggtcatat

SEQ ID NO: 629047 - DNA, 549 bp, Homo sapiens
aggcgacatttgccgaataatggcatgggatggcagagttatgggataagcatgtgacctctgaacaggagtggaacatgtactgccactatgttgctgggctgatcggaattggcctttcccgtctttactcagcctcagagttggaagaccccttagttggtgaagatacagaacgtgccacatctatgggcctgtttctcgcagaaaacaagacatcatccgtgactatctggaagaccagcaaggaggaagagatgtctcgggcctcacgaggttgggagcaggtatgtaaagaagttaggggattgggctaagccggagaatattgacttggccggcagggccttgaatgatcttataaccaatgcactgcagcacatcccagatgtcatcacgtacctttcgagactcagaaaccagagtgtgtctaacttctgtgctatgccacaggtaatggccatagccatttgggctgcctgttctaatacccagcaggtgtgcaaaggggcagtgaagattcggaaagggcaagcagtgaccctcatg

SEQ ID NO: 629048 - DNA, 117 bp, Homo sapiens
tccgagtcggccgagattctccttcaatgaaaacaaaaaccctcaattatattttactagcaatctatctgtacaggactaagctggccattcagttacatgtaaccctctttttct

SEQ ID NO: 629049 - DNA, 591 bp, Homo sapiens
gggatgaggcacgagtttgtcgccaccaatctgcagtcaagatgaagatggctggtcgctggtactgtgaggacccggtagacgagagctgaataacagaatgcggcgactgtccgcttccagcacggacactcccgccgcctgcgcctcgtagctcctggtgctgcagatgagcagtctggatagcaggtgtggctgaccctgactggaaggagctgcacatcgtgggcacctggcctgacatcacctagagcactacctgcgtcctcacctgtgcccccgacccgtccaccgtgcgccctgtggcagttttgacacagtctgctgtgctttgtctcagtgcctcttggaaggagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactaca

SEQ ID NO: 629050 - DNA, 139 bp, Homo sapiens
cacctcgccaccaggaagagcagcaaaaccacctaccgggtggccgtattggaaattaccccctaaccttgcgcattagatataggaaccggaaggtttagctccaaaattttaaccaaggttaatttggcaaggctta

SEQ ID NO: 629051 - DNA, 228 bp, Homo sapiens
  misc_feature (44)..(44): n is a, c, g, or t
  misc_feature (135)..(135): n is a, c, g, or t
ggatcgaattagccaaataaaagccgattaattgagcacagtancaattctaattctaatgaatttgcaagtgccgaagagatggcagagattgttgacttgattgtgacgcaaaaagtggatggcgtctttgcngataatgacatgatggctgtccagctacaaaatgcgctacgccgggcaaacattcgggtccctgaggacgtgattgtggcaggtatgacggtt

SEQ ID NO: 629052 - DNA, 135 bp, Homo sapiens
  misc_feature (35)..(35): n is a, c, g, or t
ggagcttagaggcacaaggaggaagaagaggcaanatcatagcaaaaaataacaaaacgagaagtggaggatgacttgggtcttagcatgctgatctgactcccagaaacaaccagtatatttggaccaagccca

SEQ ID NO: 629053 - DNA, 367 bp, Homo sapiens
gcaaataccccatggataccaagtggaagactatacgaaacactaattcacaaagtccgaaatatttttagaaatgttaccgtaggtaccgtaactgttttctgagtgactcttgctagttcttcaatagttctgacacagtccaatccctactacaaagaacgcattctgaacttcacctaaactggaagacaggttctgtaactggctttagtttccattaccttcttacataatgtaattgatttcaagtccgtctatatctctttttttcctttctagtttggttttatagtccgtattcactggaaatatcctgactgtacaaaaaccactaaataccctacttccttattctttatgggtt

SEQ ID NO: 629054 - DNA, 399 bp, Homo sapiens
cctggctacttttttgtattttagtagagacggggtttcactgtgttagccaggatgatcttgatctcctgacctcgtgatccgcccacctcgacctcccaaagtgctgggattacaggcgtgagccaccaagcccagccagacatcattctgtatttgcaacccttatttgtggacatttataaaaaattagccaggcgtggtggcgggcgcctgtagtcccagctactcgggaggctgaggatggagaatcgcttgaacccgggacccgggaggtggaggttgcagtgagccgatatcatgtcattgcaccccagcctgggcgacagggcgagactccgtctcaaaaaaaaaaacagagagacagagtctgggtatgtggccctgtctccaactccg

SEQ ID NO: 629055 - DNA, 1173 bp, Homo sapiens
gaacaaggtgaaagagccggtgaagtgggcagaacaggcaggttccctcgaccagtgacccctgttcccagtgctaatgtgccccagtgccctgtagaactggcaggccccccgatggcttgcgaaccctaattatgggtgtgtcttggtgttggctacttggatggtgccttgacaagagtggtgcagagaaagtgcatgtgaccattgaacatctagggcctctgaactttctcctgtgtgtgctgcagctgtgcacgtggctgtgcatccatacgtttggtttggagcattgagatccttaatggtgacacacatcagtgacaccaacagccttctttctggtgcctgtgaacacttggtgctaccctagtgggttccaagagttatggccgagatactacagtttgtaaccttgatgagtggtaggccaacacatttgcaggctgacggtcaccttctatgtctaccaacacgctatccacccaatggtccctacacagacagggtgtgcatacgagggcccaactcattgattgatgttgacctattgagtgcagttgggcacagggcctttggcagatgagctgaaaggcccagaacccccaaagtttggaatgcagccacccaaagccctagagacgggtacagtggctgggagcaaagctatcagttgggtgccctccatcatgacccgactgcagttctggcgaccaggaatccttgcaactggggttcaaccctttacagaatatcccatcatgggtctaccggttccgtgaaaaacgctcgttaacgtactatccacagtggcgattccaagaagctgacgtacgggcggtgtgcatggagggggaatgacggtgactaattaccacaacccaagctggacaagaccaaatcaaaggacacgagactatggatggtgattgaaggcttcaaatggcacccaatcaggcaggagggcaacgacccaaatatagaaggaaggaatgagcagtaggagacaaagcagacaaggggcgcgagacagacagcagaggaagagaactacaacgcagacgaagcgaccgcgcaggcagaggcaagacaacaacgcaaaaccaaggagatagtcacacaacacagaagaatagagccaagcgaaaaagtggaacaagacatgcacacggg

SEQ ID NO: 629056 - DNA, 768 bp, Homo sapiens
ggagtctgacgctttcctcgttgtctcaaccacgctctgagcacagagaaggaggaagtaatggggctgtgcataggggagttgaagcgatgatacatagggagtgactccataattgtgcgagttatactggaactgaaatgcgcatcgagtctgtctgaaaaggttgatgctcgtcaggaattggttcacatctcatgtcttgtactatcatcttacgacgttctgatagaagaggaaggaccgagtagaatattgctccagaggcagtggtctgcagcttcaacagaggcatagaggttggctgaacggacaggccgccccatgagagttgtgggctgttatcgattcccagtcctcatataactgtgtgggcttcacatgttgatgttgcgcagcacaagccatgtacccgagatgatggatcaaggctttgtaaggacttatttgccttcctgtttcatagaagataagaacacaaatgactggcggtgatttaaaactgtggttccagaatccaatacaggccaacaagagttcagagtcccttcagtggtccacgagacttctggagttccagcacacggacattctccctttgaggggccacgaagggaacgaggcacaggtattgaggaagaatctgaaattcccaaattccatattggtgcctcatggtctactatcggcgaaaagtgttggcctttgaattccagaagaaaggttgcccaaaaatctctgtggccacggaggagacagaatgcgtat

SEQ ID NO: 629057 - DNA, 106 bp, Homo sapiens
  misc_feature (50)..(50): n is a, c, g, or t
ccctctgtgcgtgtgcagtgattataggctttcgctctaagattaaaaangccctagcccacttcttaccacaaggcacacggtacacccttccctacgaggccaa

SEQ ID NO: 629058 - DNA, 208 bp, Homo sapiens
ccaaatgaaaaccccccctttttccattttttttaaaacccttttggggggggggggggaaaaaatttttttgccccttttcccccccccaggagaaagatttatttttttttttctagggcctttccaaaaaacccccttttttttttgttaaaaccggccccccaagtttttcctccccaaaattaccctttttttttttttgtta

SEQ ID NO: 629059 - DNA, 431 bp, Homo sapiens
gcaggatgtcatcagaaatgcctttgcttgctttgatgaagtaagcaaataggcaccatacaggaagattactatgagagagctgctagacaagcatggagggatcggtttacagattaggagagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttatactcagactggaaacgggactttctattaatatcatcttcagaatccaaatcaggcgatcct

SEQ ID NO: 629060 - DNA, 463 bp, Homo sapiens
aggattcataacggagattgattggcttgcactaaaggaaccgtcagcaggaaactgaattggctctcattcagtggggaaaatcggtcttaccatgaaatgcttatgagtaccttcaccgcccaattagaacagtatgctatctatccgatcacttaatgagctttgacttacaaaataactcttgaaacagtcctttaaacgcattctgcccgagtggttcaccacatatggtgatgccgtgcttactcatgcgtaagaatgaaggcagggatattcattactgtgatggaaatatgggaaaaccatcattcatgccatatgcacggataatagccaagctaatggccaattcccgcttatgattttggagaatggctcccttgtaatcatcgacatgacagatgacgaaacccctgaagtttcccactcgacacaatacattctgacttcatcagaagca

SEQ ID NO: 629061 - DNA, 364 bp, Homo sapiens
cacggtagattatagcaaatttttttctttattgtatttcctatgtttctcacttttttttttttcctgagagagtctcattctgtccaaccaggctggaatgcagtggcgccatctcggttcactgcaagctccacctcccaggttcgcaccattctcctgcctaagcctcccgagcagctgggactacaggcgaccgccaccacgcccggctaatattatacgaatttttttttaagtacagacggggttacaccgtgttaaccaggagggccttgaactcctgaaatcgagatccgcccgcctggactcccaaagtgcggggataacaggcgtgagcacccgcacctggccaccccggggg

SEQ ID NO: 629062 - DNA, 433 bp, Homo sapiens
tcagcctgcagtcaatgacctgtctttgcgacaccactctaaggaggaggcgaagtacttcttgacgctctcatcgtgggtaactccaccccactgtctccaggcagatattctcttccatgcgtccccaccatgctccacgtcacaccagccttccaagtcctcttccccacacggtacgcgactaaggttgcgccccgcgtgctcaggaagaagaactgctccagttggtgggctccttcctcaccgccgccctcggcacaggcccctcctgttggcacttgagaagcaacagcggggccccgtcaacaagctctttccagcgcaggcacaccaggcgcatgcttgcaaccagctcggccgccggcagtgcggccagcacgcgcagcagcgtcgactcgggcagctcgtccaggttagcggcggcggccgc

SEQ ID NO: 629063 - DNA, 105 bp, Homo sapiens
gctatactatttgtaccaacatgccagtggttgtacactatgagagacctgctgcggatcttgttacggcccggagagagatttagaccctctcccccgaattat

SEQ ID NO: 629064 - DNA, 264 bp, Homo sapiens
ggaccggtggagcagcccctgggctccctggacaggggagttctgaggctcctgctgctcccatccacctgtctgtcctggcataatgccaggctctgagttctgtgaccaaagccaggtggggtacctttccttccacccctgtggcacagctctggaatgggagggttggtagcccctcacatcagagcatcccacaaaggccagtaatggatcgctcggccgcagtcctactactgctttgtacgtcgtggttaatatata

SEQ ID NO: 629065 - DNA, 316 bp, Homo sapiens
tttttttttttgaaagaaagtaactcaatccatttgggtaatttttctcgaggcgaaatggagatagattacaatagaaactaatacaattttcactctcaagcacatattggatacagtggaatctgaactaacgtaagaataaaaaaaaaattggagactgtgacatgtattgctcagcactccaggaatattttgccccaatggagttttattctgtatttacctcattccagccacttccctgctgctattaccatcattatcctccctgcttataatggattcagtaatcttaatgcttggcttttgtccc

SEQ ID NO: 629066 - DNA, 823 bp, Homo sapiens
ccttccctccggaagagccaagaaggcttccgaagaccagagaatgccgcccaggtgtggcatgtgccgtgtccccggagtgccccagccgagcatggaggggctagcgatacccagaacgagatgcaccctgcccatgatggcaccccagggaacccgccatcctcgaggaccctccagtcgttcagagctggaagttggcagggtttcgtgccttgctagtaggcatcggcttcagagctctcaggtgctgctggcaggaaaatgcagggcgaggaggggctgggccatcagtctcgaggctcccgaggtgcagccccccactccactgcagggcccaggggggccaagaacagccacaagaactaacaaaagcgcaatactgggaacggaatcgtggaaagaaaccctcataggctttgggaacttacgaagaaatgcccgacatcccttctactaacatggcatctactaacgtggcatctactaggatgccacaaaacagacgaaatccttccacgtaaggctggacacgtgtcagggcggggtctcaaagctgggccacaggcagcatccacgggcaggccactgggtggcaggagacggagctggggaggagccggcgggaggggccggggcagatcccttaagcagaacggctcaactgttggtggtggcaaagcaggattgtggggacacaagatgcccccttgattcatcagttactaggatacaggggatggcacacaccggctgataacaatgtgaataagggcaaagaacaggacacacaacgcgggcgccaggcacaggccccggaggc

SEQ ID NO: 629067 - DNA, 362 bp, Homo sapiens
tcactccttggcaccccccaacttcctgcacacaatggcaaaaaggggcgctgggaaatccccccccagggtggaggtttcctgttgggtaccctttaaaactgctttgccttcatgttcaaacagattcagggaccaccccctcccccgcccgcaaggttagggcataaagttgtttccttcccaacccggacccaaagaccagcccttccctggtcaaagcctttccgccccctcctgactgttctggatgggcaactggtttgcactgcaccccccccggccatgtaactttcctgtccccatatgataaaacccttttgcatagtattactgacccagtaaaaagctatttcccggga

SEQ ID NO: 629068 - DNA, 131 bp, Homo sapiens
ggacacatgctcagctctgtaatcaaatttagcctaaggtgactccttacttaagttcagctaaaggttctctgtactcgcgaattataacagtggaggtgtaaccagaccataggctacatttgtgccaa

SEQ ID NO: 629069 - DNA, 602 bp, Homo sapiens
ccacccccgctctcacgaactgatagtgaatgaatatttaatgaggctgagtaaaagaaactgtgcgtatgcggaagaagagacgttatcgagagaggccagagagcgttcgcggcgtgagagagcagacatccgagacaggcacttgctggatgctccaaaagtatctgcagcgggtggtccaccaggagaagctcagcctgcctggaagatgccgagatcgagctgcagccgctcgggggccctgatgctggccttgctgcttcaggcctacatggaagtgcgaggctggtgcctgcagagcagccagagtcaggacctaaccacggaaagcaacctgctggagtgcatccgggcctgcaagccagaactctcgggcgagactcccatgtttcccgggaaatggcgacgagcagcctctgaccgagaacaccccggaagtacgttatgggccaacttccagttgcgaccgaatcggccgccggaacagcaacaagagcaggagcagcgggcgcagggcaccccgaggacgtcttaaggggcgaagactggggcccgctgcctgaggaggggcccgagcccccgcaggggttgcgcccggc

SEQ ID NO: 629070 - DNA, 558 bp, Homo sapiens
  misc_feature (16)..(16): n is a, c, g, or t
  misc_feature (490)..(490): n is a, c, g, or t
  misc_feature (502)..(502): n is a, c, g, or t
aagaatccatagcaangtactcagctctggcttctgaacaataggttagacaatgagaagtcctggctgttttagtttctaatgtaaatagggtcccttagtaaaagtgaattcagtcttacttaggatggattgggtaactacacatgagatggcttttacctttgctcaaacgagcgtttgggatcatctttgaggaatgaaaagcggtcgtgcattttcatcaggaaaagatacaagatgtgtataacatttggaaatgtgtctgaggatgaatggaaatgttctcattttattgaacgctaagaacaacaacaaaaaagaaatgtagggtgctactaaggatcttggatgccaagagatattttaaagccaatttgtaaaaacgataacccgtaaattctatttaaaattggaaaagtaggaccagaattttgaagtaagccagtttatctttagaatgatattgtgaaattggctttaaatatancattccgatccnatgtatttatggagtctaattcatagcctgttactgtcattccacacaggctaaaa

SEQ ID NO: 629071 - DNA, 690 bp, Homo sapiens
ttcggacgaggtccacttcttttcgtcagggtataccgactagggccgttcgcgcatttgacctattcatttttggcttcgcatctcacagagctgttatggccacaaagctttcactgctctgactccatgcataagggcacacatagactgtgcgctgtaacacaaccatgctgaaatctagcaggatcgacctgcggttatgcgttgatcactagatggctatgcccaataggtctactacttaacctccctggctgctgacacgaacagttgtcagagagtatgagaaactgtttgagtatagattgcgatgcttccactacagaacttggatgtggctctaggctaatttcagacaataaggcacgcttacgtccctgaccacaacttgctgaaagtgtcataggaacagtcttcctagacatgtgaacagcaactctaggcaccacagatttgcatatcgcctggagaccccgagacattacgttacaccaaattagtttacttgccatgtgatcttgccgcgagcgttctaaagatgttcaacagtcgttaacttctcttcacacatgtctgctaatagccaccgtcaacttactacggcctccctcacggtttccattcctcttcaatattgcgactcctcatggcaaccagtagattcccttcttttacgcttccttttct

SEQ ID NO: 629072 - DNA, 347 bp, Homo sapiens
gataagggaggaatcacagtggaggtactgaagatccgtaattactagtacaatgcatattgatgaggacagtaggggagaaaccgatttacagatgagttgacaagcaaagaaaaggcaaataaacaatttggtccaagaaatatatcacattctgtacaaggtcttcacttagctgtcgtcatttgtattaactcttcatagttgacttgaccaggtcaccaatcgagtatctgcttccctgctcatttcttcatctgcttcatctgtgaacttctctccacggtatgtcgtcacatggcgcagttctgcagcactagtatagccattgccatccttactcgtac

SEQ ID NO: 629073 - DNA, 365 bp, Homo sapiens
  misc_feature (8)..(8): n is a, c, g, or t
  misc_feature (30)..(30): n is a, c, g, or t
  misc_feature (91)..(91): n is a, c, g, or t
gcattctntcttttttttaattgtggtaanctctacacaacagtggtcaggcgtgatggtgcacgcctgtaatctcagcctcccgagtggntgggattacaggcgcccaccacacctggctaattaaagacagggtatcaccatgttggtcaggagatcgagaccatcctggctaacacaatgaaccccctgtttctactaaaaaaatacaaaaaattagctgggcatggtggtgggcgcctgtggtcccagctactcgggaggctgaggcaggagaatggtgtgaacccgggaggcggagcttgcagtgagccgagatcatgccactgccctccagcctgggtgacagagcaagattccgtctc

SEQ ID NO: 629074 - DNA, 125 bp, Homo sapiens
gtgactttgaacagagtgggaggaggtttgccttcagcaggttccagctggacttttcctttgagcttcccgcttttggggtgcccagatattttccgttcacagcttccatcaggatacatata

SEQ ID NO: 629075 - DNA, 452 bp, Homo sapiens
attttctccccctctgtgggttgtctgtttactttgctgactgttccttttgccgtgcaaaagctcttaagtttcattaggtcccagctatttatgtttgtttttattgcatttgcttttgggttcttggtcatgaaatccttacgtaagcaaatgtctagaagggtttttccagtgttatcttctagaatttttatagtttcagaccttaggtttaagtccttaatccatctcgagttggtttttgtataaggtgagagatgaggatccagtttcattctcctacattggctagccaattatcccagcaccatttgttgaaaagggtgtcctttccctgctttacatttttgtttgctttgtcgaagatcagttggctgtgagtatttgggttcatttgtggtttctctgttcaatgtgtttattgtctatttttatacacaaaatcatgg

SEQ ID NO: 629076 - DNA, 532 bp, Homo sapiens
gttcaccacaatctgcattgtctgtatgtgtggaaatgctcagattgtatcctgagcatcgttcgcctgttgcctgttcaatggctctatgagcttgtgtcctgtgccacatgtgccatcgtgggcgtgcctcgccacatcgcggattccatgtccctggtcacctttgcttttgcttggctcggtagcccacgggttggtgcccttggactgctccctgttgtgtccacagaatagcgtgaatcgctgccctgagtgaactctgaggctgcactggtgtccaacccttgttcccattcccatctatgtttccgtaatacatgattcataaatggagtttaactcacccaaggtagaatgaaaaataacgaaaattcaatttatatatacagtgatatattattaagagaaagattttacgtcgttcttgattacatgtaaaggtccttggaaaatctttctggtgggacagtgattcaattaaagatggttaattaaaaatggtgtgtggaggctgataaaatttaaagga

SEQ ID NO: 629077 - DNA, 994 bp, Homo sapiens
  misc_feature (295)..(295): n is a, c, g, or t
  misc_feature (953)..(953): n is a, c, g, or t
  misc_feature (961)..(961): n is a, c, g, or t
cctattctcggcacaggaggtgaagggtttatctcagacttggcccatgactgcgttgaaggacaggagggagcggctgtggctgtggctggaactctgaacgccggtgcgggcggccaggccctttccctgggtggtgacgacgcgaggaccagagccctgtctgcccgagggaagggcgaggggacactccccgtggcgggggtgggatcccggtagccggggctcagtgaccgctgctgggccaccgcctgtggggacctgaccttcctggggaaacccatgggtcaaaggngccgagaaatccaagcaccaagtggccgctagggcaggacgggcgcgttcgcagtggagaagctgggtgtgtccgtgggaaaggaaagaaatggaagcagaggctcttcaggggcacctgggaacgcagcctacactcttcccaggcctcctccctccgtccactgtgccgcctgggtcctgggacagcctgagggccgcaggctcccatgcaaggcccgctgggggcctgcttgtctggggctgaatttggactttatggggctatggctttaatttcacaatgaccgataaccagtgaactgaagccaggacagcaccgtgagcaccaagtcagagaattttcacgagggaaccaatgaacaggaacagagtgtgaggctgccccagctgcatcctccgggaggcgccttcccaagggagtgcaaggctgcctgctgtggccaggccaccaaagcaccttcttcaccgccaggcatcttttgaggcacgcgaacatcagaggccccagccacgtgctctggaggagaagctgagagccccaggccacaggcagggcagcctctgagggccggctcagggagagtggccggagcttctggcctggggcaggtgacccgttagaaactgcatgtgttgctctggcaccagccacagcnagagattntctcctatcacacagggaccccgccaacgcact

SEQ ID NO: 629078 - DNA, 357 bp, Homo sapiens
  misc_feature (249)..(249): n is a, c, g, or t
  misc_feature (304)..(304): n is a, c, g, or t
  misc_feature (350)..(350): n is a, c, g, or t
accaacaatatcccagaactcaaatattatgataagacagttcgtggggccacagagaagtaaaaaatcaccaagaagacagtaagagaatcaaacttccatattcatgatatccttttccccagtgtgcctgacaccaagtgtgtggaaaatttccccccaactcacagtttctacagtggaaaaagtgagactgaggtgaacaaccagcttctccacaatcttgagttttctggtgagaaatctttncctgcctcaatgcacaagaagtgtttgagagtacccagaagggagatgtgccctngaggaaagccagagacaaagtggttgaggttagagtgcctgccttntgtctgg

SEQ ID NO: 629079 - DNA, 197 bp, Homo sapiens
ccccctccatatgtagaggctcagtctttgcagggaagcagctggaagatggccgactcttttctgatgacaacattcagaaggagtcgaacctgcacctgtgtcctgcgtatgagaggtggtttgcagatcttcgtgaatagcctgaccggcaagaccgtcatctctgtaggtttgcgcccatgtgacatcagttc

SEQ ID NO: 629080 - DNA, 504 bp, Homo sapiens
tcgccacggcaggtgtactccctcatctttaatcaagggtgtgtgattataaaatatatatctggcacacaactgtactcaatagattttcaggtatttctcttccctttcccctgtatcaaaacttacaacgaaattcattgagctagattaaaaatcttactcataaccatacttaagcctatattttagaaactaaaatccactcaccttgatatactctgtggaatctggctcaaactgggcaaagcagagattgaggacatcaacatgcctgtcctggctatacatagtctaaaaccacacagcagagttagcatcacatgagaacactgaagttcagcacctgtcctgatgtcatgacaggcctgcccacccacatactggccactctgtgctcctcaagaagcataaagaaagaacacaggctttgtaattgtcacacctagattcaaattccagctaagccaattatgagagaaccctagtacaacctgccggtgg

SEQ ID NO: 629081 - DNA, 379 bp, Homo sapiens
  misc_feature (19)..(19): n is a, c, g, or t
  misc_feature (172)..(172): n is a, c, g, or t
  misc_feature (359)..(359): n is a, c, g, or t
cggacaccctcctgggaanctgggatgataaagatgagcttacgcctgtggccccctggtggtctgaaccacaagccccccgatggtcccaggaaaagatgggaggaccccgagaccagacgaactctgtccgacccctctgctcacccacctgggacccaccagggtgcanctggactccagggtccagcccacaagctgcatctaggctctctgggagaggagggacctggagggccaggagtcccagactcacgcaccctgggcaacagggaaccgggaatcggggccttctgctcctgctggcctgggagactctgtggggtcagcactgtactccgttgctgttttttataaanacactcttggaaaaaaaaaa

SEQ ID NO: 629082 - DNA, 146 bp, Homo sapiens
acagagcgatccccgtctataccgtgtcaactggagtttttacaactcacgtgaatttaactggattggggagcggggtgatctataacactcgtttacgccggcttactattgacttggagttaataccccactattaaacttct

SEQ ID NO: 629083 - DNA, 268 bp, Homo sapiens
  misc_feature (45)..(45): n is a, c, g, or t
  misc_feature (79)..(79): n is a, c, g, or t
  misc_feature (259)..(259): n is a, c, g, or t
tttttatacaaaaactatgggcagcagtatcaaagttgacattanttgtagggcatttgaaatgtttgttttgctctantatttgtgctattgtttgtgccgtaggtgagctctgttttgttgttaattaaccatttttaaatggtcttgctgagaaactataataagaaatctgggccaggtgcagtggctcatgcctgtaatcccaacactttgggaggctgaggtgggcagatcacttgaggccaggtatttgagnccagccttg

SEQ ID NO: 629084 - DNA, 369 bp, Homo sapiens
  misc_feature (6)..(6): n is a, c, g, or t
agaacnttcgcctgcgcgcggagtttcgtctgtggcgcgaaggcggtgagcgccactacgcgatgttctcccaggacgacaagcgcacgccgatcctgatcgaagaatttcccatcgccagcctgccatcaaccagttgatgccgcagctcaaggccgcctgcaagccagcgccgccctgagccataagctgttccaggtggagttcctcaccaccctggccggcgacgcgatgatcaccctgtgctatcaccgcccgctggacgagcattggcacaccgccgcaaaccagctggcgactgacttgaatgtcagcatcatcggccgctccaagggtaagcgcgatgtgatcggccatgactacgtggtg

SEQ ID NO: 629085 - DNA, 858 bp, Homo sapiens
  misc_feature (6)..(6): n is a, c, g, or t
  misc_feature (9)..(9): n is a, c, g, or t
  misc_feature (25)..(25): n is a, c, g, or t
  misc_feature (44)..(44): n is a, c, g, or t
  misc_feature (47)..(48): n is a, c, g, or t
  misc_feature (54)..(54): n is a, c, g, or t
  misc_feature (68)..(68): n is a, c, g, or t
  misc_feature (90)..(90): n is a, c, g, or t
  misc_feature (98)..(98): n is a, c, g, or t
  misc_feature (100)..(100): n is a, c, g, or t
  misc_feature (105)..(106): n is a, c, g, or t
  misc_feature (115)..(115): n is a, c, g, or t
  misc_feature (144)..(144): n is a, c, g, or t
  misc_feature (160)..(160): n is a, c, g, or t
  misc_feature (171)..(171): n is a, c, g, or t
  misc_feature (204)..(204): n is a, c, g, or t
  misc_feature (215)..(215): n is a, c, g, or t
  misc_feature (222)..(222): n is a, c, g, or t
  misc_feature (226)..(226): n is a, c, g, or t
  misc_feature (228)..(229): n is a, c, g, or t
  misc_feature (239)..(239): n is a, c, g, or t
  misc_feature (272)..(272): n is a, c, g, or t
  misc_feature (282)..(282): n is a, c, g, or t
  misc_feature (289)..(289): n is a, c, g, or t
  misc_feature (295)..(295): n is a, c, g, or t
  misc_feature (310)..(310): n is a, c, g, or t
  misc_feature (320)..(320): n is a, c, g, or t
  misc_feature (385)..(385): n is a, c, g, or t
  misc_feature (401)..(401): n is a, c, g, or t
  misc_feature (411)..(411): n is a, c, g, or t
  misc_feature (428)..(428): n is a, c, g, or t
  misc_feature (451)..(451): n is a, c, g, or t
  misc_feature (454)..(455): n is a, c, g, or t
  misc_feature (472)..(472): n is a, c, g, or t
  misc_feature (475)..(475): n is a, c, g, or t
  misc_feature (477)..(477): n is a, c, g, or t
  misc_feature (518)..(518): n is a, c, g, or t
  misc_feature (521)..(521): n is a, c, g, or t
  misc_feature (523)..(523): n is a, c, g, or t
  misc_feature (528)..(528): n is a, c, g, or t
  misc_feature (530)..(530): n is a, c, g, or t
  misc_feature (532)..(532): n is a, c, g, or t
  misc_feature (536)..(536): n is a, c, g, or t
  misc_feature (541)..(541): n is a, c, g, or t
  misc_feature (543)..(543): n is a, c, g, or t
  misc_feature (548)..(548): n is a, c, g, or t
  misc_feature (558)..(558): n is a, c, g, or t
  misc_feature (665)..(666): n is a, c, g, or t
  misc_feature (852)..(852): n is a, c, g, or t
gcgganagngccggtcctcagcgcncagcaccgccgatcccggnaanncggagngcgcaccgcaggcnggcggccgaagctcgcgcatcnaagcaatnantcttnnaactgctcnttagagaagggaagatgagtgagtagagntcgaagtcaagcaagnccttggcctcnaagaaggaaaaggacggcactgagaagcggggnaggggcaggcngcgcaanagcntnnggtgagtaangggaaagagctggtagggagtaagaaggagaanagcgaagtgnaaaaacntaaganaactcggggaagaanaaagggaagnaaaaaaaagggtgatgaaaagacccggaaaaaaaaaaaaaataaaggaaggaaacaaaggggaanaaacaaaaaaatgganaaggaggaanaggagggaatctcgaangagtcataggaggaggagaagtnaannatgagtgaagaatgatnatnantggaggagaagcttccttatgggaatggaaagatttgatangangnaaaancnanagcnccttncncaggnccaccatcancaccgcctctggccgccacccccatcttccacctgtgccctcaccaccacactacacagcacaccagccgctgcagggctcccatgggctgagtggggagcagtttnnccctggcctcagttcccagctccccccgcccacccacgcatacacacatgccctcctggacaaggctaacatcccacttagccgcaccctgcacctgctgcgtccccactcccttggtggtggggacattgctctcttggcttttggtttgggggcgccctctctgctccttcactgttccctctngcttcc

SEQ ID NO: 629086 - DNA, 400 bp, Homo sapiens
  misc_feature (367)..(367): n is a, c, g, or t
  misc_feature (395)..(395): n is a, c, g, or t
atgggttttcacagtgctttcccatacaatgtctggaatctatagataacataacctgttaggtcaggggtcgatctttaactaccaggcccagggtgtggcgctgggctgtctgcctgtggatttcatttctgccttttagtttttacttctttctttggaggcagaaagtggggataagacaatatgaggggtggtctcttcccttattgcaatgctatgaaagcaatacacattcagtagaaaccgttcgaatgcccatacagccattctgttttttactcttactgcattattcaatagatggcatgaaatatttaagactttattatgaaaataggaccttgtattaggatggttttgcatnaacagtagggcttaatgttaaggagtgnctcag

SEQ ID NO: 629087 - DNA, 941 bp, Homo sapiens
tcgcactctgattcttccgaccgttccggcgtcgcgatttctctgcacggttcgctactggaatgaatgagatcgccgggctggtcattgaacaagtggtctccgagtcagtgatgcaagtgcatggttttggatggggagctgacgtcatccctcggaggctcgtgttttccttccatcggtgcgaggcgactccagacaccaggtcggtcgtggggggcttgggtcagaaggactcctacgtgtgggcgacgaggcctcagagcaatcgtggcgattcttgactcatgaagtaccccttcgattgagcatggcgatcagtcacacaacgggggactgattcatggtgaaagatctggcaacacgacttgctttctacaacggagcttggtgcgtggcccgggaggagctgactcgaggttgctttcgtgttgctgaggtcccccttgaaagcccaggggccgatacgagcaggatgatagtatggactctgattatgtttcgaggaacgtttcaagccaccccgggacatgtgcagtgtgaccatccatgatcgctgtagccggtcaccttctgactgcgctacgtagtgggcgcgacccaactggtcattgtgcattgggacctcgtggagatggggtcacctctgcacggtggcccaatgcttacgagtggcttagtcccctgctcgcccaagtctatcttgagtctggatctgttgtggcggggacctgaccgatttatctcatgaagatcctcaatgagcgatggcttccgctttcaggcacactgcgatccgtgaaatcgtgccgcgacgtcagggagatgtgtgcttggttgcctgacttggcgggagagtggcaccggcggtcatctactgtctggaggaaaagcttcgaagtgcccatggcaggccttgcctggcatgacgggccggtccg

SEQ ID NO: 629088 - DNA, 107 bp, Homo sapiens
taatcgagctcggcccgcttctgcttctgcgcaagaccctgcttcctgcttctcgcttcctgcttctgccgcttcctgcttctccttttttagacgctcatcacgat

SEQ ID NO: 629089 - DNA, 448 bp, Homo sapiens
tggtgaagccaggacaaagcccgtgtcacaacctgatgcggctcaggacaaagccacggtcacctcctgatggggccaggacaaaccccgtgtccacctcctgatgttgctcagggaaacacccgtgtacaccacctgatggggctcaggacaaaccccgtgtccacctcctattaatgcacaggacaaaacgagtgtccacctcctgcctggagctcagggaaaaccctgtgatcaccacctgatggggcacagggcaaaccgaatgtaccacctcctgatgcggctcaggacaaacgtggtagtcagctcctgatgggacacagggaaaaaccccgtgtacacctcctgatggggctcagcggcaaacccgatgtacacgctcctgatagcagtccaggggaaaccccgtgaccacctcctgacggcgcgacacgaaccgcacaca

SEQ ID NO: 629090 - DNA, 112 bp, Homo sapiens
tagtaaataggtaggtggaggcatcatatagatcactccaggtgatggagggatcttctactattaggactttacgcaacgaaacgaaggcatcacaaatcatgaaaattat

SEQ ID NO: 629091 - DNA, 527 bp, Homo sapiens
  misc_feature (93)..(93): n is a, c, g, or t
  misc_feature (157)..(157): n is a, c, g, or t
cggggaagagcctgaattggggtccctccgtgtgataaattgccacccttgagcattggtaggaacaagctgccaaacgaggaagttgtaccnttccaggagagcgcttctgcaggtgttcatgatgatgttgacttatattacgcagattatgtgntttactatctttatgtacgccttgtttctggtaaacggatataagtgaagaacaaactttgaacatacttaatgtatttttatagaactttgtaaacgaaggagattctgttttagagtctgtccttttttatatcttgaagaaatctatgtatgatgctataaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtctc

SEQ ID NO: 629092 - DNA, 633 bp, Homo sapiens
acgaggatcccggtgttcccttgtctggggtaaatacgatacaaaatgattcttttgaatcctgaatccataaattacacttttttttttcaaattcacaaaattcacaggggggcggacggtgtaataaccactatggggaaacatcccgtaaaccggccggtggccaggccaagggagtgacggaacgggtgacatcggtttgagcagtgcttgggtggtggctggtagaatgccacgcgtgtgcatacacttggtacatcaggggtgaagggagggttttctagatgatggggggagggtaaaatggggattttttggtggttcctttgtggaggggggggtgggggtatagtactcagcttcggccctaaaataacagtgtataaaaaccccgtgaagtatggggtgggtgtgtacgtgtgagtgtgtgtaggtatacgtcgggcaattaaggcttggtcttcgggaacttagtgaattcttttctcttttccctccagaagtatcggtcacaagattggtaaataagagctctacttagttggtctaccatgaacatgtggcagcaaaccttatgcatctaatccctacaaggttacggaacggctttcagacttggcaggttaagca

SEQ ID NO: 629093 - DNA, 544 bp, Homo sapiens
  misc_feature (79)..(79): n is a, c, g, or t
  misc_feature (116)..(116): n is a, c, g, or t
  misc_feature (128)..(128): n is a, c, g, or t
ggtgcaggccccgtatcccagtccttggaagcttagccagaaaatgcttaacccagaagcgagttgtagtgacccagtngcccattgcatccattttggcaacagtttaaattccngttctccaaaangaaaaaaaaaaagccaaaaaaattagcttgggcatggtggcacatgcctgtagtcccagctacttgggaggctgaggcaggagaatagcttgaacccaggaggtggaggttgcagtgagccaagatcatgccactgcactccagcctgggcgacagagcgagactccatcttaaaaaaaaaaaagtctggggctgggcgcggtggctcatgcctgtagtcccagcattttgggaggccgaggcgggtggatcacaaggtcaagagatcgagaccatcttggccagtggcgcgtgcctgtagtcccagctactcgggaggctgaggcaggagaatcgcttgaacccgcgaggtagaggttgcggtgagctgagatgctacagcactccagcccggcagcagagcgagactccatctc

SEQ ID NO: 629094 - DNA, 229 bp, Homo sapiens
  misc_feature (41)..(41): n is a, c, g, or t
  misc_feature (43)..(43): n is a, c, g, or t
  misc_feature (131)..(131): n is a, c, g, or t
  misc_feature (153)..(153): n is a, c, g, or t
  misc_feature (216)..(216): n is a, c, g, or t
agggaggcctcattgacaagtaggcccatctttggcgcaantntggacctgggaatgtctccacctcggattctgatctgatccttagggggtcccctggccccacggacccgactcagctttagacactncagccaagggtcctccggacanttcctgcagctctttctggaccttcaggcacccccaagcgtgcagctctgtcccagcctttantgtgtgtgagagg

SEQ ID NO: 629095 - DNA, 175 bp, Homo sapiens
agagagagagaaagagatctattgtttgggagaaagtacaggaaaaaaacaagagtctttatctagtaatccagagaactcttggatttgtccaagagcgtcaaggtggtacctcttaagagtctgcaagaaacacagtcctgctgggcttgaggtcccccctaaagcagataca

SEQ ID NO: 629096 - DNA, 98 bp, Homo sapiens
gcggccgcctactactactactgctcgaattcaagcttctaacgatgtacggggacatgcatttggccaaaataaacaaatgctggtctgccaaaaaa

SEQ ID NO: 629097 - DNA, 908 bp, Homo sapiens
  misc_feature (676)..(676): n is a, c, g, or t
ctcgtcacagcacctcggaacccagaggcccggctctgatggtgacccccctggtgaggaaggcgatggcccctgcgaggacgatggcccgcgcccgcctcgccccggcggcatccctgccgtcggcttgtggcttctgtgcacgctcggctccagggcacccaggccgggccaccggccgcgcccccatgggctgcccgcgggtagccgactgcctgaacagctttacctgccggggtgcctggcttcgtgctggacaccaagcgccctcggtcagcgagacggagctaccttcctgggagtcccccaccgtgcgccggggctgggactgcgtgctgcgcctggttgcaaccacccagaacggtgcgaacttggcgctagttggagcgttgcagaccgacgcgcgggggagggacgccattcgccgcctgcttcctcatcaaattgcctctacgagcagaacttcgtgtgcaagttcgcgcccagggaggggcttcatcaactacctcaacgaggggaagtgtaccgttcctacccgcagttgcggacccaagggccttggagggtctgggatcccaaggctgggcaaggccatagaacttgaaggtaaaaccccaaggaaccctggttggctcgaggatgttggagaccacaagattggccgcctacttggcgnggtgaccactggctgtcagcggtagagcagggaaggcccaaacaggtggactgtgtggggctcacggcaggccctacctggtccagctggacaggtggttagttcgacccccagaggggggcacgtcagtcactgtgcgtcaccaggcgcagggatatgctcgctccatggtgggcctccgggctttccccctgttttccccggcggattcaagtcctagcgggttgcccac

SEQ ID NO: 629098 - DNA, 106 bp, Homo sapiens
tatgtgtaactgggactacaggtcatgccaccacacccagctaatatttgtattttttttaactgcaatcacccccctatttaatacctgttgggtaccgatgacg

SEQ ID NO: 629099 - DNA, 1354 bp, Homo sapiens
  misc_feature (231)..(231): n is a, c, g, or t
  misc_feature (1354)..(1354): n is a, c, g, or t
gctcagcagaggacaatgagtcggagaccaggtggggaagacgagcccttcagagcctgctccatcgcggagaggtccagcaatgcccatgggaacgcgggtggagcacgcggaagactccggtgttcctggttccgtctacatgcatgctggtggcaggccgacgtagcgtttaggtcgcatggaagaccgcaataccatgaatcactctgtgtgggaatagtaaccatncgcttgtgacagtccgatcaccaatgattccagatcggttcaatcaggtgggttgttgtctacgcaattcagttgcttgtaccccgtgcttaggacgcttccaccagtgcgaacttgagcgtcggaggtttgacgagtacggtagagaggttagccgtaggagtgggtgcccggcttgggggacgttctaagcagtctcaggtactgcctggagcggttggctcatcgtagacctattccctatgcttcagagaggtcccgggctacgggtgacacgacatcgacgagctggacatgctggccccagtcgaaagaagcgatgatctgagcccaagaaggccctgtttccttggccggggagcctggttccctagggttgagagacttggtaaccagacacgctccatgctcaagcaacaagcaccctggtcgactttgcacaatctacttgccatggggaacattgcgaacagccaacagaggacttgggaccttaaaccaaggcttgccgaggcttgccaaaggggcttctcatagcgaagatggccttcgcaagcgctcctgtgccctgcggcctcgtggcgtcacttgactccccccttttactagatgtcgtgggcaaaacccgaagtgcccccctgaagtcccaggagattcctcggcgcgtttacacatagagaggtgaagattgcccttcctccccagagaattgcttgggtaggggtgggaaggtttcttaccaaaggggatgtcaccccatttgaaccccttcgtttgcacggcctctccaagggaaacccccttggggaaggcccaagcgaatgcaagctagcctttaacccttcggaagcgaaggcttttaaacggaatacgtccctttgggggcccaaggccaagggaaacgccccaaagggaaacccatgaagcctttgtgttcaccgttccctgggaaacgagggtgtgccgggaagatccttcaaagccaggggggaacgctggagccctttccagggggcacagggatggggcctcccaggttggggcatggaggggtccaggatgggggctcaagcgtaattaaagaaacgtggaaggccagcagacaaaacaaacgtccagcacn

SEQ ID NO: 629100 - DNA, 134 bp, Homo sapiens
tgccacacattctgtgataccagaacatatatccagattctgtggcgagatgatgatgaagtcttcttggccttatgattgtggagaaatgtgctgtgatctggctgataaggtatcgatggggtgatgaggtc

SEQ ID NO: 629101 - DNA, 967 bp, Homo sapiens
  misc_feature (428)..(428): n is a, c, g, or t
  misc_feature (492)..(492): n is a, c, g, or t
  misc_feature (509)..(509): n is a, c, g, or t
  misc_feature (525)..(525): n is a, c, g, or t
agcggttctctcttcctcgggcgcgtgcctacggagcgtggcgacgccgatcgtcctgtctcgcgcatcgatggctcgccctcagcagcgcgcttgcgtggagcctcaatgatcgcgcgaacagaagtagcaacgcaagcaaggttcactccgggcgaccaggtcagaccgcatatgctcgaaagatggaagcgctacagctgtgcggaagaccctagaggcattgactacagggcttggtagaaggatgcaggggcgcagatctgtgatgcctcaaggactcggtttatggaaggcataggagagagacagacacagagagcacagtgcgtgtccaagtgggcttaccgggaagtgtccctggtgccactgacgtgccacggaggcatggacagtgcctgcgtgactgtgcaactgagatcttactngtgcgcgagatcgcctgcacaagtgtttcctccaagaaaccgccaagaggccagtgcgtggaanagagtctgcacctaganctggcgcatgcagagntgcaccaagccccaatgaccagggctggcgtagtgaagaacagtgagtaggcagttcatgtggcagcgtgttcctggtttaacatgaagtgtcaacagactgcgtcatgcatgacaacaacagcacttcctctgagacgtttgagcaatcgggattaataaggggatccgtatggctccatggggtgggaccgaggtgagcgacaggctttaggtccgccgtatgatgacggggtaacttggagaacgtgggggcgttaaacagacgcggacatgacgcggggaatccggggggggagaaaatcggccaggtcgggacccaagataatctgcccacatggtggagacacccacacaccttggagagaagacaccccaatggggaaccccggcggcttctggccacccggaggcccaaacagcctgggtacagggggggaaac

SEQ ID NO: 629102 - DNA, 419 bp, Homo sapiens
acaactcaggggcgagctgctaaagacctaccagggtaagatgctcaacacactcctccttgctggagcagctgagcgagcggcttagagtggttgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgtgaggagtgagatgtggatgttgcttttgcacctacgggggcatctgagtccagctccccccaagatgagctgcagctcgcccctgagtt

SEQ ID NO: 629103 - DNA, 215 bp, Homo sapiens
gcggtgtggctgggaaaacccctgtgtggaggcacttctcgcttgtattgtgctttgctttatttacgtctggccctcattgcgtgtttttacaaaatcaggttagtgacaatcctatgacaagcaagtctcttggactcatttttccaacagcatgagctcacttgggctcttcgggcccacttccggtaattcatgcaaaatttaaacctttg

SEQ ID NO: 629104 - DNA, 174 bp, Homo sapiens
tatatgtttatggaggtaagatgctgagttggttccatacacatatgtgaagtgattaaatcagctaagttaacatattaatcccctcaaatacataccacttcttgtggagagaatatttaaaatcctttttttttttttgggaaaggaagcctgggggtgtggccaaggcgg

SEQ ID NO: 629105 - DNA, 461 bp, Homo sapiens
  misc_feature (2)..(2): n is a, c, g, or t
  misc_feature (13)..(13): n is a, c, g, or t
  misc_feature (390)..(390): n is a, c, g, or t
  misc_feature (404)..(404): n is a, c, g, or t
  misc_feature (408)..(408): n is a, c, g, or t
  misc_feature (430)..(430): n is a, c, g, or t
  misc_feature (449)..(449): n is a, c, g, or t
  misc_feature (454)..(454): n is a, c, g, or t
anttcggcacagngaaagtttacagcaactgtatagtgagtacagtcagattatattcctgttcctcagatttaagaatggggtcacattatagagcttctgtttgcaatgacatactcattctgccacagtcatcttctagaagctttattttcctgggatgtttgaaaacccaaaacacttatattgcagttgagtattgactctgcttcccaaattaatcccagatgtttggggatcacactagacaaaggcagttcaagtcactgagtaggagtaaaacctttgctggattcccttgcaggaagtgttaggaatccagtgatctttaagatcttttgcagctgtttgtgggtgggctcatgcctgttaatcctaggcactttaggngacctagggggggntccnttgagggccgggggttttgagnaccagccgggggcaacctnggcgnaacttgg

SEQ ID NO: 629106 - DNA, 661 bp, Homo sapiens
  misc_feature (491)..(491): n is a, c, g, or t
  misc_feature (587)..(587): n is a, c, g, or t
  misc_feature (645)..(645): n is a, c, g, or t
cggcacgagcagaagacaagagccaatattcccagaaacggagtggtcagatttccttaaaaaatgtgcagagattgtgtttctggagtcgagggctcaagttaaaagcaaacaaaataccacaaaatatataacaatttgtttttttggaggatttgcgattctgaatttggatccagttctcttaaatacacattgaacctcataggacatggctcttcaagtagaaatgtattaatagaagcctcatttatagctgttcaaagaattggagtgatcagtgctttacttattacttctgactaaactctgcaggtgcagcttggcaatcaacagagatccaaagtagaaagacagtttcatgaaaataacctgacctctccgactggttgactttgtgggaataaagactggtttatgctgatgcatgtttttagcaatgcctttcttcgtaccttggacatagttattatgcctgggggaagagagtnccacgaagctgggatgccatgagccaccccccttgctgggcaccaggttgatccctggcctgctctgggttgctgaatgcgatccttcaagcactngtggagatgctgtaattttcttgggcaatgtgagtttaacttggagaggttatgattngaggccctgcttgctt

SEQ ID NO: 629107 - DNA, 642 bp, Homo sapiens
aggattacaaagctcatagtccccccaaagcttcttctgctgtactttagcaaagtcttagcatacaaaatcaatgtgcaaaaattactagcagtcctatacatcaagtcaagcagagagtcaaatgaagaacacaatcccattcataattgctacacacagaaaaaataagatacctaggaatacagctaaccagggaggtgaaagatctctaggagatctctagaagaattacaaaacactgctcaaagaaatcagagaagacacaaacaaatggaaaaacatgtcatgctcatggataggaagaattaatgtcattaaaatggctatactgcccaaagtaatttacaaatgcaagttatccctattaaattaccaagggcattcctcacagaactagagcaaactatttcaaaattcatatggaaccaaaaaaagagccctaatagccaagcaatcctcagcaaaaagaacgaagctggaggcatcatgttacccaacttcaaaccatactacagggctacagtaaccaaaacagcatgatactgatacaaaaacagctcatcatttggagctatgtatcttcaatacccagatttctcagagtttaaatatggagaggcattgaatttatggaagcct

SEQ ID NO: 629108 - DNA, 137 bp, Homo sapiens
atcaatactatccttaacatctctcaaatatacccactaattcttccctcatctactggtgccctagacctaaacctacttatcacatctccctagacaacagtagtagacctcattcacatggagcaagtatttat

SEQ ID NO: 629109 - DNA, 329 bp, Homo sapiens
tgcacacgcttgcgctctttcactcggttggttcctcctgttgcctgtttctcttcctgccgcagcctcagtttcttctccaagtcttcgtcgtctagaagaagactaaccacctctattgggtttcaaggtatcttggtttgaagttcaccacttgaacatcacatcctgctgaatctcactcttctccttgtgctcttttgcaggaatgcgttcttcaatggtgccgtttcaccagcatgcagccggtaccaccagtaaccttgctgttgtcttgcccgtaagctggtgtgccatttggatcccaacccgtgcaagtttgcccaaat

SEQ ID NO: 629110 - DNA, 1373 bp, Homo sapiens
  misc_feature (701)..(701): n is a, c, g, or t
tgcaggcagtggtgaggagcgcagcgtggcggctgagcgggagtgcactggcctccagagcccgtgtgccaaggcggtgcctcgcgggcggcgacgtgagcctgggatctggtgcctcagctgttctgggtctggatgactgatggccatggtctccagctgggtgtggactgtgcccaccatgctgcctgaatggccaatgactgccatgtgtcctggtgtgactgtgacaatgcagtgacatgacatggtccggtgtgacggcgaggacagagtgaggctgcgtcctggccttcctgaacaccttaggctggtgtgggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctcgaaggtgaagcgagaggaaccagacctcatcagcccaacatcaaagacaccatcggaacagcagcgcccgcagcacccaccccgcaccggcgactccatcttcacggccacccctgcggcggacggttgaccaccagccaccacatcatcccaagagctgagctcctcnagcgggatgacgccgtccccaccacgctccctcttcttctttattcatcctatctgtctctttgtttctgagctttcctgtcttaccttttttctgagagattcaaagccgtccacgacatctgtatatcccccggtcccttctgaatttaacttggcactaagtcatttgcacatggctggacgtgtggagacggccttgagtctcggatgcgaggtgtgcgtgagatgtgagaccaccttggccagtgcctgacgcagggcccggacgaacctaccatactgggccgggtgactgggcgccggctgtgtgacacgaggacatcaccctgacctcgactagtctggaagctccgaacgacatcacggagcagccatacaagcgattccataacgccccatctcgactcatgatgacccgtaccacaacaagggacttcaggcagcgaacgcccctgggaccgtcaatccatcgacatacaacgcagcctgggtacccaaggcgacacaacaaacaaaacagaagacagaggggagcaggagcgcagcaacaaacaaaagaagtccccacaaaagggacgaccgacaagagacacacacgcagaaaacgcccgcgaataacaatggcaacaagaagggggcaccaaaacagcgcgcgccgcgcaaatgccag

SEQ ID NO: 629111 - DNA, 183 bp, Homo sapiens
agattgagaaactagagacaggaacaggaagtacgagtatattataaagggttaagtaaaacaagatatgcacttggaaaatcattgtcttttagatagtgcttgtgctttttgtttgtttggctggaatagagacagggacttgctctgttaccctggctggagtgcaatggagcaatttca

SEQ ID NO: 629112 - DNA, 1023 bp, Homo sapiens
  misc_feature (351)..(351): n is a, c, g, or t
agtgacagggatcattgtgcatattcaccaatagttgaaatgaaggaaaaaatgttagagggcagccagagagaaaggtcgggttacccacaaagggaagcccatcagactaacagcggatctctcggcagaaactctacaagccagaagagagtgggggacggtattcaacattcttaaagaaaagaattttcaacccagaatttcatatccagcccaacatcaaagacaccatcggaacagcagcgcccgcagcacccaccccgcaccggcgactccatcttcacggccacccctgcggcggacggttgaccaccagccaccacatcatcccaagagctgagctcctcnagcgggatgacgccgtccccaccacgctccctcttcttctttattcatcctatctgtctctttgtttctgagctttcctgtcttaccttttttctgagagattcaaagccgtccacgacatctgtatatcccccggtcccttctgaatttaacttggcactaagtcatttgcacatggctggacgtgtggagacggccttgagtctcggatgcgaggtgtgcgtgagatgtgagaccaccttggccagtgcctgacgcagggcccggacgaacctaccatactgggccgggtgactgggcgccggctgtgtgacacgaggacatcaccctgacctcgactagtctggaagctccgaacgacatcacggagcagccatacaagcgattccataacgccccatctcgactcatgatgacccgtaccacaacaagggacttcaggcagcgaacgcccctgggaccgtcaatccatcgacatacaacgcagcctgggtacccaaggcgacacaacaaacaaaacagaagacagaggggagcaggagcgcagcaacaaacaaaagaagtccccacaaaagggacgaccgacaagagacacacacgcagaaaacgcccgcgaataacaatggcaacaagaagggggcaccaaaacagcgcgcgccgcgcaaatgccag

SEQ ID NO: 629113 - DNA, 983 bp, Homo sapiens
  misc_feature (311)..(311): n is a, c, g, or t
cggttcggtatgggtgctgcgggcgctgctgttccgatggtgtctttgatgcttgggctgatgaggtctggtccctctagcttggaaatgaatatgctgcactttacaaccactgcactacctgactcaggaatcggctctcgaaggtgaagcgagaggaaccagacctcatcagcccaacatcaaagacaccatcggaacagcagcgcccgcagcacccaccccgcaccggcgactccatcttcacggccacccctgcggcggacggttgaccaccagccaccacatcatcccaagagctgagctcctcnagcgggatgacgccgtccccaccacgctccctcttcttctttattcatcctatctgtctctttgtttctgagctttcctgtcttaccttttttctgagagattcaaagccgtccacgacatctgtatatcccccggtcccttctgaatttaacttggcactaagtcatttgcacatggctggacgtgtggagacggccttgagtctcggatgcgaggtgtgcgtgagatgtgagaccaccttggccagtgcctgacgcagggcccggacgaacctaccatactgggccgggtgactgggcgccggctgtgtgacacgaggacatcaccctgacctcgactagtctggaagctccgaacgacatcacggagcagccatacaagcgattccataacgccccatctcgactcatgatgacccgtaccacaacaagggacttcaggcagcgaacgcccctgggaccgtcaatccatcgacatacaacgcagcctgggtacccaaggcgacacaacaaacaaaacagaagacagaggggagcaggagcgcagcaacaaacaaaagaagtccccacaaaagggacgaccgacaagagacacacacgcagaaaacgcccgcgaataacaatggcaacaagaagggggcaccaaaacagcgcgcgccgcgcaaatgccag

SEQ ID NO: 629114 - DNA, 1096 bp, Homo sapiens
cgaaccgccgagggagggagggaagcgttttttagaggacgttgggtgtccaaaacaaatttttgaacatgcagtctcaccctgacagcaagtgcattgaaaataccaaaagcctcttcctttcagaagccaggatgttggccactgaatattggagaagaaacttaatccagaatagcaggtacacagagctcctaactgggcaacaagaagaatactgacttggagactggggaaccgtaacggaaagggagtagagaaagaactgtttttttttaacagaaggagagagaacgctgatgaggggtgtcggtggagtttacaatctatttatacatgcagccgcggctggggagttgctgaggaaatcgagaagtataagcgcggctggtagcaagacgccagcccacgctatgtacccactaacaaatcaactgtgccgtatgtgacacgtcactcaccacacacctcccagccacgaaaagacgtatggtgtacatcatatagtgtattggatatgttccccaacgtcacagttgacggtatagtcaggacccgtcatattactatgagatatcactagagtcagataaattatccaacgtttgataacaatcagtctaactttgatactatttaccaccctactttcgttgcccgcggagcatatgacatacatactatagtaacacaatagttcgacttccatcaatgagacagagcaggaggggcacgttcagtctgaataccgtccacccaccacacacaatgatatgcgacggacacctgggttgtcaccccacgtgctcgttgtgtgtcgtctctgtgctcgcgaacacgtcgcccagcacccatgagagttatggcggagccagattgggaacgcagatcgacggccgatatgattgcctgaggttttgcaatcctctgctccctcgcagtgtgtcaccaccacatcttcacactccaatgcatatcttatatgatcaccaccacacttttttccaattagtatcgcacagcaccgtaagagattcgcatcgacagtctacaccaacactctcaccactatgtattgtaaccacacaacccgcgt

SEQ ID NO: 629115 - DNA, 332 bp, Homo sapiens
cgtctctacaggatcccggttgcgccatgtttcccccacagcctgcaatggtcaggcacagtcaggtcccactatggcctgcccaggtccatgtcgtcacagctctgtgctgagtccttcgagccaggctggcctggttgctcgtccagctgtccgtatgctgctgtcaccatcccttctgtctacagcgctcttgccctgatgcctagtgcgctagttgctgcgcctccttgtgttcgcatgttttatttcatcttttgagacctccctgtccattgcacttatatactgggttctgccccgtggtgctatacatggtctacttagtcttc

SEQ ID NO: 629116 - DNA, 892 bp, Homo sapiens
cccgaactgagacgaaaccggtctctgagcaccccttatccgcagacgccccgtggtggcagcccgggccactgtccccgaagatacccggccgaggtcacacccctcccggagctcccgttccgtctcccgaatgccccgtccgacaagggacaagagttccgggctccccacaccaagagtaagtgcccggcctgcaaaacggggaacggggcgggaacataagcaaaggcgggtccacaaaaacacctgcggagataatggaaaagcttgtcctttggaacaacaacccgcccctcggttttcccgcgacgcagccaaagtcgcctaccaaggcgaggcccgggtgtaccacgggttggccgcaccacaagggggcaaagcttatatcccccgggccccgataatgctactccgtgcacccccccccacaagatggggcgggggagactagatatctgcgcccaaaaagagcgccaaaggcgctaatggataggaaacaacccttgtctccctctcggcccaccagaggccgccaccactcccgccccaggggcaggccaagggaacaccccacttctcaaaagaggggccaccccgagaggccagttccaacacaggcggccagcagcacaaacaaagcgctcctcgctcgggaagccccccgggaacggttgatcgccgacgaccactgtttaggcgcacacacaccacacaggtgttgacacacggcccacgagagaccacccgagctgggcagcaaaacccaccgctgaggctgtgcaggcggcccccggagaccctgaggaccctccacttcggggataaacccccttttctgcccccaattttttatggggaaaaaaaaaaacccccaaatagggggcaaaaa

SEQ ID NO: 629117 - DNA, 612 bp, Homo sapiens
  misc_feature (29)..(29): n is a, c, g, or t
  misc_feature (38)..(38): n is a, c, g, or t
  misc_feature (57)..(57): n is a, c, g, or t
  misc_feature (148)..(148): n is a, c, g, or t
  misc_feature (188)..(188): n is a, c, g, or t
ttgaacccctcttgtcccctttccgcttnttagcagcntcacttggcaaatttaccnggggacattggcggatgtgcactgctactggacttctactatggagatgtcatctgggtgattctcagttttggaggtgggtggacttttngggagttaccgcagcagctgtcatctttttgaaacggganttcaaccacacagccaccattcgcaaggtggagggaaacttcaacccgtttgcctctccccaaaagaaccgacaatcagatgaaaacaaccttaacaggaccctgggggttccgagttcgactcgatcagcaaaaatacatgggctcctgttcctgagcaaagcgagcaagatcaggatagactgtcacagagctctgtaaatctgtcccccagcagtcccgcaaacaacttatcagtagtgacttacagtaaggggctccacgggccttacccttcggccagtcttaaacgggtgtcagcaagaagaaaaactaacaaaagacagaaggcctgactttggggggagagggcaaggggttcctctggattgcagaccacatcgcacggacccctggctcagacccccacctaccccccaatcac

SEQ ID NO: 629118 - DNA, 198 bp, Homo sapiens
catgccattgcatgcgtcagtgcttccttcctttgtattgctgaagtaatatccaatgtgtacccaacaacattgtatcagttcatcagctgctgaacatggggatgttgcattggatattatgaacaatgattctgtgggcatgtatgtgtgcataataacctcactgagaattcagtggactagtagtagtagtca

SEQ ID NO: 629119 - DNA, 80 bp, Homo sapiens
ctcttgtccaaatatcttcaccttccaagtctcaccggcggagcccacgaaccctgggggagggaaccaccgataaactc

SEQ ID NO: 629120 - DNA, 424 bp, Homo sapiens
accaggccagggtgtgacccattgctctgccatcaactctcaatgcaactggggggtgcaacttcatctctctgtgcctgtttcctcctccagaaaaacagggtttcctattgaccctcaagaattgttgcaagggctcattgagagaacaatttggccgggtatgatggctcatgcctataatcccagcactttgggaggctgaggcaggtggatcacctgaggccaggagttcgagaccagcctgaccaacacggggaaaccacatctctaccaaaaaatacaaaattagctggatgtagtagtgcacacctgtaatcctggctacttggaaggctgaggcagaattccttgaacccaggaggcagaggttgcagtgagctgagatcacaccactgcactccagcctgggcaacaagagcaa

SEQ ID NO: 629121 - DNA, 347 bp, Homo sapiens
catcccatagatataataatatgtcagctgggcgtggtggctcacagcactttgggaggcagaggcgggcggattacctgaggtcaggagtttgagaccaccctgaccaacaaggagaaaccccgtctctactaaaaaaacacacacacacacaattagccagggttggcggtgcatgactgtaatcctagctactcaggagactaagccaggagaatcacttgaacccgggaggtggaggctgcagtgagctgagattgctccattggactccagcctgggcaacaagagcaaaactctgtctcaaaaaccaaagaccataagaaggctcaagaaacaaaacatgt

SEQ ID NO: 629122 - DNA, 158 bp, Homo sapiens
tctgatgtcccaggctactcccgtaccccagacctggcccatatggagtagaagaaggaggggaattggcatggccaagcgagtggctacagtgaagcactgtggggtgctgggagcgcaacatgcacaataagcccctttagccaaaatcccaggat

SEQ ID NO: 629123 - DNA, 414 bp, Homo sapiens
agtaggatggctataatactatatatattttaaaatagaaaggaaaattacaagtgttggcgaggattgtggagaaattgaaacccttacacattgctgttgggaatgtaaaatggcgcggccactgtggaaagcagttcggcagttcctcaaaaggttaggcgtacagttatggtatgatccagcaattccacttctagttatatacctaaggtcacacaaaaacttgtacaccagtattcagagcagcactattcacaatagcccaaaggtagaaatacccaaatgtgcatcaaatgataaatggataaatagaatgtagtatatcctacagtgagaattgttcagccaaaaaaaggcgtgagatatcagtacctgctataacatggatgaaccttgaaaacattatgttaa

SEQ ID NO: 629124 - DNA, 366 bp, Homo sapiens
cggggaggctggacaggaagattgagttcagcttacctgacttagagggtcgaacgcacatctttaagattcacgctcgctcaatgagtgtggaaagagacattcgatttgagctgttggcccgcctgtgtccaaacagtactggagcggagattagaagtgtttgcacagaagctggtatgtttgcaatccgagcacggagaaaaattgctacagagaaggacttcttagaagctgtaaataaggtcatcaagtcttacgccaaattcagcgctactccccgctacatgacatacaattgagccccagggctctgagtgaaagaacttcctgtgcttttgtaacttgttgccaccgcacaaaaat

SEQ ID NO: 629125 - DNA, 487 bp, Homo sapiens
  misc_feature (325)..(325): n is a, c, g, or t
cacgaggactgttctcttgcccagcctggagtgcaatggtgtcatcttggctcactgcaacctctgcgtcctaggttcaagcgattctcctgcctcagcctcccgagcccctgggattaaaggcgcccgccaccacgcccagctaatttttgtatttttttttttttgaaatggagtttcactcttgtggaatgtgatggcacgatttcggctcccacaacctccacttcccaagttcaagtgattctcctgcctcagcctcccgtgtagctgggattacaggcacgtgccaccacacccagctaatattttgtatttttagtanagatggggtttcaccatgttggtcaggctggtcttgaactcccgagctcaggtgatccacccgcctcggcctcccaaagtgctatgattactggtgtgagccactgcgcccgaccttttttgttttttttttttttttgagacagagtcacgctctgtctca

SEQ ID NO: 629126 - DNA, 161 bp, Homo sapiens
tgaggatttccgactagtacaagcatactggatggttgcttcatctatgtggcgggcgcgcattgcgtctgggcgctttaatacccaggtgggactgccgacaagcgctacttcattggactggcagtccggctgcgacgggtgtggtagccggtattgtc

SEQ ID NO: 629127 - DNA, 420 bp, Homo sapiens
  misc_feature (26)..(26): n is a, c, g, or t
  misc_feature (50)..(50): n is a, c, g, or t
  misc_feature (152)..(152): n is a, c, g, or t
  misc_feature (187)..(187): n is a, c, g, or t
  misc_feature (190)..(190): n is a, c, g, or t
  misc_feature (222)..(222): n is a, c, g, or t
  misc_feature (384)..(384): n is a, c, g, or t
gtcgtccttctccctccctgaaggcngcctcgcttgcccagtgtgtcggncgccgcgaactagagtccactgacttttccgccaccatgttgcccgcctcactgcttcgtcaccgggcctgcgcgcctgatgcttcaggcgctgtacatacncgaggccgccgctgcaccatgcccccgccgcaggnccnggacagatgtcattcacctttgcctccccgangcaggtgttctttgacagtgccaacgtcaagcaagtggacgtgcctacgctgactggagcctttggatcttggcatcccatgtccccacactacaggtcctacggctgggctggtagtggttcacacaagaagactggaccacgactaagtactttgtgaanagcggctccgtcactgtgaatgccgactcctctgtg

SEQ ID NO: 629128 - DNA, 139 bp, Homo sapiens
atggacatagacagggacttcactgaggagtgacctttggcacacgactacgggaggctgacttgggacagctgttgggtgagacggtggggtacgatgaccacacgaccctgaacctgtttacccgtttactccctga

SEQ ID NO: 629129 - DNA, 1303 bp, Homo sapiens
  misc_feature (608)..(608): n is a, c, g, or t
  misc_feature (866)..(866): n is a, c, g, or t
agcggaattcgggggcgggtttgaagacgcgtcgttgggtttcggaggccgtggaaacatccgtatgatggttagagctgccgggctggcaggaatcgttctgtcacgtggggccgcgcggacagatcaagggaggcgccggcctgttagcgatgtgtgtccatggagttgtcaaatcgtgcattaccgctaggtagagccgagtctgctagcaggcaatcccggtgccttgcagaggctcgtatgcactatgtaacgtcgaccggtgcacgactcatcctggaggggtacctgtggtcaccatggtaagtaaaacctgattgcactgagggacacttcttgtctgcactgtgtgaaagcttgactgtctatcgcgaagacgtcctagtgcacgagcgtggtcagatctcacttcgagctcatgcagagtcgatcgagtgagattgacctgattcagctgctgttagcatgacatcgggcctcgcatgaatcgtccgtgggtgctatgctttttctcgcacgttctcgtgttctgcgtgtaactggttttgagtagaattcgacgtttacagattgggcatgggttctctatgcgaggcgaactcttnctatactcaacgataggggttgaaactgaattcccccattacttacttggtttaccccgcaggcgttctgtctgtacctgtcggttccgtcaaggttgtgccgtgggttttgcctaatgagcttcgtcatctacgctagtattggcgcaaaagcaaatctacaatgcacagttatcatcgggaagtcatatctagcccgtgaagtatattcccctttaacaaaaaggaattgaactccttacctggggtcccttttgngtaggtcgcaaggacatagtcccctcacattggttttcaagtccagtatcctttggtttggtttccttttgtggcctcttaatttcaagtccacttggaatgaagatgggcttgtaattacttagattcacagcgtggatagagtttttggcgaaaccatatggcggtagataaataacttagcgaattcaaacgcaagaatcggtaaataccgcgtgtccccggggagaggaaaatcagcgcttgtgtaggttaaccccgtgaggcggttttttgataacagccaaacctttcgcgtacaagttaacgggtttttgggagcaaaatcgcattatagggagaaactggggcccgtggaaaaccacttgcccttgaaacaataggggataccacgcaaacactacctttaaatttaaccctgagccgttgtaaagtaa

SEQ ID NO: 629130 - DNA, 823 bp, Homo sapiens
  misc_feature (570)..(570): n is a, c, g, or t
ctgtaacttccagagatattgccgccagtgtgggaatttatatctcccttcatagcttttagtgcggacattcacgaattcccaccctttagggtgatgctacttgagggagttccttgttcgctggttgaaagattgccttaatgcttgctgtccctgcggttctcttaaacggctcttcgagtctctcctacaggatcttgggattgtcaggtcaacgtgatttgcgtagtacttttcccctctagttgatctttgggaagagtaggtggattgctcataggtcccgtcaaagtctcctcaggaggaaacatgctgttgcccagcttgctgcatgttcccagctccggtcagctgacatggagtgtgcatgcccctagccatagcctctcccatagttcaacttgcattctttaacagggccactccacagggtcacgcagtggccatcacttacagtccgggtggagcaggcgcgggccgaacccgggaggagagtgtcggggatccgcgaaggagcctcctggggatggggcgggggatggacaaagcgctgcccccggctggacncgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaa

SEQ ID NO: 629131 - DNA, 720 bp, Homo sapiens
ccaggtctactatgtggagatgaccgtaggcagccccccacagacgctcaacatcctggtggacacgggcagtagtaactttgcagtgggggctgccccacaccctttcctgcatcgctactaccagaggcagctgtccagcacatatcgagacctccgaaagggtgtgtatgtgccctacacccaggcaagtgggagggggaactgggcaccgacctggtgagcatccctcatggccccaacgtcactgtgcgtgccaacattgctgccatcactgaatcggacaagttcttcatcaatggttccaactgggagggcatcctagggctggcctatgctgagattgccaggcccgacgactctttggagcccttctttgactccctggtgaagcagacccacattcccaacatcttttccctgcagctctgtggcgctggcttccccctcaaccagaccgaggcactggcctcggtgggagggagcatgatcattggtggtatcgaccactcgctatacacgggcagtctctggtacacacccatccggcgggagtggtattatgaagtgatcattgtacgtgtggaaatcaatggtcaagatctcaagatggactgcaaggagtacaactacgacaagagcattgtggacagtgggaccaccaacttcgttgcccaagaaagtatttgaagcttgccgtcaagtccatcagcagctctc

SEQ ID NO: 629132 - DNA, 573 bp, Homo sapiens
  misc_feature (320)..(320): n is a, c, g, or t
gagcggcctgggagcccgcacccgtctctggtgccaggcgttgtcgtggggtcccaagagagcggggtggggaaggtgaagggagcgcggctggaaaaatggggattagggtggcggaacaggcacttgtcaggagtgaagagacagcggagagggtactgggctgaattctttcgtgccgagtcaggtccctccggttcccaactcacccggggtggagcaggcgcgggccgaacccgggaggagagtgtcggggatccgcgaaggagcctcctggggatggggcgggggatggacaaagcgctgcccccggctggacncgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaa

SEQ ID NO: 629133 - DNA, 1033 bp, Homo sapiens
aatgtgcctagtaaaatcgcaagtgtgtgtatcaatggcttactaatgacttttcctgccgtgctggtacaacggtgctgcatgagatgcactctagattggagccttcacatcatagatattatgtgcttcagtgttagtaggtcatctagagacgctcggttatagtggaggtcattagccttcaggacgtaatatgagtattcaacagggtgtcacctactctataatctcatgcctcttggtacctctagcctcaagcttgatgagcagtaccgcacaacgtgttgaccgtgttgtcatctacatcaaataatcaacaggaacattgggaagagcgttattatccataataaatgcattagagccggctgcagcataggggtactataagtgttcatgctctcgtaagaacatctatgtagtacaaccttgatagtggctacaacccaggcacaacttgtctgccgtacataaatgcagtgtgtctatacctagtcggttataatctgactacgggtactctgcggcctttttgtggaagagaagtcgttcgtatccaactcagtgatttaccgcaagtatagtaattaggggtacgtattatgagcatggcggatcctcacgtacacctcgtaatagacgtggtgacgctcgcggtaggaagtccgaaagatgtgctcctgcctagtaaacggcatttatattgctttgagcaactcgttaatgcttacccatcaatctacttgaccttctcttgaatcacgtcagtacagtgcaatgtagtgcgagcgccatgcgaagctaggatgtagaagatagcgcagaagtaggtgaaccacatgggctcatggtgggtgactccgactgtacatcctcttgggatggtccgtcctggtgggaccttgggtccacactttcttccatagtacacctaggcagagtgtttccatgctaatgggttaaagaggtcatcgagtttgttccccacaattatcttgtatgaaaaccccctgcaataaaaccttgcgaa

SEQ ID NO: 629134 - DNA, 162 bp, Homo sapiens
aaaggccttgcatggtctaacaattgcccctgcgttactgtcacttttgggttgcaaacaggaagatattgatagcggcacagtagggttgataaatacccccaaagggtgctggtgacccagcgagcgcgatgcacgggttgccaccgctgtgaaatctct

SEQ ID NO: 629135 - DNA, 388 bp, Homo sapiens
  misc_feature (30)..(30): n is a, c, g, or t
ttggatcccacaaagcaatgattctaatancaaaaaataagaaaggaaagtgaagggatgtgtgtatggcccaggggcctgggagggtggggtgggggacagcctgtatccacaagccatccccagttcagtaacaagatggggctcgctgtctccccacaccccgtcagtgtctgcccagcacggtggagccacactgttcaacactgaaatatgtatcctcagtcccatttggtttcttctgaaagagacagtagaacatgctaacgttttagtaccagagaggagggagtccttgcacccaatcttgagcatcccactgcttaagcaggtgccaagccactcaggtgtgtcctgcagcaattagcttggcattacagtaacactt

SEQ ID NO: 629136 - DNA, 226 bp, Homo sapiens
gcttacccatcagcatacagggatcacttagaggccttgggcagcaactgggtggggaagctgacgaacttaagggcttcggtattggcaccagctgctaagcacattggacatgctggcaaaggagtaccggtacatgggtgccccattccggggcttgcttgccgagaacacaggagaggccaggcacaatcagtgccagcactcggttcattagcaccaggaa

SEQ ID NO: 629137 - DNA, 852 bp, Homo sapiens
  misc_feature (43)..(43): n is a, c, g, or t
  misc_feature (49)..(50): n is a, c, g, or t
  misc_feature (61)..(61): n is a, c, g, or t
  misc_feature (65)..(65): n is a, c, g, or t
  misc_feature (71)..(71): n is a, c, g, or t
  misc_feature (86)..(86): n is a, c, g, or t
  misc_feature (96)..(96): n is a, c, g, or t
  misc_feature (145)..(145): n is a, c, g, or t
  misc_feature (155)..(155): n is a, c, g, or t
cgaagaaaaaaaaaaaacagctaaacacttaaaaaaaaataanggaaanncctttatggtncacnccggancaagttaaaggggcngaacccacgngccgggggagaaaggccacctactcgttacgggacagcgctgcgcgganccacgcggcnggcagagcgcaacccccacagggcaccgcagacacgaccaagcaggccagccgacaaaagcaaggaaccaaacaaaaaacagaaagacacgacaggaagaccgacgacgcagaagcgacccagagactttttttttcaccaagacccaacccccaaagccaggagcgaggggactaacagcgcaccccctccaccagggccgacggaaaccccggtaaaaaccaaaaaacaagccagcatacatcgggagaaaacctactgttaaaaatcaaacaattagcaaatgtatatttgtcctccaacatacaagacacacacacaccggaaaacaaaaggctaaggaaaataatttccaaaaaaaaggaagaaaaacacacccggagattcgaatcaaagccgccgcacattcgcttgcccaagagcacacacacacacaacaacaaataacccacacccaaccaaaaacacctcacagcaacccccaccaaaaaagacaccaccgtcgcatcggagcctcctcgcaaaagacgacagacccaccaaaacccacagagaaagaacgggagaacgagaacgaaccccccgcacaaaaaacaacaaaacaccaaccgagcttacacccacgaacaaccgacgcgaagacgacggcaagacaaaaagaagacagaagagaaagcaagcacgcaagaagcaaaag

SEQ ID NO: 629138 - DNA, 305 bp, Homo sapiens
gtgtgatctagaggatccctttttttttttcggcttttcacatttcacattttaattggattaaacataagattaaataaattaatataatttcaaaaataatataacgggcataacaatggactctggataaactttcaacctaagggtatgtttaacagaggaaatgaagagcaacaatggactctatacatcagtaaagcggcaatgcattagaacacacccaaagcctcaaaattcccacaccctatgacttagcaattccaccttttacaaagtgtatcctaatttcttcccaacttggg

SEQ ID NO: 629139 - DNA, 131 bp, Homo sapiens
caaaaccccaggggggggggggcggggggggggggaaaacccccccccccccccccatccccccccgggggggggggggaaacttttgttttttgggggtttttttttttggaaaaaaaaggttttcccca

SEQ ID NO: 629140 - DNA, 123 bp, Homo sapiens
atgcacactggagtgagttcccgctcgtgccgcattgcttaatcgaattcgactacgaacgatgcaggtagcgggttcaatccctgtccctttctcagtgggttccttctccggtggcgtggt

SEQ ID NO: 629141 - DNA, 791 bp, Homo sapiens
gcagtagtcctcgaagaaggtacaagtgtcttctaaaatactgggttaaaaacaggcacagaagtttacagacagtattgggagtctttgactgtgcaaaatccacaggaagtgatgatgaacagcagtcaacgattcaagttgaagcaaacgaggtccttatacgtacagagttcgtcttctagccaaggaaatactgtaacccaggacgctgagtgacaacacagtctctttcctggcagcccaatggtgccatcttcgaaccttcactatcagttggaacagaggctgacagacttcagcagtgtctcagtctgggctgtgggcagctgtcagtcccgatgatctgatcgaaaatcgagattggttcaaatggatgcctcgaagttcacgttattaggcaaggtcaatatcttgtatgttccaagtcagagactctggagagagactgttatggggctatagggatccattagtgagctttggtgccgtgacccgtgttactaccacagttggtctgttatatccttacgacaatactgcagatggagtttatagagtttccaatggaacaagatagcataagtgaccgttgccataatcgacacatatcaaggtaaaaggaatctgtcctattgggagagtcactgcgacatgattaatggtacagatgcagcctcatttccaccgtttgtggagaaaagccaggtattgcagttctttcttcggatattggccggtcactctatgcgtgtattggaatccgacgttaatcgtgaaaggaatccctg

SEQ ID NO: 629142 - DNA, 336 bp, Homo sapiens
aacagtgatgctcaagggctctccaaaggaggcaggcttgtgtggaccccagagggactcctgatcaggttagaaggacgtggaaagaatactacctgcaagccgacgagagaggcctggagcagatccttccttcacggcactcggaagatgccaagcctgccatcttgattttagacttccagcctccagaactgagagacaacacgttgtttctgttgtttgagccacacagttggtagaactgttaaagtagctccaggaaactaattcagtgactaatgttttcgaacagtctttgtgcattttaaataaacatatttaatatattacaaa

SEQ ID NO: 629143 - DNA, 443 bp, Homo sapiens
taaggtttatagtatacatctttatcttattacagtctttgttcaactgatagtatattgccacttcacacatagtataacaacattatgtttcttcctttccagctttcatgttgttatcatacattttacttgtgcgtatgcaataaatcccaaaatacatggttactatttgtttttaaatagttaattatatttaaaagagattaaataataagaggaggaataccttacatatatacccatgtaattaccatttcctttgatcttcattcctttgtgtgaatctatgttttcatcaggtatccttttcctttggtggtaaattttttcagctttcgcaggtctgaaaaagtctttatttcactttctttttttatacgtaaaaatttaagacataacccatacatataaattacatatgtagtttattccataaacaa

SEQ ID NO: 629144 - DNA, 313 bp, Homo sapiens
agaggacggagaggtagagaagaacaactaatggcactaggtttaatacctggttgatgaaataatgtgtacaataaacccccaagacatgtgtttacctaggtaacaaacctgcccattctgcacatatacccctgaacttaaaagttttttgttttttgttttttttttaaataaggccaacagatgaacatctcaaggcaacccatattttaagtcattttactgtgaggaccctgacccaggaaagaaaagcaattgctataaaacaggtggcccactgatctgcaaggaacccacgcgggtaccgagc

SEQ ID NO: 629145 - DNA, 368 bp, Homo sapiens
agttacaacagctccagttacaacagctctcccaggttcatgccatccttctgcctcagcctcctgaggagctggtactacaggtgcctgacaccatgcccagctaatttttttgtatttttagcagagacggtgtttcaccatgttagccaggatggcctcgatctcctgaccttgtgatacgcccacctcgggctcccaaagtgctagaattacaggcgtgagccactgcacccgggccctctgatttttaaatgtgtaactaaattaagaaatttttaagcccaggcaggctgttctcaaactcctgacctaaagtgatctgtccacttcagcctaccatagtgctgtgattacacgcgtgagct

SEQ ID NO: 629146 - DNA, 334 bp, Homo sapiens
tcagtagcacatggggtgatgcagtgcctcccgggacacatgagctagatatagcttactggagtcggctagatagggctgggggcatgcctactggagacagttcgacagcaatgtctgccagccgggcgggagagctcctccaggctacagtcgggttcccagtcccagtccataggtagagcctccttcggatccgggcacgcatgtcgttctggtgtcctgggaggaacggtgaagtcctggaatccggcgagggagaaggtgccttctacgtccagcgtcgcggatcgcaggggactcctcgtcggagctcggacctgccggcagtgcc

SEQ ID NO: 629147 - DNA, 477 bp, Homo sapiens
acatgcagcaggaatgtatcaaccttgaccatgtactatcctgaagcaaaaaaacagcccgtaatacttgagcagtgcgtaatggtaatagcgagtttgtagtcaaacttgctagtaggtctgcttaaggatctagcccagtccggcggctgccgtctaccagcctccccatcagcgtaaggatacctacctactaggtacctataaggaagtaatagtcatcgctgtccgaggtgtcatacaccaggttgttggcgaacatactcctgaggaaccgcacgggctccagccacgactcgatgagcagcagggagatgcggagcacctctagattggatttctgttgcgttacctccatgttggagggtgtcggaatagagtctgagaagcaaaacgaggtctgggagtcatgcaggaatgaatactactggtcctttgggatataggttacttcaaactcctccttggtgcctctag

SEQ ID NO: 629148 - DNA, 101 bp, Homo sapiens
agctcggtaccactcgtgcaggaggggctgacttttccttttggagcgaacaggatcttttttatcttctttcaaagtagcccaaattgaaaagtaccctg

SEQ ID NO: 629149 - DNA, 419 bp, Homo sapiens
gagaatccccccctataccagaccaagacactatactcataccaacaggctacgacatgtatacattcttacgcatgccataataacaggacaactagctatgtgtcttacacctacacaagtctagaatgtagattacgctacaaatctaggtatacacagatgtgtacaaagagctaggtaggtaacaatctagaagcaatctgtgtacacgagtgccacaaagcattcaaaagaaaccaatttaatgccaccaaacataagcctgctatacctgggaaataaaaaatctcacacctaaatcctagcagagtaaacgattccaactagacatgtactgaataatccatatggcacatttatgactatagaagtatgtaattcataatacaggtataggtgtctggttgggaataggg

SEQ ID NO: 629150 - DNA, 100 bp, Homo sapiens
tcagtcttctcccatcaggtcatctgagtggccatttgatccacctaccacatagagctggcccatgagtacagccatttgaaatcgggctctgggtgtt

SEQ ID NO: 629151 - DNA, 503 bp, Homo sapiens
ttttttatgttacgaaaggatgggtgtgtgattcttccccacactacgccctcaagatctggcggggccgatgccatttgaagccaagggcgtgtggccgcaggtgctcctataacattaggggctctaaagcccagaaatgggggggtggtcctcccgccccaagaaagagacgctgacgataaggctgggaacattctaagggacaacttctcaataagggggcggaaaggcactcccccaaagttagaatattaccccaagggccctaatccatcgaagtttttctccttacatactgaaaagggtgcgcattgaaacgcactgcaaaggatccttacaagcactggtgtagagacattctcgcagcacttagatgctgctataggcgccttgtttggaactctactcatcttgcgaggttgcccagaggggaatcaaagccgtcacatggaaaagtgaacattggttctccaacccacggtcacgagctgaatcaatct

SEQ ID NO: 629152 - DNA, 520 bp, Homo sapiens
gtcccttgagaagatcaggaaacacatgtcataggctgtaagtagtgataagataattccattggggaaagagcccatttgttatgcatgctgcacagggcagatacatagtgtggtattatgcttgcaatgagctagatcctggtcccatagagggaaaaatattccttggtgggtaatgaaccttttgttcccctaggcacaaggagtgggactacgccaacataaatattggcgatcgttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatattgagctggggggatgctttagcggtgaggg

SEQ ID NO: 629153 - DNA, 327 bp, Homo sapiens
aaccagctacctcagaagtcagagcaggaagagcctgctttggacacgggagaaaagaagccagttgctaactacttcaagtgacagaaaccttcacttgaaaacaatgattataatatatctctttcttattcttccgacattagtaaccaaacacaaaatgaactgtcctttctgcgctcatattattcgagtgtgccttatctcttcatctactaaatttagatgtgatccttaatgtgtaataaaagattatatataagcatgatctatataaaaatatattcggcttataaagtctgcaccgtgtatgcctgtaggttaaga

SEQ ID NO: 629154 - DNA, 135 bp, Homo sapiens
ggcttttttgtcccccaacttgatgatgtatgaaggcttttggtctccctggtgagtggtgtggatggcatgccagtgcttacctgtacactgacttgagtgccagttgaataaaatgtgcacaccttaaaaatg

SEQ ID NO: 629155 - DNA, 183 bp, Homo sapiens
ttaatggaaatatatctacaaagtgtggtttcgttgattgtcttacatgataattttccctggtaacaacttagtaagtgattgttccccgctaagtgattgttcccggctaccggggaacaatcacttgaggtaaagagttcgacaccagcctggccaatatagtgaaaccccgtctctact

SEQ ID NO: 629156 - DNA, 887 bp, Homo sapiens
  misc_feature (69)..(69): n is a, c, g, or t
  misc_feature (75)..(78): n is a, c, g, or t
  misc_feature (80)..(80): n is a, c, g, or t
  misc_feature (92)..(92): n is a, c, g, or t
  misc_feature (531)..(531): n is a, c, g, or t
tcagtgtatgtggtagaagaccaagaagagatgagctaggaccatcacctgcctcacagcctgctggcngctctnnnngntgcggctctggnacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgaataattcagggacttgatcttgttaatgtccaaaatccatttcttattgatctttaaagatgtgctaaatgacggggggggccaaaggcttagttgtgaaaaatataatttttaaattatacattcaaggtagtggccaaatgtaacacatcaatcatggaatgatttctctgctaacagccgcctgtatgtttcaataaatccagccaaccatcaaaaacaagaaaaagtgggcgccatgggctaactaagttagctatgggnccgcttgcgtgtagtgagggcaaagaatgacgctgtttcaatgagcgaatcgactgcaaggttgatactgccagaaagtgtgcgctcgacttagagggggtaatatgtcttggatccgcgcaggggaatagccaggtctaagaaactagtacaggaccagatagagccgatactgtgcgaggtagcgaggtggcgagcagtattatgaccgccgtgctgaaacctcgctcgactgaatgcgggcgcggagggaccatacggacgcatgaaaagtatctacgttgtcgctccgcgaccggactggacatattcaggaaaacattaggaatgcgtgctgcggcccactgcgagttaag

SEQ ID NO: 629157 - DNA, 342 bp, Homo sapiens
gtctctctatctgtgtcaatatatgtaagtgtctgcctgagtgtgcgttagtctgactgtcacctaggaatacttggtgacatcagggaacagtataatgctcaggggactgttaacatgcaagatcagctcttttgcatcatctgcagagaccactgcctctcattccacatggggacaaagccaaagtcaaggccctagcttctgtccttcaccccattgctcatcctgtctccagccccttgggccaccttcctgttctcacatcccctagatgcccccaggcctcctccccttgcctccactcccagagtgaggtcttctctaagcagcccatgtaat

SEQ ID NO: 629158 - DNA, 206 bp, Homo sapiens
aggatttcgcagatcggatctgatgggcgatctgcgccttgatcacatcgccgcggttgaccgccgggaagttggagccggtggcccagttcttggcctgatgctcgatataaatgtcgaattcaccggccttgaaggcttcaaaggccacgtcgctgtcgcgatagaactccacttcgaccttgtcgtagttatagaaaccctgg

SEQ ID NO: 629159 - DNA, 227 bp, Homo sapiens
  misc_feature (2)..(2): n is a, c, g, or t
  misc_feature (5)..(5): n is a, c, g, or t
  misc_feature (123)..(123): n is a, c, g, or t
  misc_feature (142)..(142): n is a, c, g, or t
  misc_feature (169)..(169): n is a, c, g, or t
  misc_feature (185)..(185): n is a, c, g, or t
  misc_feature (188)..(188): n is a, c, g, or t
  misc_feature (197)..(197): n is a, c, g, or t
  misc_feature (199)..(199): n is a, c, g, or t
  misc_feature (208)..(208): n is a, c, g, or t
  misc_feature (212)..(212): n is a, c, g, or t
  misc_feature (216)..(216): n is a, c, g, or t
cnganttgcagtgagctgagatggtgccactgcgctctaacctgggcgacagagtgagacaccgtctcaaaaaaaaaaacaaaaaacaaaaattatccaggtgtggcggtgggcgccttgtcnggcaaggcgaatctctttnaacccgggaggcggaggtttgcaagtngagccaaagtcaaaancantttgcactncnagcctgggnaaanaagngttaatttcca

SEQ ID NO: 629160 - DNA, 217 bp, Homo sapiens
gggctttcgggtccgcgcccagagatgggctccaaaggcaaagaagcgcgtgctgctgccacccgcacgcccagtgagaatctgaattcggtgcggaagtcgtgtacatctgccgaacccgtcctcagtatgaatggagccgaagcattacaaagcgcagtgtgcaacgggccagggcacgtctagcgagtgtacctgccagcgggagactgacggg

SEQ ID NO: 629161 - DNA, 232 bp, Homo sapiens
  misc_feature (156)..(156): n is a, c, g, or t
  misc_feature (208)..(208): n is a, c, g, or t
  misc_feature (225)..(225): n is a, c, g, or t
tggtgccggactacgatatgtacacagactaacactgatatatgggatcataaacaagtaaaacacttaacatattacttcaatatatcgaatatcaatgtatcgaagttatagtacgtgtgtaacaatgaatccagaccaatgtagcgattagantattagtgtgtctgcttgtccttcacatgatcacaggatgaagctccctttngtaagaaacatcatggncacactg

SEQ ID NO: 629162 - DNA, 116 bp, Homo sapiens
  misc_feature (108)..(109): n is a, c, g, or t
gcaaagttttgcttcttcatctcaaggggacactccatattttaacaacttttgcttgaggttcaatctaattgtcagccaagtgagaaattggattcatgatattgnntacccgt

SEQ ID NO: 629163 - DNA, 180 bp, Homo sapiens
gggtgacccactagtctccttcaactggtaatcccctcagtaggcaactgcaggggttcgccactgactggagagcagtggaaggtctgcgccaggaaggaggctttacagaggctttttttcgcctgcacttcggcagagtcattttcgaggcactctagacagatcccatgcgtgcca

SEQ ID NO: 629164 - DNA, 238 bp, Homo sapiens
tctagaggatcccgtggacatttccacgagtcacccatgctggatgagtggcttgatctcggctcatgacaacctccatctttcaggctcaagcaattctcctgcctcatcctgagtagctgggattacaggcatgagccactgcgcctggctaatttttgtgtttttactagtagagggggtttctccagtgttggccaatgctggtctcaaactgcctgacctcgtgatccaccca

SEQ ID NO: 629165 - DNA, 240 bp, Homo sapiens
aggtaccccaaaaaagttggaaattaaaacaaaacaaacattaaacaattgaagcacccttgtgaaattgcaaatgaggtcacttcttttaccttttttggggtgggcagggagggaggattaaatggggttgggcatatcaaactaaagatgacatcttatttttgcattgacattaatgtagcggatatattttgatgattatactccattagatttaattctaggccaggatgttac

SEQ ID NO: 629166 - DNA, 149 bp, Homo sapiens
aataagccagacacagacagacaagtacagcatgatctcactcataagtggagtctcaacacaaaagctaatacacacatttcaacaaggttaatagcatacaggcagagagtagacacatgttaccagagactaagacaggaggacga

SEQ ID NO: 629167 - DNA, 466 bp, Homo sapiens
gggcacaggtgagtgtgcatgtgtatatagtacgtttatgttaactgcgtggtaatattcattaaactttaccttatacctaacctttttaactgatgaaataatataatagatatctcacccagtataacaaatccacttagaaatgctaaagagatcctgcctaaaatatctagatttttttttattttcaggatatgccctaagtttttatatttttctcttgcttcccattattgtagctgaatattacgctgacccattgatctagaaatttttacaaagaaaatatgatttcctatccaataaataagttccttcatgaagaattatttttaagtgcatctttgtttcctgatattaaattagtagatttgtacaataatgagcaaattaatattgtggtgcctgggcttttttctcttttcttatgtatacctattcattatctgatctctgcgttctg

SEQ ID NO: 629168 - DNA, 1349 bp, Homo sapiens
  misc_feature (6)..(6): n is a, c, g, or t
aaaggnccggcccttgctttcatcctgtggcctcccaccaagcactgcctcagctgtggcaggctatgctccaggggtcggaccgatacctggagagccgtgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataaaaaaaaaaccaa

SEQ ID NO: 629169 - DNA, 1207 bp, Homo sapiens
  misc_feature (6)..(6): n is a, c, g, or t
aaaggnccggcccttgctttcatcctgtggcctcccaccaagcactgcctcagctgtggcaggctatgctccaggggagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataaaaaaaaaaccaa

SEQ ID NO: 629170 - DNA, 197 bp, Homo sapiens
cagtcatgagcttcttgccgtggtggcggccgtgcatcatcatggagtaagggaggcgctccacaatgggacactgagcttagcggaagcgtgtgggggcataccgccctggactgtgaggcaggtacttggcatacttctccttcaatgcaatgtaatcctgcggggaaatgccttgatctgccatcatcggtgtc

SEQ ID NO: 629171 - DNA, 763 bp, Homo sapiens
  misc_feature (6)..(6): n is a, c, g, or t
aaaggnccggcccttgctttcatcctgtggcctcccaccaagcactgcctcagctgtggcaggctatgctccaggggtcggaccgatacctggagagccgtgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataaaaaaaaaaccaa

SEQ ID NO: 629172 - DNA, 1309 bp, Homo sapiens
  misc_feature (6)..(6): n is a, c, g, or t
aaaggnccggcccttgctttcatcctgtggcctcccaccaagcactgcctcagctgtggcaggctatgctccaggggtcggaccgatacctggagagccgtgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataaaaaaaaaaccaa

SEQ ID NO: 629173 - DNA, 316 bp, Homo sapiens
aaaaaaaaaaaaaaaaaaatcttaaaaacggggcccctcctgtgaaccccagacgaaaatgaaaaaggaggcccggttccggctcttctcttgcttttttttaagaaaagttcccctctgtaacccaggcctgaatgccagtggcgctattcggctcactgcaacctccacctcccaggctcaagtgattctcatgccccagctgctcaagaggctgaggtaggaggatcacttgagcccaggaggttgaggctgcagtgagccgagaccatgccactttattctatcctgggcaacagagtgagactgtatctca

SEQ ID NO: 629174 - DNA, 692 bp, Homo sapiens
  misc_feature (6)..(6): n is a, c, g, or t
aaaggnccggcccttgctttcatcctgtggcctcccaccaagcactgcctcagctgtggcaggctatgctccaggggtcggaccgatacctggagagccgtgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcagtctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataaaaaaaaaaccaa

SEQ ID NO: 629175 - DNA, 404 bp, Homo sapiens
ataaacagctttattagaccgctcagaatgactggagcaggaaccagtaactaaatcctgtcatacatgatgccatgacttgtgggcattactattcttttaaaatgaacactatgagaaatcggccaggcgcagtagtggctcacgcctataatcccagcactttgagaggccgaggcgggtggatcacctgaggtcaggagttcgggactagcctggccaacatagtgaagccttgtctttactaaaaatataaaaatcaggcgtggaggcaggtgcctgtagtcccagctattccagaggctgaggcaggaagatggcttgaacccaggaggcggaggttgcatcgagccaagatggtgccactgcactccagtctgggcaacagagagagactccatctc

SEQ ID NO: 629176 - DNA, 725 bp, Homo sapiens
  misc_feature (6)..(6): n is a, c, g, or t
aaaggnccggcccttgctttcatcctgtggcctcccaccaagcactgcctcagctgtggcaggctatgctccaggggagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataaaaaaaaaaccaa

SEQ ID NO: 629177 - DNA, 197 bp, Homo sapiens
gacatacagacaagcgaaggatctccaagtcaagcgtttctctccgcgtcacttgccgcttgccatccgtggtgatgtagcgttgggttctcttctccaggcttccgtcgctgggggtggtgtgatccctcgcctccgccaatctctgcttggccagtggggccgccggcaactacttagtgggtagctatcacccg

SEQ ID NO: 629178 - DNA, 398 bp, Homo sapiens
cacaagtctcacactgttatgtgggaaacctctttgctaacctggtcatgtattttgagatcggccagttaccagttcaaactgttcagtcctcccgctccatatatggtcgaaaatgttgtgacgcaacatttgtatcaccaaccagctgcacgtaccttcctaaagagcgtagaaaatggtatcaagtgccgggcgtggcgcaatggtcatgtgttcagacattattgggaagcttagcgggccggctcttaaggtctaaagttcactaccaatttgtgtgatcatggtacaggcgcgttctagttatccataggttactaagcctggtgtgttggctggctcttagagtcccaccagctaaagagtgtatggcagtatgatcgcgtgaatgtggg

SEQ ID NO: 629179 - DNA, 348 bp, Homo sapiens
gagaattagatattccctttcttctttacccagaattttctttttataaataaaaataggctgggcacagtggctcatgcctgtaatcccagcacttttggaggctgaggcaggaggatcgcttaagctcaggagttcaagaccagcctgggcaacatagtgagactgtaccactacaaaaaataaaaaaacttagccagatgtggtggtgcatgcccgtagtccagctactagggaggctgaggtgggaggattacttgagcccaggaagttgaagctgcagaaggttgtgatcgcaccaccacactccagcctgggcaacagagtgagactcactctctctcaagc

SEQ ID NO: 629180 - DNA, 1402 bp, Homo sapiens
gcccagataggggagcggaggtggcggcggacgagaggtagcggtggccttgagtagtcttccagatctcctcgagctcgaccactttagccggcaccgatcccacttcccatcacccctatcctactctatccattccttcacctacccctatcccatatttaacacctataccacagatacaggtgacgcggcaggggagatggcatacacagctaaccgcgctggtgccccacagcatcgtcgtcagcaggccattcaacgcaacagcatcaacaggctgtgcgcacaggagaacaaccaacgagagctcggccaggcgcgggggctacaggcccagggcccttggcagatggagcaataccatcagctcagtagtacagctgtcacactcggcagagacgtcacaggttgcacgcacgaggcgcagtccgggcctgcggcggccacattcgagagccactaggggaacatctgacgggacctgccgcatggaaggaggctcgaccatccccacaggaaccacacgacgcaatccccgaatagacatactagcgcaaatcagaccgacccatacgctcccaaatgacgcgccgggcacgcaagcaccgacacgaacaacgggaaccgcccatacgccccccaatgcccgacgcgaaccggccacaacgaaccggggggccaagccatgcaaaaccagacaacgaggaggacacccgaagcacgagaattacaggaaaacgggacccgagccgcacccccacagcgactaaagagataaagaaaaagccaccactagagccggaacgagacaaaacaacaataacacacgatcgagactgacacgagcgcacccggtgaagcaccagcagcgaagaccggccgcacacgtggccaccgatgcggaaccagcgaacgacaaacacatcacaggaacagagcaagcagcgggcaggcacgcgcgggacttccggcaaagaacgaaaccccgaaacccacagaacggggtgaacaaacagaccaccagcggtcagaccccccacggacacagcgcacaaagcagagaaacaccagacaacacgacacccaaggcgcgcaaatcacccgccagacacgcggccgcagccaacccacgcggcgcgcagccccgacggaacagaaacacacgcgggaacaacacaaccgcagccacggcgagagcggggcggggccggaagcccacggcgggcgcgacgagcgaccgcgcacaaagaacgcagccaagcgcagccaccgcggcgccagcgccacacgagcccaggcagcaaaggagggaacacagaccgcggctacacggggcacggccccggcgccacggaccgccgaacacagcgcaagccgccgcacggccacagaccgccaa

SEQ ID NO: 629181 - DNA, 856 bp, Homo sapiens
ctaatttttctatttttgtagagatggggtttgccatgtgcccacgctggtcttaaaactccttggctcaagtgatcctccagcctcggctcccaaagtcctgggattacaggcataagccatcacaccgggctaatttttctatttttgtagagatggggtttgccatgttgcccacgctggtcttaaaactccttggctcaagtgatcctccagcctcggctcccaaagtcctgggattacaggcataagccactgcgctcggcccagtattcatcagagaatactggggccgaggtcgtggtcacactgtaccaggccaaaattagtgtcagaccagatcagatggtcctatttaatagccttgactcctgagatatgggttaagctcacagagctgggtcccaggcaaactaactgagtctaagccccaggtggtggcacctgcccaacctctgcatggccaaccctcacagaggcaggaaattcctccttcctgatgctgcaatcagtcctagtcagttcagaatcgggggtcatatggcagattacaaaggcatcttcaaagaagctgttatagattcatgcacggttcccttaggaaggtaaaaacttctgacttatagacggcaaatggtttccaggaagaattgcacgctcacctaatagtggcaatgagcggtgaaagggtccgctggtaacaacctatggcagctgtaaagtccagagcggtatggggcacctacccaggccttcgtataacccgatattgccgccgggacctgttctcaacacaacgggtggggcccgctccaccggcggcggagttccggggggaacctccccgctcaaaaaa

SEQ ID NO: 629182 - DNA, 557 bp, Homo sapiens
  misc_feature (474)..(474): n is a, c, g, or t
tgggcctcacgaattcatagccaaattctatcatacttacaaagaagagctggcaccaacactgctgaaactataccaaaaaattaaggcggtggcgactcctccccgactcattctaggaagccagtatcactcgataccaaaatctgccaaagaaataacaacaacaacaacaacaacaaaattacgggtcaatatccccattgaagcaaaaatcatcaacaaaatactagcaaaccaaatccagaagcacatgaaaaagttatttcaccacattcaagtaggttttattcctgggatgcagaattgattcaacacatgtaaatccataaatgtgattcaggatgtaaagataattgagaacaaaaaccatatgatcatgtcaatagatgtagaaaaagctttcagtaaaatccaatatcccttcatgataaaaaccctcaacaaactaggcatcaaaggaacataccgcanaacaataagagcgatctatggcaaactcacagcgaacatcatactgaatgaataaaagctggaggtattctcctggtacggat

SEQ ID NO: 629183 - DNA, 236 bp, Homo sapiens
acggggtaacaacgtgatacacaacatgagcactggctgagcaggtaggtccctgttttaggaaaaccagtgtcaaacaaattaccaaacacatgtgaagacttccgtagtttgatactctaggaattcctctgtttgctgctgcaagtaaaaccagcccgccaccgtgagaatgcaggactccattggtgaaggagcagtcgtttatttaactgagggttttttgatctggggcg

SEQ ID NO: 629184 - DNA, 149 bp, Homo sapiens
ctaacaggtttccccaccttactgtagacaccgtctgtcttacggcacgaagcccaggacctccgtagggctcacagtgcggcttctagagaagatgcccgccacaggtgctctctgctccatctcagtgagacccgtagaggtgtcgt

SEQ ID NO: 629185 - DNA, 1055 bp, Homo sapiens
tggtttgagcaccctctaaggaagcagtctttattggctttttataaagtgaacacttttttgaaaaacacgttgcaacaggtttgaccacaatgtgctcagctccctttttataagtgaaattccgtggggagaaaagtcaaggaccttagggagcagagcaggtggattgcacaacacagaatttacctagtgagctcacttttgtgctgagccaagtgacacggccctcactgtgcagccatttccaagaaagttatcttggcctcacggataaagtgcaaagtaaacaaaattaccacacgtgctttattttgaaacaaacaaagtggtgacggtttgccataatacgtggccctcattgttgcagaaaggacacttgggggggctcagaccaatgtgaccacaagaaaaataaaacacctatacaccaggtctgtgtgttacacggtgggacttttaataaaggccccacactctctgctggatatctcgtggagacaccgtttcaccgtgtgggacaacccactataacgcgtgggttgtgaaatcacaggacgcgtttttacccccgtggaaaaaaccagtttaagattaaaagtgttattccgtccttgctcactattaatttcccccccaaagagagaagagccccacccaatatttagaacacgaacatattaggagcgacaaaaaatggggcaagcgcagcgggcctgtgtctggttttaacccccgacgggttgtatttttctcccagggtgcacagccccgtgtgggggacacatgtgcaaatctcacgcgcggcggcacccacaagacgtgtgaaagaacatgcgtgcccccctgtgtagcgtgttgggatatattcccccccacaagggggtttacccgtagcatctcttgttttggtcgtgccaaaaagctgggctacaataatttcacccaacaagacgggggtttgtgcaaaccaaaagcagacgaaactttttcacttaataactataaaagggggtattatcccccaaacaaaaagcgcctcctttgaaaaaaca

SEQ ID NO: 629186 - DNA, 426 bp, Homo sapiens
ctcgtgccgaattggcacgagcccacttaagtgatcttcccactttaccctcccaagtagcttggactacagatgcacaccactggctaattttttacttttaatagagatggggtctcactatgttgccctggctggtcctgaattcctgcatagaaaaaggggtagaagtgtgagacaggcagacattaaggggtccccttaactgcagcctggtgaaattctgaagcagagaagccagctaaggtatgctcagactccggtcttgcagaaactgagataataaatatgtgtaatttaaacctactaagtttgtgtcaatttgctacacagcgaaacctatataaagtgtggggaaacaatggaacattgttaatctcagaagggacatgaccatttcctactttggttttcccggtgtgttgg

SEQ ID NO: 629187 - DNA, 223 bp, Homo sapiens
ggctctcctgggagtgaggttgcgcgcttcgcctctctcttccctctgcctggcctgcctgcacttctaacggcgcgggcccactctggacccagctggcgccagagcggaagctgcctgccggcggccccccacttgagagatggatgagctgcaccaaaggggaactgttgacactcgggccctttcaggatggtgcttgttggggtaccgagctcgcata

SEQ ID NO: 629188 - DNA, 152 bp, Homo sapiens
tacggtgttgctggtcatctaagatctgcgatcatgctgtagaagtctttgtcttacagatctggcagggatctgtgcttgggccgtttagagcatgtgacatgtgtgagaccagagacagcagattgaactgtggagaaaaacccaaaaag

SEQ ID NO: 629189 - DNA, 778 bp, Homo sapiens
agcggggtgagaggctggagtgagcggtaactacccctggctgctgcacagctcggctgctccttcccgctccctcacacacctggcctcagcccgcaccggcagtagaagatggtgaaatgaaacaacttactacgatgtcttgggggtcaaaccaatgctactcacggaacgaattgaacaaaggcttataggaaactggccttgaagtaccatcctgatcagaacccaaatgaaggacgagcaagtttcaaccatgatttctcaagcttacgaagttctctctgatgcaaacgacaacgggaattctctgagcaaatggaggcgaacacggccaattacacgcaggcgtggagcaggtgtgcggctacacaggctcacccatggacactctttgactattgttacactctgcgactgagcgcggcacggattgccgacgacgacaatgtgcagcgggtcaccacacttgttcggctccccctccagagctacttcgagctacaccccctcagacacgcacctttctaagttaactgtgttggcacccaagcacccaccttggcctccttggcccgacaatacacccaggtaggacatccggactaactaccacagtgctcggcacaccggctacagcaccgccacctgtgacacacaccaggcggctcacaacgctcagcaaccccggcccggataccccccaacacatgccactcatgtggttcccctggcacaaatgcgcccacactatacgcgacacctccgcatacaacga

SEQ ID NO: 629190 - DNA, 100 bp, Homo sapiens
ctgctcttatcaaatgatcacacatcttctcatcttctcgtttgtctgcagaatactgggcacgcagggactcaaattccgcatgtctgtgaatatcttc

SEQ ID NO: 629191 - DNA, 119 bp, Homo sapiens
ccattccgatcacggcgaggctaggacgtcctagcagtgctactgaagaggcagaggagtcgtttgaatttgtggtggtgtccctcactgggcagacgtggcactggcgaggctaggac

SEQ ID NO: 629192 - DNA, 822 bp, Homo sapiens
  misc_feature (3)..(3): n is a, c, g, or t
  misc_feature (7)..(7): n is a, c, g, or t
  misc_feature (11)..(11): n is a, c, g, or t
  misc_feature (38)..(39): n is a, c, g, or t
  misc_feature (49)..(49): n is a, c, g, or t
  misc_feature (55)..(55): n is a, c, g, or t
  misc_feature (64)..(64): n is a, c, g, or t
  misc_feature (80)..(80): n is a, c, g, or t
  misc_feature (86)..(86): n is a, c, g, or t
  misc_feature (119)..(119): n is a, c, g, or t
  misc_feature (132)..(132): n is a, c, g, or t
  misc_feature (138)..(138): n is a, c, g, or t
  misc_feature (142)..(142): n is a, c, g, or t
  misc_feature (157)..(157): n is a, c, g, or t
  misc_feature (185)..(185): n is a, c, g, or t
  misc_feature (192)..(192): n is a, c, g, or t
  misc_feature (208)..(208): n is a, c, g, or t
  misc_feature (210)..(210): n is a, c, g, or t
  misc_feature (216)..(216): n is a, c, g, or t
  misc_feature (259)..(259): n is a, c, g, or t
  misc_feature (261)..(261): n is a, c, g, or t
  misc_feature (277)..(277): n is a, c, g, or t
  misc_feature (291)..(291): n is a, c, g, or t
  misc_feature (299)..(299): n is a, c, g, or t
  misc_feature (332)..(332): n is a, c, g, or t
  misc_feature (335)..(335): n is a, c, g, or t
  misc_feature (348)..(348): n is a, c, g, or t
  misc_feature (368)..(368): n is a, c, g, or t
  misc_feature (389)..(389): n is a, c, g, or t
  misc_feature (396)..(396): n is a, c, g, or t
  misc_feature (418)..(418): n is a, c, g, or t
  misc_feature (429)..(429): n is a, c, g, or t
  misc_feature (432)..(432): n is a, c, g, or t
  misc_feature (443)..(443): n is a, c, g, or t
  misc_feature (457)..(457): n is a, c, g, or t
  misc_feature (474)..(474): n is a, c, g, or t
  misc_feature (477)..(477): n is a, c, g, or t
  misc_feature (488)..(488): n is a, c, g, or t
  misc_feature (508)..(508): n is a, c, g, or t
  misc_feature (511)..(511): n is a, c, g, or t
  misc_feature (535)..(535): n is a, c, g, or t
  misc_feature (739)..(739): n is a, c, g, or t
  misc_feature (742)..(742): n is a, c, g, or t
  misc_feature (780)..(780): n is a, c, g, or t
tcngtanacanaaattttattcaattttaaaaaaaaannaggactttanacaaanctttacccnaaaacaaagcaaatcngtccanctttaaaccaaattctgagagtagccaacttcnattttcagcagcnggcaanagcncccccaatgagttcnactgacatttctattttcttcatcccanatggtanaaaacaaaaccaatcnanaccccntgaaaagctttatgtggtcatttgagttttacaaatggtttcncnaatggtatgccaaaancatttatgtgttcnccccaganagctttactgtaacatacagcaatgtttatccnggngagtgagtcttcngtaaacagtcaaccaatgcnctatgttatggaaaccaagcnaaatgcnattgaaacaatccacaggttcnaacctggaaanacnaggaaaacaanctggatgcattaancacagcaatatgaaganccnccccaaaaaanacgaggtgaatggctacccnaanacaagttttacttttcttgaaccnataggcctgtcatttaagtcaatgacagccgccgtggcttcatcccgagactcaaaggccaccatggcttcacctgtgggcatacctttttcattgtattttaaacacactgagcctgggattacttgatagccataaaagaaatctaaaatctcatcaatagacacagtaaagggcatgttttgcactttaattactgtcggnccngggttttccagaactagatgcaaagccaggggggaccnccaatatggattgggccagggccggggccggtggccggggca

SEQ ID NO: 629193 - DNA, 438 bp, Homo sapiens
ccaattccaggtgttgactcttagatggtatttctggaccttccctgagccaaaggggagccaactgccctgaagggatcatcaagatagtacctctatgagtctgcaagaaccacagcctcactggactaggggtgccccctaaagcagatacagcttagatcacaacacccaggttcttccaaatatctgaaaagccttcccaagaaggatggctaccaataagcccagacaatgaaaactataataaatacctagctcttcaatgccaagacacagaaaatatacatatatatatatgtatacatatatgtgtgtatatatatatatacacacacacacgcacacacacacagagagagagagagagagagagagagagagagagatggaatttaactcttgcctggaccacaggccaagacctgtgaaagaagg

SEQ ID NO: 629194 - DNA, 745 bp, Homo sapiens
aagaaggccaatggtgaaagaaggtggctccgtgcccagctgtcgtgaagaagcaggaggctaagaaagtggtgaatcccctgtttgatgaaaatggcctaagaattattgtgcatttggacatgtgactatccatgcccaaaatgatgaccatcaccactgcatttgtgaaattggcccctgctatatcatgtgtttgcaagctgtgcatgagatgccatacctctataatgctgtgctgaaatgtgcctccatgctgaattaaaccaggatatcaaccacaatgtgcgcctgagacactgagacaaaaacagtgcatacatctatgcattgcgttaaatgcattgtgcgccacaaaatgtacagtgagcgcatgatgaacaagatgcaactgatgaatgacaagcatgatgaacttgtattgtgccactgtgggcctggagaacatggacatgggcgttgcttgtgaccaaacaaatgtggtgaccgagtacacccaaagccggaaaggcaatgtacaacaacgcattgtaccgtatatggatggctaagaggaaggtatacaaccgaccgtggatctacacacacacattagtagttgggccagcacacaaaaaggcaaaaaaggcaatcaaaggcattgtggtttgtgatatgaattttggccaaccaaacaggaactggttagagccattccccagagtctggacaagcattgtgtgttggtcatatccgttagccaatg

SEQ ID NO: 629195 - DNA, 363 bp, Homo sapiens
atttgatttaatctttagagcttctatagaaggccaatttaccaagaggggaatgtttcctgaaggtatttatgggtagatagtacagcataatggttggaaggtctaagggtaagattagagccatactacgtggtctcaaatcttatctttaagatgaagctcataatgacttaccactatggctgctgtaagggtaacttaacctataaaagaccttagacacacagaagtactgcatacgtgtttgctactatttctctcaaggatatttttagtctagacaggagcctagcctcaggatatgtcgaaaggccttctcagtgtgctcatgtcccagcacactcttttttttttgtgcta

SEQ ID NO: 629196 - DNA, 679 bp, Homo sapiens
gattattgttagatccgggcaatagctcagggctggtggcgttagacccatatcctgtggaggagtatcatgagtactggtgatcctgtagaattttaatgcaacttctacttctatgtggggcccaggattcagcgggtgtagctgaaatacatttgactactgagcttggcgcattctgagatttggggttgaattaatggggcctgagtgctagcattattggtcttgagtgacaacgtttacttactgacgtatatcccccgtatggatcactttggctggggttgatagataatggttgtcctccacacacgtattttttattgaaactgtagacttttttgtcacaaggctcctacactactgttttccatgtcacgcaatatgcttattttataaaacaatttgcttaacaccttgcatctgtcctcatttttctcattgttaatcccctcttttcattacgctctacttccttatatgatacggtctaatcactactgtacgacaatgcctcctctcagtcccccaacatttcccacatgtctgttattactatttatacaaactccgtgacagatgtatataccaatttacagatacctctctgattcaatttagtttacacttgcatagaaacgagaaagaaagaaaacaataatatataaatataata

SEQ ID NO: 629197 - DNA, 570 bp, Homo sapiens
tcatccattcagggttcattcattcaggtaaccaacatttctgagcagggcacttcgggggtgccaggggcggggacccagagtggaattaaaccatggtccctgggcctggaaaagttattactcattcactcagcagattcaccaagccctacgggtgtgcatgggcggggcaagggggggtgtggggggtagaggagagcgttgctggcagggggagccgggggggatgtgaactcggggacggggcacccacaagggctcagggggcccaaacccttgaaatccgtgaaaccgggggggtcccaagagctagaaactcaggaaaccccgagggtgctcgggggccccggcgtctcgggggctccgtggggcagaccccgtgtaatttttgcaattctccctcccccaggctcttcctctggacccctaagttatggcccggtcacctctcccaggcccaggccggagatctggcagggtgtggccgcctgggggttctatgtattatagcaagttctgatgtcacatatgtaagggactttttaaatatatgtgcctttgcctact

SEQ ID NO: 629198 - DNA, 257 bp, Homo sapiens
tacgcacataacttagtagtaatctgaaaccatcagcgctagcgtcattcgatccaattagccctaggctgtacgccctccacctgctaatcattactgtcaggtccacctactcatgcacctgagtttgaagcgccacccctggcaatatcgaccatataaccttccctctacacttctcatcttcacaattctgatcctactgactatcctagaactcgctgttcgcttcatacattgccccctccaacctagtg

SEQ ID NO: 629199 - DNA, 128 bp, Homo sapiens
ttaaatcaaaccatatcaagttggtgtctttcagtgttgtataatataggaatatctcacaggatctgatggttgtgtaaagggcagttctcctgcacatgctttcttgcctgccaccacgacacagt

SEQ ID NO: 629200 - DNA, 449 bp, Homo sapiens
cagacaatggagagttttgaagggcttaaagagaatcacagcgaaatggggggaaactttgaaccactgtagacttgttaaatagttgtgatcaaaaggctgaccgaagaatagacagtaaagaccaggattagaaggtcttagatgaaaatgagagagttactgggaacagaggccaaggttagtttgttttgtcatagcaaagaatgttgctgcatggtgcccctgtccaggagacgtgtgaaattttgaacttgagggtgatgacttaggtagtatgtggtgaaatgaacttctaaggagcaaagctcaagaggtgtcctgcctgcattgaactacctatgctcttatgtgtgaccaaacaaatgacctcaagttgaaatttgtgtttaaatgaaaagctgagcttaaaagtttggaaaatttgcagcctggccaagtggcaaaaa

SEQ ID NO: 629201 - DNA, 100 bp, Homo sapiens
  misc_feature (3)..(3): n is a, c, g, or t
tgnaattcgtcaatcatggtgactcctcctcaccctcaccgcgccggattcatccggttgacgagcaccaggaggaacggcgctcccagcagtccggtga

SEQ ID NO: 629202 - DNA, 507 bp, Homo sapiens
  misc_feature (385)..(385): n is a, c, g, or t
  misc_feature (441)..(441): n is a, c, g, or t
ttataaatgagattcattttttgcatcctttctggcttgggaagtgtcttcccgtttcaaccggatatggtgctcattgcagcggatttcaagtcatgctcagacaggggtgttcggatactgcatccgtgtcgttcagtttcgctattcaattcaccccttagttgctttacgacgcaagcactgcctgactttagtctacagggaaataaaagactctgccagcaacagctgatcgtagggggcttgctgtaatgtgtgtttcagattgtcaagatgctcctggctggccacgcccaggtagagaaagcgggcaccttgccgcagcgcccggttcaggctgacgcgcaaaggcaggtggccgatacagcaaaagcagcccggngcaatgcgctgcacatgcactggtgacaaatcactgagaggcatgccgccagtggngagcccctccagaatcacggcagcccgcggatgctgcaggcaattttccgcaatccagcgttctct

SEQ ID NO: 629203 - DNA, 336 bp, Homo sapiens
tgagacagagtcttgctctgttgcccagaatggagtgcagaggtgtgatctctgctcactgcagcctccgcctcccaagctcaagcgatttcccctgccccagcctcccgggtagctggaactacaggcatccaccaccatgcccggctaatttttgtattttcagtagagatgacatttagtagagatgtcatttagtagagatgacattagtgggccaggctggtctcgaactcctaacctcaggtgatcctcccacctccacctcccaaattgctgggattacaggcgcgcgacttgtgcccggccacagtgtctttacatacttcccatcat

SEQ ID NO: 629204 - DNA, 336 bp, Homo sapiens
  misc_feature (336)..(336): n is a, c, g, or t
atgatgcgaagtctgccttactacaacacacccatatggacaccgttgacttaaagcgcttataagctatacagaacgacaccaggctgactaactttagtgcactgaggacaggatgatgccttctcgccaagactgatgttgcgaggactaagcgatattacttcagggtagatgagagaacgttgatgtaactgaaggaggagagcatcagctgagagctacagaagacagacgagctacctaagatcagtgcaacgaacttaccaatcctggcgagagctgctggactacgagagaaccttacatcacctcttttgaccacagccctgtgtn

SEQ ID NO: 629205 - DNA, 326 bp, Homo sapiens
  misc_feature (34)..(34): n is a, c, g, or t
  misc_feature (38)..(38): n is a, c, g, or t
  misc_feature (79)..(79): n is a, c, g, or t
  misc_feature (97)..(97): n is a, c, g, or t
  misc_feature (103)..(103): n is a, c, g, or t
  misc_feature (158)..(158): n is a, c, g, or t
  misc_feature (191)..(191): n is a, c, g, or t
  misc_feature (218)..(218): n is a, c, g, or t
  misc_feature (284)..(284): n is a, c, g, or t
  misc_feature (305)..(305): n is a, c, g, or t
  misc_feature (310)..(310): n is a, c, g, or t
gcgcgcagacccgctgggcctgcggcgcccgccnatgnagcagcagcaacagcagcagcagcagcaacagcagcaacancagcagcagcagcaacancagcanagcagcagcagcagcagcagtcctcaccctctgcctccactgccagactgccagntgcagcgaacctggtatctgcttcgcggccgtncttctacccttcaggcactgtagacancagtcaggctccgggatcgtacagcggcgccatcactccactggagaagacgtgaagccatcgatntcacagtgcaagttgagtttnaagcngagaaggccacgcttc

SEQ ID NO: 629206 - DNA, 176 bp, Homo sapiens
tttgtcgttgtagcttagaacactagagattttatgctggaagtcagagagatcgggacatctgtgcagctgtctcatatactccagttcatctttgagaaggtggtttcactgtgcacaatatgggtctgtattttaacatcagaaagctcgactccagagaagaaactacagtg

SEQ ID NO: 629207 - DNA, 191 bp, Homo sapiens
  misc_feature (5)..(5): n is a, c, g, or t
  misc_feature (29)..(29): n is a, c, g, or t
  misc_feature (31)..(31): n is a, c, g, or t
  misc_feature (47)..(50): n is a, c, g, or t
ctggnttaaacttaatctaaatggaaccngnctatcaagtattatannnntttcacattattgaagttcctatatttcaagagttaaaagtggtcaataaggacagaaacacagtttgttcttgaaatataggaacttaaataatgtgaaactggattaaacttaatctaaatggaccactctatcaagta

SEQ ID NO: 629208 - DNA, 622 bp, Homo sapiens
accgttcaggctacgcaagacatcgggaaaaataaaacactgtctccacattacgctggaacgtgtacgccccttgtgtgtctcctcaggtcgatggtagcgaagtctctggtaaagggtaccattgtgtgcacacgacttagatcaatgcctgtcagagccttacaacaagcgaatagtagtcttaatcaacacagagggatcttttgctgggtctggtccatccaacgaaggagaccagatgtccgtccatatgggcactagcttcatccttgctgtacatgcctcactcaaaaaattaacaagtctagcaggatgttggaatccatctcgaagttcttgtgggtcctcagcaagagcacatgacttatgatataaatcttccatactagggctagcccaatcagcattacctttgcactgtataaagtggtcagcatctggtggatcaagaatggccatatatttttctaaggactctacttctctgtgcattacataaaactggcagtaaatttcccagctgacatggtcttgacaaagggaaagcatccacccatgtaacttgagcatcaacaaagtcactaggtatatacaaattttgatacggcgccttagttca

SEQ ID NO: 629209 - DNA, 315 bp, Homo sapiens
gactctagagatccatctcgtcgatctgagcaatgatcgccactcgctccaagtgtggatacaggcatgagcactgagccgttcctttataatttctatcaagtcatattctacaaaggggtatttggatgattcttactttatgaattttttcaaaggccaagaaagcgatggtataacacacagaaatcagagaataggagagctagtgagtagagcttccagttggagattgggttcattaccttacctacttgtcaaccacatctcaagatatgatgacagttaccaggtcttggaaagattgcggcgttg

SEQ ID NO: 629210 - DNA, 158 bp, Homo sapiens
gaatagcctgcaaggatcacacattcagactgtagtgtctgtggagttttaggagtgaaggggtgacctttctggtcttagcactatccatcctctcccactatccgatctggcatcccacgcagttgtcccctagcacttactggacaggcacaggg

SEQ ID NO: 629211 - DNA, 155 bp, Homo sapiens
tgcgacatccaactaatataccaactgtatccctaaaattagtgctgacaatatgaggcgtccatcgagccacccacagaatgcacttcacacatttgcacagccattctggtgtatccacattttcacgaattgactgcaggctgctcattaca

SEQ ID NO: 629212 - DNA, 264 bp, Homo sapiens
ctgggcgggcagggcaaccgcgcccgccaaaaaaacaaaggccagggggtttttggccgcagcactttccagcgccgcccggtcctcacacaaaaaacttttctagctttgcgggtgcggctttaaacgactggccctgaatttttttttccccaagatccccaaacccttttttggagtttggattggaacccctttccggtaacacaaataaggtttatacattgcgattggttgatcttttaaattttttattaatttaga

SEQ ID NO: 629213 - DNA, 345 bp, Homo sapiens
  misc_feature (216)..(217): n is a, c, g, or t
  misc_feature (237)..(237): n is a, c, g, or t
gtgtaacctgctgcagagcagtgggatgtcaataattaaacactgctttatccaaactcaagttatcatgggaagtattatcgagtttcacttgcatttgtactcttcgttgcaatacaagtaaatattcatgtctgggtctccgtttaactcctctgggtgaaaacgttacggatttaacgaacgaagcttatgttgaacacttggaacgtgcanncttttaggtgagctctttcnccaagcactttatttcaatacgaaaaaaaataaatcagcaatttaaaaaatatttaaaaaaatgtattggggtttagtttatctgaaaagggttgaaattattaatag

SEQ ID NO: 629214 - DNA, 173 bp, Homo sapiens
ggcaggggacaaagagcaagggggttttgggtatttgcttcccttcccgtttttcctttgcccctggaaaggaatgtgggggcccccttttttggaaatggacccccccccttttctttttctggaaataaaccccaaactttccccctttcaaaaaagggtttatgccccca

SEQ ID NO: 629215 - DNA, 388 bp, Homo sapiens
agaaccttccatctgccgcggctggagctcgctgctccagccggtggctcgtattccaaccttccagcctgcgatctgtggagaatcaatctacttactctcttgcgcaatacataccttgtggcgagctcacgcagcaacatttaaccatgcggccacgtgtgcacatccaggctgttcagcgtgccaacgacatcggcgccacttctcgcgcggccctcagcgctcatcccgccatccggcccctgcctcctacgaccctttctgcgcgctccgctgctccgaccccccagtccccacccgtcccccgccgccactcttcgcgtccccgactccctctcgcttgtctcacccccctctcgcggtcccccgtccttcgttgtgcccg

SEQ ID NO: 629216 - DNA, 368 bp, Homo sapiens
aagtatttgtgtatccaaacatatcacagtaaaagtaccctataaaagataaaaaatgggccaggcgtggtggctcacgcctgtaatcctagcatgttgggaggccgaggcgggcggattgcttgagctcaggagttcgaaaccagcttgggcaacatggtgaaaccctgtctgtactaaaaatatagatataaaaaaactagccaggcatagcagtgtgcacctgtagtcccagcgactcaggaggctgagacaggagaattgcttgaacctccccccccccccccacagtgagagcagataaatttatggcaattttagcctgggttttccatgtcctgtcagtattcaaaaccataagtttcttt

SEQ ID NO: 629217 - DNA, 293 bp, Homo sapiens
cctcagtgtcagtccagcaatctgagatatcatgtgtctgagtgagtatgtgctcttgagtgtgctgccttgttgtggattgcgcatggctgagtccacatagagcacagtgcatgatgagctgaggttgtagcgattaccaggtcattggatacctgtaggttgctgcgcagatcagacaggaaagtgacttggtgatcgagttttaagataggaatcccaaaccttttttgaactgaggtggcattactcccagtgcaaattggttgggaaatcccggggagcaattgtta

SEQ ID NO: 629218 - DNA, 969 bp, Homo sapiens
  misc_feature (901)..(901): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttaaggtaataatattatcctgnagaaccatggttttaaaaaaatccaccaaccttggaaatttcctccaccaaaatttccaaagtccacc

SEQ ID NO: 629219 - DNA, 908 bp, Homo sapiens
gtcgctcattacacgtgtgtgacaatttggcccgacaccgtgccggacgatccaacctgcggtattctcacttccggtgtcattttcccacaccggcaactacatggggctagcgcagggttaccccgcgaattttacctttgtgtcgcggcttcccttgacaactgggatttttctgcgtgaccgggcccctttgttcccgccacttccggtgggaggatctggggcttccccttttccaggaagctacgcgtcccacggtctaccagcctcctcctcgggggccccacattctacaggagatccatgaaggcaatttgctctaattttgcgagctgtgacacatacttggacgagcaacccctttggggacctatcccacagcttctgtgaggatgacctcccctctttcgccccacccctcattggtggttggcgccccccctgtggcgcccagttccccagtacgctgggctcgcctcccttgatctcctggggccgcgggggtcgcgcccctccccctcatcaggtgggtacggaagcgtgttcctcctgtcctttggcgaggccccccatggagcaaaagtctccctggcacccctcggtgctggagcttacagccccagcgatcaggtatagtctgtcgccccccccctcatgcccctgagagcggtgcttgggcccgcttctggagctcgccaccctttgtgggccaccaggtgtgtactcaccccttcttgggttgccagcagcgttagcttcggctgttctagccgccacgcacaccgggtgaccagcacggtttgttggcgcggcactcgagtggcgaccctcgttcgcccgctcggcccccccaatgggcctttgcccccctcccccacaaaaaaaatttttgcccccaacataac

SEQ ID NO: 629220 - DNA, 1165 bp, Homo sapiens
  misc_feature (701)..(701): n is a, c, g, or t
  misc_feature (891)..(891): n is a, c, g, or t
  misc_feature (1084)..(1084): n is a, c, g, or t
  misc_feature (1090)..(1090): n is a, c, g, or t
  misc_feature (1100)..(1100): n is a, c, g, or t
  misc_feature (1102)..(1102): n is a, c, g, or t
tgtcactttctacacggcggcggatcgggtgttgcatccttggagagagctgagagctcgagtacagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaaagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccatgagtcaattaaacntcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctnagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttcctggcaagattctctgaattgtactgncttgcnaaaagagtangnagggggatgatcccagtggctcacgctgtattccaagacttgggagacaatccgggtaagatc

SEQ ID NO: 629221 - DNA, 594 bp, Homo sapiens
ctccggcacaaggctggagttcggtggcgtgattcttggcctcaaatgcaaactccgcctcctgggttcacgccattctcctgctcagcttctttattagctccgactacagggctgtgccaccacacctggacagtttgtttgtttgtttgattattgagatagagtcttgctctgcctctcaggctggaatggagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagcgcaagcggggatcctctaagtc

SEQ ID NO: 629222 - DNA, 1008 bp, Homo sapiens
  misc_feature (544)..(544): n is a, c, g, or t
  misc_feature (734)..(734): n is a, c, g, or t
  misc_feature (927)..(927): n is a, c, g, or t
  misc_feature (933)..(933): n is a, c, g, or t
  misc_feature (943)..(943): n is a, c, g, or t
  misc_feature (945)..(945): n is a, c, g, or t
ccaagattcaagaggccgacctactcgggttgaaacggctttcggggggaagctctgagcctcactttgtgcactgagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtaaacgtgcctgcttccccttcgccttctgccgtgattgtcagtttcttgagggctccccagccatgcttcctgtacagcctgcaaaactgatgagtcaattaaacntcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctnagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttcctggcaagattctctgaattgtactgncttgcnaaaagagtangnagggggatgatcccagtggctcacgctgtattccaagacttgggagacaatccgggtaagatc

SEQ ID NO: 629223 - DNA, 725 bp, Homo sapiens
  misc_feature (16)..(16): n is a, c, g, or t
  misc_feature (261)..(261): n is a, c, g, or t
  misc_feature (451)..(451): n is a, c, g, or t
  misc_feature (644)..(644): n is a, c, g, or t
  misc_feature (650)..(650): n is a, c, g, or t
  misc_feature (660)..(660): n is a, c, g, or t
  misc_feature (662)..(662): n is a, c, g, or t
ggagggacctggtggnagatgattggctcatggcggctgacgtccccctgctggttctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgatgagtcaattaaacntcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctnagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttcctggcaagattctctgaattgtactgncttgcnaaaagagtangnagggggatgatcccagtggctcacgctgtattccaagacttgggagacaatccgggtaagatc

SEQ ID NO: 629224 - DNA, 617 bp, Homo sapiens
  misc_feature (20)..(20): n is a, c, g, or t
  misc_feature (564)..(564): n is a, c, g, or t
  misc_feature (600)..(600): n is a, c, g, or t
agcggggaacaatcacttgnaacacacacttaagataatttccactattaacaagtgaaaactctgtttcaaaggatgatgaccaaaagatcaatcatgtgtaagtatgtaactacatacgaggtacagagtatgttgtttattcttcatttacataaattgacctttttaatgtgggaaaggttctaaatacattcttcaaaagaagttctgcaatagacaggatctgaaacagtaggttagtgattaatgcttaaaaatcactcgtcttcatttagtggcgtttccagatgtaaacccaaaaatgtgagaaatgaaaagcaaagtaattacacactaacatttttagacaacaggctggttgcatttcacatgcaccttatggctttatacatctcaacagggaagaggaggcagccctgaccatgttctcagaaaagattaactgtaagtaaaccaaccttaacaaatttcattgttaccctcctaaataacttattttacaagcattttccttttaaactcaacccttatacaagagatagggggtaggggaatatcagncatatataatatctttagcagcagaagagattaaancaaagatcaatcaatct

SEQ ID NO: 629225 - DNA, 1229 bp, Homo sapiens
  misc_feature (579)..(580): n is a, c, g, or t
  misc_feature (585)..(585): n is a, c, g, or t
  misc_feature (1229)..(1229): n is a, c, g, or t
tgtcactttctacacggcggcggatcgggtgttgcatccttggagagagctgagagctcgagtacagaacctgctaaggccatcaaacctattgatcggaagtcagcccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaacttgtgagtcaattaaacnnctttncttcataaaaaaaaaaaaaaaaaaaaaaaaaaaaaaaaaaaaaaaaaaaaaaaaaaaaaaaaaaaaaaaggggggggggccgaaagaagacactcccccgtagagggcgccagacatctgcagtccgcaccaccaccaggattgtctagtagaaagaaggagggcgccccaaatagaggagcggcgcgccgattaatataacacaggaagacagcgagcaggcggccggcggtgtaaaaaaacaacacgcgcgggagaaggaacgaaaaaaccgccgcactacgcgggaggagaccttccgggagaaaagagatcgcccactaccgactctctcgcggggggggggacgaaccaaaaattagtgtgggggaacaaacaactctccctccagacgagagagatattatagagacgccccagcagaaggggagaacattatttaaaatctttgaggaggaggtttgtaaatatggtgggtgggtgaagcaaagagaggccagaagaataagttgattgagcgcgggcggtggaagcaaaaaatgttggtgggcacgaccagcaggggagttgttgtatttgtggagacaaacagatgtttttagaccgggcgacggctgtggtgatgatattaatatagcgggagn

SEQ ID NO: 629226 - DNA, 3635 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 629227 - DNA, 3735 bp, Homo sapiens
tgtcactttctacacggcggcggatcgggtgttgcatccttggagagagctgagagctcgagtacagaacctgctaaggccatcaaacctattgatcggaagtcagcccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaacttacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 629228 - DNA, 895 bp, Homo sapiens
taaaggtttctgcatgatggtttatttaaaatattatgactctggatgtaaatacatatgggcttacattaagtgtatgattatccatataaagtgcctcaattaacaatatttagttcactcctttaaacaccttttggttctaataagcataatagtaaatattttactctcatgtggaagtgtttaaagctgttgtgaactcttgattgtgtgaagaaatttacgtgaaaaattaacttagaggttaactacattcaaacaattactatgtgttgtgcaagtgctgctcagatttcctccagtggcaaaattagttcgcatagtggtctatgtgcccgaactttaataggatcacaggttattagtggtgcattatataaacctctctcatacattacagtgaccaggtgtttgggcaccgtgcaactttgcttccaaacacattttacaacactttgctgcgaacattacaattttcacaaaaactctttttaacaacattacctttttaagataaaaagtactccgtggaggcatattacaaaattcattttataccaggcccttcattctctatgggcttggactcttataattctccaagaataatccgtgtgcccataattttattacttaaaagggctataattatatattctcctattaaacaaaactattttctaagttcaaatgagtacatcaattgtgtcccataaacaacttagtccccatctgcctgtagtctcatgggttaaaatccaagtatttatcaagtttctataattctgaatcagaacgggtaccgcacaaaacagaacagaacacgggttagcccatttaagttaaaagccttgtgccttttacatattgggggcatattttataataaatt

SEQ ID NO: 629229 - DNA, 238 bp, Homo sapiens
gatcgacatcctcccaggccccaaggacacacacactctgtcctttccatgggccatggctctgggagctacccacagaagggataggaggctcaaactgccccaaggccccagagttttcaggtcggggagttagggatggaacatgaaaatgacatgcttgttaaatacatcactggctgtgaccacaaggctgagggggcctccttgctctggagggggttttcattcatccttg

SEQ ID NO: 629230 - DNA, 3415 bp, Homo sapiens
tcgaggcccagccttcgccgatcgtggcaggtagaaatggtgacatcactgtgagagaataccaggcatggtgtgttcagtgaaagatccgtgatgttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 629231 - DNA, 2716 bp, Homo sapiens
tgtcactttctacacggcggcggatcgggtgttgcatccttggagagagctgagagctcgagtacagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 629232 - DNA, 237 bp, Homo sapiens
caagatcaacaggagaagtgatagcatagcgttcgtgtaaattatgtaatgcaaaatatttttaatctatcgccttaatactttcatatgaggtattattgggaatgatagagccttacgtgcccccaccttaccccctatatatgtacccccatacttgacgatgtactgaaggctttagtgactccctggagagtgggatggaggcaagccagggactatacctgatacactgta

SEQ ID NO: 629233 - DNA, 483 bp, Homo sapiens
cctccaggccccccttagaaacatcttccaaagcaaagggaggcccgagaactcagggggtcacttgcccccattccgggaggagatgccaagaaccaggtcagccttccctgcctggtcaaagggttttattccaacgacattccgtgtgagtgggaaaacaatgggcaaccggaaaaaaataaaaaaccccgccttccgtggtgggatccggcgggtccttttttctttaaaaaaagctccccgtgggcaaaaacaggggggaacaagggaaagtttttttattttccgttaagcaatagggtttggccaacccctacacgcaaaaaaacctttccctgttcccgggtaaaaaagtgggaggggcggcaaaccccccctccccggggtttttcggttgcccgaggaaggttgggagggaccccgtttaaaaactttccagggccccaggaaggaaaaaaaacacccccccctgccctggga

SEQ ID NO: 629234 - DNA, 871 bp, Homo sapiens
  misc_feature (173)..(173): n is a, c, g, or t
  misc_feature (193)..(193): n is a, c, g, or t
  misc_feature (195)..(197): n is a, c, g, or t
  misc_feature (303)..(303): n is a, c, g, or t
  misc_feature (344)..(344): n is a, c, g, or t
  misc_feature (361)..(361): n is a, c, g, or t
acgatctctatggtgaaacggcaggtcccattaaatctggggagcggctatagagtaacatttcgttagacgggtctcactactttctgaagaatggaccatattcattctccatttaatgccattctcctccctatactgcctgagtaccacctcttccaagaagtcatctntgactactccatcctcatcncnnnaggcttttctctcaatggtctacatcactgactttccacatagcttagctgttcttatgtctttctcacaaataagttttcatacctttgttcttcaacataaatnggggcctctcagcctgagggagacagtttagggagtaccanaatacacgtagtatcanaaaagcagtcccaggccactggagcttaccagttattgaatccttgcttctgcgaatccattgttttgaaggttggtgggtagttgcaaactccttgatgcatctgctgtgctgttgcatcctccctcctgtctatctcccctgcgtatgtaccactgtcgctatggtcacggtactgagcaccagggttgctaggttgcacaactttaagggggtgccattcgcaacctgcctgacacgaatggtgctccctggaattatgcattgcaacatctgcacgtgatcctgtcgaacaccagaaaattctactccagtggcaatggggaggctggtccctggcttgcttaaagaacccgcttttttattgtgtaacattatatacctttcaggacatttgacaagatatatttaagcatttgttaattttgtattattaaatatgtgtgtttataaagaaatagattatcctgaaataaagagaaaacgttggcagtgttctgtggtggccta

SEQ ID NO: 629235 - DNA, 187 bp, Homo sapiens
ttttgtaaattatttatgttttctaaacgaaatttaccggtataggttgatgaacgtcatgtgttttccgaaaagactggtaaatattttatttattgttcacatggtcaaaaatttcaccgacgtgaaaccctgcgacttagctagaacctcattttttaaagattaacaacaggaaataaattgt

SEQ ID NO: 629236 - DNA, 319 bp, Homo sapiens
  misc_feature (22)..(22): n is a, c, g, or t
  misc_feature (101)..(101): n is a, c, g, or t
  misc_feature (105)..(105): n is a, c, g, or t
  misc_feature (126)..(126): n is a, c, g, or t
  misc_feature (132)..(132): n is a, c, g, or t
  misc_feature (148)..(148): n is a, c, g, or t
  misc_feature (156)..(156): n is a, c, g, or t
  misc_feature (161)..(161): n is a, c, g, or t
  misc_feature (186)..(186): n is a, c, g, or t
  misc_feature (188)..(188): n is a, c, g, or t
  misc_feature (220)..(220): n is a, c, g, or t
  misc_feature (223)..(223): n is a, c, g, or t
  misc_feature (228)..(228): n is a, c, g, or t
  misc_feature (241)..(242): n is a, c, g, or t
  misc_feature (244)..(244): n is a, c, g, or t
  misc_feature (246)..(247): n is a, c, g, or t
  misc_feature (253)..(253): n is a, c, g, or t
  misc_feature (255)..(255): n is a, c, g, or t
  misc_feature (292)..(292): n is a, c, g, or t
gggggattctttttcccagggncggggaaacattaatttgtttttatattttactatttttttgtgtttttttgtttttaaatcaataagtcatctaggantagnattatgtttgatagaaatggnatttgntaggtaaataaggttnaaagtttnatttnatttttttatttattttatattttncnatgttttttttccataatatttaagtttttcnatntttanatatttttcttcnntnanncacaantntcttttcatggtccctgatcaattttaaacagttggnacaccggtggcactgtgaactgcgttc

SEQ ID NO: 629237 - DNA, 855 bp, Homo sapiens
taacaacatgttcatttaatttccatcaccagggggcatacccttgggggtgtaaaacggtactctacacccggtgggctatttatctgggggttagacttctgggagacttttcagatagacttgaagtctctggccttgcctggggaattactgggctgcccaaggaagcactggagaaggcgggggtctccttgcccttgtggtcctgctatggcgcatttggattggagttcctacgtatcggctggtcagagggggctggatagtggttgggcccactccattcctcaggttttttggaagcgggggtctttaagggagagcctttggttccgggaacttccttgacgggtcccttttcccttctggggtggtctggggaacctcttgggtgtagatgggtgggttgttggacacatgggctggaggctcggggtttcctggacatcttcggcagaccagggtctcgggaacagtgcaaatccagatccaccgggtctcccgcgagcttcccccaggacacgtgaaggaaggccagcaggctagaaacggtagccgcgacatttacaagcaaattggggctgcagagcccggatccccaaatcacacctcacactaccatacgggatccccatccaggaagaatcgcaggcaaccccgtgggggaaccccagggaagtaaacaaccgaaggtcagaatgggccgtggacaggctgggagatgaagggcgccaaagatggggaacctgccaatactcccaaacactggcctcggcaccggaggcccagggagtcccttcaacggtaccccgtgaaacacaaagggcggacgaaaaggggaaagtggcccgg

SEQ ID NO: 629238 - DNA, 828 bp, Homo sapiens
  misc_feature (406)..(406): n is a, c, g, or t
  misc_feature (467)..(467): n is a, c, g, or t
  misc_feature (748)..(749): n is a, c, g, or t
catgcagcgcagggcgtggtacgaggacgctacgttccgcgtatcatagaagaagctgatcacctgttatgatcacgcactgataatcattgtccttatctgcttcctagtcctgtatgccattttcctaacactcacaacaaaactaactaatactatcatctcagacgctcagagagatagacaccgtctgaactattctgcccaccatcatcctagaactcatcgccctcccatccctacgcatgctttacataacagacgaggccaacgatccgtcccttaccatcaaatcaatgggccaccaatgggactgaacctacgagttcaccgactacagatgactaattttcaactcctacatactttccccattattcctagaaccaggcgacctgcgactccnttgtcgttgacaatcgagtagtactcccgtatgaagcccgcattcgtataataattacatnacaagacgtcttgcactcatgagctggtcaacattaggcttaaaaacagatgcaattgccggacgtctaaacccaaccgcttttacccctgcacgacccgaggtatactacggggaattgctctgaaatctggggaggaaaccacagtttatgcccactcgcctagaaataattcccctaaaaatcttgaataaggggccgcatttaaccctagaacccccctttgagcccgaaaaaaaaaaaaaaaaaaaaataaaacttgttggcggcctttggccagnnggcctaaaatacggcagttaataaaaagggcccgaataggcctacttggccattcccccttaaaagggcggtgtttaat

SEQ ID NO: 629239 - DNA, 1884 bp, Homo sapiens
  misc_feature (1348)..(1348): n is a, c, g, or t
cgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaagagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtggggnccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggagggctgaggcaggaggatcgcttgaacccaggaagtggagactgcagtgagccgatatcgcaccccagcggctccagccctggtcgacagaggtgagagctccatctcaagaaaaaataaaaataaagttgttctctgaaga

SEQ ID NO: 629240 - DNA, 1159 bp, Homo sapiens
agcggccggagtgcagcagtatgcaggtccagctgcctaccctgctgcctatggtcagataaagccatgcctatgaccttcaagccagcgctccgaggaaaaaccctccagtcatgcagggggagaagatgatcccagaagaaggcaggaagcgcgagaacagcgaagccatatcaatggcccagtgaatgataatgggacttccaaacgcataagcagataaatccctcgccatacagagcatcctgtaacggacgactacccaagcaagcatcgcggagtcggccagacgcaatatccatgatagatcagacaaccggggaactaatggagaattaggactgacaagaaacatgcgaatatagcagagccagaattagcgcctaaatcaccgcagatactataaacaccaatcaaataacatgacccgactattggacgaccaaatacctgcacacgagagtcaatgagatctggaatcgaattgaatctgaaacgatgaatgcaaaaggcatcatcaacatagaacaacaacattaaaacagaaaattaagcctatgaaagagaaccagcgcaaaagaggcagatgagcggtccagaaaaaacaaagcaatgcaagaagagcgacgcgaggagcagcaatatcaattgggaaagctgataatgtcagaaatcatatttgattatggactcactattaaattctttatcgaataaaatgctaaaacattattatggcatgctaatgattgatgcgggaactgcacactacaataatagaggctttgacataaacgaaatttatatgaacagcacaggctgggaaaatacactgcacggttacgcttgcgagcaaatatattttgcattgctggtttatatattgcgaagggtataaacagcgagtggtaagttccatccatcgatattatccagagacccaaagaaagagtagacgcgaaatgtcacggccagtgtttgagatgaaaaggaaaccgccagatctaagaacccttggaggagcgccctttggaaggctattgtggcgcgagaactccccaccgaggaactttcctctggaaatatcgttgcagaaactcgaatatttcgcgagcgtttaataaaacctgtgttaaaaaattccttaatggtatccccg

SEQ ID NO: 629241 - DNA, 129 bp, Homo sapiens
tgtgctgtacgcatgcacgtttggtactgggctgtcttctcaccttattgatcagtactgcagaatccattctgcagaaggaacaatttccgcaacccttctgctactggtggacacttgtattccagt

SEQ ID NO: 629242 - DNA, 1957 bp, Homo sapiens
  misc_feature (29)..(29): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (42)..(42): n is a, c, g, or t
  misc_feature (1421)..(1421): n is a, c, g, or t
cggcccctgactgccgcggcccccacagngcccgcngngnancccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaagagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtggggnccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggagggctgaggcaggaggatcgcttgaacccaggaagtggagactgcagtgagccgatatcgcaccccagcggctccagccctggtcgacagaggtgagagctccatctcaagaaaaaataaaaataaagttgttctctgaaga

SEQ ID NO: 629243 - DNA, 140 bp, Homo sapiens
ccagtggccccagcggccctcggggccccaataagatgctgctgatgatggcgctggcatgcgccagcccattcccggaggaggcaccggggccgggcggggccggtgggcccggcggcgacctcggcggggcgcggccg

SEQ ID NO: 629244 - DNA, 2487 bp, Homo sapiens
  misc_feature (1951)..(1951): n is a, c, g, or t
ccataacgcacaaattcttaaaagcatgtgtgtccacatagtaatttttggtccttatttttatttttatttttcagttaatggatattaaagatacaactttattttgttttttttgagacagggtcttactctgtcacccaggctggagtgcagtggcgtgatctcggctcactgcaacctccacctcccaggttcgagtgagtcttctgcctcatcctccccagtagctgggactacagctgcatgccaccaagcctggctaatttttgtatttttagtagagacggggtttcaccatgttggccaggctggtctcgaactcctgacctcatgtgatccacccacctccgcctcccaaagtgttaggattacggatgtgagccaccgcgcccggccttcctaataattttgatagccttccccagttcagggattcttcatttgttctgataggaaaaagctagcgtggcttcccttttcctctcggttgaggcccgtttgacccgttctcaatattccttccaaagagcaggcatcgctggaaaactcgccttgcctcgtagccctggcaggacctaggggacaggttctgacaaggaagagccctgggtgggtcttaagaggccattcatttcttaccaattctgagtcactgaataaaaccacttcccccagtggggcccctcggtttcttcacctgtataatgggtgcgatgtgtgaggatgaaattgcagtaaaataaaaccgtggcagtaagagatgcctttctctggcacatcccacctgctgggcataagcggcgccaccctctggagttacagcctcaaggcagtccggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaagagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtggggnccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggagggctgaggcaggaggatcgcttgaacccaggaagtggagactgcagtgagccgatatcgcaccccagcggctccagccctggtcgacagaggtgagagctccatctcaagaaaaaataaaaataaagttgttctctgaaga

SEQ ID NO: 629245 - DNA, 2159 bp, Homo sapiens
tatatatatatatactatatatgtataatatataacacgagctggcaccctgcctctctgtgcccaggcccagcccctggatgaccatggcaccacatcagacagatgctgtcacgtgtcaagcacatggactccacagggagacacgtgtgcggacaaccgactcccctgcctacacactatcacaccgaagaacacccggcatcatatccctgacactcggactgcacacgacgagagcaagaggcgacacaccccacccagaactctacccacgcccccgccccccccctggccaccaacggaccacaaacaacacaaacacacacaacacacgggcgacgagacaccgaacaacacaaaccacagccacacccacaccacacgccaagcgcagcaccccccacacgcgccctccaccagcgccgcctaccacacccagccacgacacccgtgcgcccaacacaccacaagcgcgccgccacccccccacgccaacggcgcccgcgtccgcctccatctcaacaaaacagagccataagcagcccccgccagaccgcaccgacgcaaaccctccccaaccaccacacaccacggcacccccccccacgacaacagagcgcgacacccacgcagactgcgccccaaccgcccactcacgcgcccacaacccccaacacacccgagcaccaccgccccggccaccaaccccccatacacccgcgcaccatacccaagagaggaagccacacgccggcaccaacaaagcgaaaacaaaaccagcgacatacaaccaacaacacaccaccacaacacacagacacaacaacaacaacaagacgacccagccaacgactcccagacgacacaacaccgacgaacaaccacacaacgaacaaccccgccgagcccccagccacccacgcaccacacatcccgacaacacaccacccgcgccacacaccccccgcacccgcggccacgcgccacacaccagcacacaacaaccgggggcacccgcggcccccgccactaccacaccacccccgcgacacagacgccacccaacgcagcccaccaccacccacaccacccgacagcaccacccaaagaaaagcaacgagcgcaacgcacatacaaaatcacgccccccccccacagcgcccaaccacccccccccacacccacaacacacaacgacgaaaccaacagagaacacaagacccaaaacaaaacaagacaccaccccacaaatgaagcggtcacaaaccgaaaccacacacaaccccccgcaactaacaaacaacaaccacacacgccgacctgcccccacacagacgacggaccccccacagcgccccgacgcaccccagcccgacgccgccggacacgacccaccagccgcaacggaggcatggagaacagccacacaccgccagcacccatgccccacccccgcccccgcgccccgcagcccgcccgacacccccacacgccacacaccagcgcccgacccagccgccgccgctaccgcgcccaacccagacaccgacagcctgaccggaccgcgcagaccacgaggcgcgaggagaacggcgacaggcaacgacagagacccagcaacgcgcaacggcgcgaacggagcacgggacggcggcgcggcgcgcggcgaaggcgagggagcacgacggcaccagccagctgcagcagccgcgggccggacccagcaggacggacgagacggccgccagctcgcccgacaaccggagcggacggcagcgacgacacgggcacgcgcccacgcgaccgcacacgacacgaaaccggaccacgcgcaagcggcaacagacgcagacacagacgcccagccaagcccgaccaacagcgagcgcagcggcaccgccggcgcgaagcgccgaactggcaaagaggaccaggagagccgcgacagcgacgaagcgcagaccgcacgcgagcgcgaagccgggagacacaggcagcgacgcccggcaagagcgcgaccacagggccgcccgaagccgcagacagcagcaggagccagcgccgcgaccacgacgccagccgagccaaagcaggaacggcgacgcacaaaagaaccgaagcgccagcaggaccagccgccgagcaaccacagctct

SEQ ID NO: 629246 - DNA, 810 bp, Homo sapiens
ggcgctgaaagtcaatgacattgctatcttctcttttcctcgccaggagtgggtcctattatccagcggacatacagagcctggggaaggggacacgtgccgccttctgaaggtgatgcctacctcagtggtatgcgtgccaagaagatcgcacagtacagattgccatggtcgaagagttgcaccagcatggtctctactcaaaggctgttgacgcctggggtcattctacaggctgccggagctctggtcgcatgtagtgagccgcgcgatgagtcgtgagccggggacctgtggggcaccagaggttccaggagagaagctacaagtggcaacaggtccgagtcgttgatataccggaaaaacgacttgtacgaataaacccattgtagagaacactccagagctttcgccgaaatggaggtagggaggagcataatgttgtatgagtggctagaagttctttagtgctaatggtgcgcctattttaaagtcaaggcggaccggttgtccccccccatcctgtgcgtttagacgcgagagaactttgaaccgaacaggaatcgaccgtactgggactttgtttactttgggctggaaagtttaccaaacccagacttgactaagtactaattcgaacgccctcacgaggctggctacgccgtccggctgccactgatgaatcctgtaaagattcagccacgatgtccaagctggacgagaggtccctccctctgaaagtcgtaccagtggcctgtctatttgactcctcggcaatccgccagactcactccgtaacgggccgtcgct

SEQ ID NO: 629247 - DNA, 194 bp, Homo sapiens
accctacacaactataactactccttatattaatactggtgggccgtctgtcttgttaacgagttggatatatattagacggtgtgcctctgcttatgtaagttcccagagggccaggtccctgtataactttccccactctagttaggaatagggaaacgctggttgttctttggcactggcgaggctaagga

SEQ ID NO: 629248 - DNA, 1891 bp, Homo sapiens
  misc_feature (1355)..(1355): n is a, c, g, or t
cgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaattcggcacgggtctcagcctctcttgagtgtagacagacgtgacaagtgagcgactggaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtggggnccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggagggctgaggcaggaggatcgcttgaacccaggaagtggagactgcagtgagccgatatcgcaccccagcggctccagccctggtcgacagaggtgagagctccatctcaagaaaaaataaaaataaagttgttctctgaaga

SEQ ID NO: 629249 - DNA, 284 bp, Homo sapiens
  misc_feature (2)..(2): n is a, c, g, or t
  misc_feature (14)..(17): n is a, c, g, or t
  misc_feature (34)..(34): n is a, c, g, or t
  misc_feature (50)..(51): n is a, c, g, or t
  misc_feature (71)..(71): n is a, c, g, or t
  misc_feature (98)..(98): n is a, c, g, or t
  misc_feature (124)..(127): n is a, c, g, or t
  misc_feature (159)..(159): n is a, c, g, or t
  misc_feature (184)..(184): n is a, c, g, or t
  misc_feature (206)..(207): n is a, c, g, or t
  misc_feature (210)..(210): n is a, c, g, or t
  misc_feature (233)..(233): n is a, c, g, or t
  misc_feature (242)..(243): n is a, c, g, or t
  misc_feature (264)..(265): n is a, c, g, or t
tnataatgtaaatnnnntgaaaaactagattaanatatataactgcttgnnatggtttataattatataangtgcaatacaattcctgcatctttaanatgtctgcagaataactgtgaatttnnnngttattggattggccgtaacttttagaaaaanatcttgttgatgataatgtgatttncgggaggtcattaattgctttnnctnttttaaatgtagacttatataantacctgttnntatatagcttgagtaattgtnntatgattgtataccactaa

SEQ ID NO: 629250 - DNA, 1136 bp, Homo sapiens
cgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaagagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggacatcgcacgctaactagtgtataactgtgacccaattctatcttttcaggatacccttgagcaccggactctatatcataccttcacgcccttgctcgtagtggcaccagcgttactacagctattatatatctattcattacgatagcacattatttctattggtcagtcagggtac

SEQ ID NO: 629251 - DNA, 177 bp, Homo sapiens
gatctctgtggcaggaaaaaatggttcctgcacactgagagcttccagtctagcaacaaaaacatcagaaatcccacacccgtattaaacataaaaataaataacagatgatggtcccagtgatcaaggaaaggtaatggatgtgatgaacctaacaagggccctgaccttgtgctg

SEQ ID NO: 629252 - DNA, 1116 bp, Homo sapiens
cctcgtgttcacccagggcggtgagttacaattggcgcaaatctccgcccacttacaagcctccgtctccgtgggtttcacgccattctccgtgcctcagcctctcaagttagctgggactacaggcacccgccactacgccccagctaatttttttattttatttatttttttggaaaagtgtgagagtctttggtctctctgtgtgtcccccagaggggtggagagtgtacaaggtggtggcgaactctgtgtgtgctctcacacgtggaaacctctcccgccctcctgggtgtttcacaccgccatatttcttcgtgtgctcccacacgccccctctcaaaatatacacagtggcgcacatatatatgtgcgcgcgccccgccacacacacacacccgcgcgcggtatatatatttgtgtgtgtagtttctttatagtacatactaaacacgagggtgtattctcaccacacactgtgtgtataaccacacaagatatagtgtctctgtgtagatatatctctctctaaacctcttgtgtgtatatctctcgcgcgcgccctctctgctgggctctctctcacacaaacactgtcgtgtgtgagatatattaacagcgcgcgtcatgtgatacacccacaccggcgcgcgccgcgcgccgcgccacacgacgaaatactattattttgtgtgtagtatttttttctataaatataaaaaaaacacgggcgggtgttcacacgatgtgtgtgtgtctacgccacgagtgagatgtgtgtctctctctacatctctctctctgtgagaccctctccacccctctctgtgtgcgcacaaatatatctctcacacgaacacacacaagtgggcgcacaatatatatatctctcaaaatatattctatagccgcgaggtatctctcccccctataatatactatggtgacaaatcctctcaattcatatattaaaatctttcctccagatattacaccaccccgaggtggtttataaaaccctctcgtgttttttaagatacacctcctcctggcgacacaaacacaaccaaccccccggaaaaactcctatacacccccccccccccccttattttc

SEQ ID NO: 629253 - DNA, 796 bp, Homo sapiens
  misc_feature (98)..(98): n is a, c, g, or t
  misc_feature (171)..(171): n is a, c, g, or t
  misc_feature (190)..(190): n is a, c, g, or t
  misc_feature (198)..(198): n is a, c, g, or t
  misc_feature (204)..(204): n is a, c, g, or t
  misc_feature (220)..(221): n is a, c, g, or t
  misc_feature (233)..(233): n is a, c, g, or t
  misc_feature (250)..(251): n is a, c, g, or t
  misc_feature (255)..(255): n is a, c, g, or t
  misc_feature (258)..(259): n is a, c, g, or t
  misc_feature (275)..(275): n is a, c, g, or t
  misc_feature (317)..(317): n is a, c, g, or t
  misc_feature (331)..(331): n is a, c, g, or t
  misc_feature (358)..(358): n is a, c, g, or t
  misc_feature (361)..(361): n is a, c, g, or t
  misc_feature (369)..(369): n is a, c, g, or t
  misc_feature (374)..(375): n is a, c, g, or t
  misc_feature (378)..(378): n is a, c, g, or t
  misc_feature (393)..(393): n is a, c, g, or t
  misc_feature (397)..(397): n is a, c, g, or t
  misc_feature (427)..(428): n is a, c, g, or t
  misc_feature (441)..(441): n is a, c, g, or t
  misc_feature (504)..(504): n is a, c, g, or t
  misc_feature (560)..(561): n is a, c, g, or t
ggacattagctagcgctcgctctactctctctaacgggaaagcagcggaatacaagagactgaactgtatctgcctctatttccaaaagactcacgtncaactttcgctcacacaaagccgggaaaatttattagtcctttttttaaaaaaagttaatataaattatagcnaaagaaaaggaacctgaantttagtancacagntggaacaatccgcagnnggcggcggcagntggcgggagaagaggtnnaatntannttgattatctgtggtngtggtgtcgctagtctcacggtgatggaagctgcacattttntcgaagggaccganaagctgctggaggttggttctcccggnagnagcccgangcaanncanggatctggggatctncgantatcccaagatctgagtgggacatactttnngaaggatgtgcantgttcaaatcataagtgtgacaaaaactgacaagcaggaagcttatgtactcagtgagagtancatgtttgtctccaagagacgtttcattttgaagacatgtggtaccaccctctgcnngaaagcactggttccctgttgaagcttgctagggattacagtgggtttgacgtcacttcaaagcttcttttagtcctcgtaagaatttcagtgaagccttctcaccaagggtacccacacccggaatttccaggacgaaatagagtgccttaatgcaatttttcccaaatggagcagcatattgtatgggacgtttgaaatctgatgtggggacgtatatactctggattcccaa

SEQ ID NO: 629254 - DNA, 880 bp, Homo sapiens
tgagtttgtgtgatgagatgttgcatcattttggtccctttcttgaatcagacttgtgattgggggagagcaacttcagggcttctccatagaccttgaccattataagcagaccttattctccctacacttccactccataggtaaataaactggtgaagccacacacacccaatgaacattttctccccattgtggtagttaagttccacccagttgtgcttttgatacgcagaaatatctaaatgggatttggagtcctccagctatagaatgtgacatgcgcatacccaacgtgacctatctataatattttctgagttggtttcctatcataaatacttgttttccacagcctttggtctctcagactcttgctaacataatgtacgcttatggacaatacctgtcgctgaataaggagcaatgagaaccaaacactaatttctctggagcagcatggtctctgcaatggcattatcctgctagtgatttctcatcttgccttttctaacctaatgagaatgtcccagattcattacctggcatgtcaaagtcctagagccagaatatatcttaattcctctgtatctttgctccctcattcactagcgccactgtctaatgaagaaagttctctaaaaccttgtatgcatcagcatagaattgtacgcacgagggggtgcatgaacatccttctggggatatgatggcccttgtcccccggccattttttctctagaaagggttgtcctgccccgcagcatcacagtcacacacctgtgggttacccagcagcacgaccaaccacaatgggtagagcccacaccacgtgttacaaccttgcgccgatcaacgatcatcggatagtgccccattt

SEQ ID NO: 629255 - DNA, 482 bp, Homo sapiens
tgacatagcacttgagacagatcataaaatacacattaattattatagagactaggtctcactttgtcaccaaggctggagtacagcagcactatcatagctcactacactccaacctgggcaacaaagtaagactctgcctttcttttttgagacggagtctcgctctgtcgcccaggctggagtacagtggtgtgatctcggctcactgtggccttgacctcctggttgtaagcaatcctcccacctcagtctcctgagtggccaggactacctgcgtgtgccaccacacccagctaatttttttgtgtttgtagagacagagtttcactgtgttgtccaggctgtcgtgaacttctgagctcaagtgatccaccccccttggcctcccaaagtgctgggattacaggcatgcaccaccgcccctggcctgcccattttaaattatgttattgtttgctattgaaacttctaaaactagg

SEQ ID NO: 629256 - DNA, 1054 bp, Homo sapiens
  misc_feature (5)..(5): n is a, c, g, or t
  misc_feature (8)..(8): n is a, c, g, or t
  misc_feature (14)..(14): n is a, c, g, or t
  misc_feature (22)..(22): n is a, c, g, or t
  misc_feature (41)..(41): n is a, c, g, or t
  misc_feature (68)..(68): n is a, c, g, or t
  misc_feature (81)..(82): n is a, c, g, or t
  misc_feature (88)..(88): n is a, c, g, or t
  misc_feature (119)..(119): n is a, c, g, or t
  misc_feature (159)..(159): n is a, c, g, or t
  misc_feature (185)..(186): n is a, c, g, or t
  misc_feature (216)..(216): n is a, c, g, or t
  misc_feature (261)..(261): n is a, c, g, or t
  misc_feature (334)..(334): n is a, c, g, or t
  misc_feature (337)..(337): n is a, c, g, or t
  misc_feature (389)..(389): n is a, c, g, or t
  misc_feature (392)..(392): n is a, c, g, or t
  misc_feature (411)..(411): n is a, c, g, or t
  misc_feature (417)..(417): n is a, c, g, or t
  misc_feature (428)..(428): n is a, c, g, or t
  misc_feature (438)..(438): n is a, c, g, or t
  misc_feature (441)..(442): n is a, c, g, or t
  misc_feature (455)..(455): n is a, c, g, or t
  misc_feature (480)..(480): n is a, c, g, or t
  misc_feature (531)..(531): n is a, c, g, or t
  misc_feature (538)..(538): n is a, c, g, or t
  misc_feature (599)..(599): n is a, c, g, or t
  misc_feature (618)..(618): n is a, c, g, or t
  misc_feature (642)..(642): n is a, c, g, or t
  misc_feature (646)..(646): n is a, c, g, or t
  misc_feature (651)..(651): n is a, c, g, or t
  misc_feature (659)..(659): n is a, c, g, or t
  misc_feature (661)..(661): n is a, c, g, or t
  misc_feature (663)..(663): n is a, c, g, or t
  misc_feature (668)..(668): n is a, c, g, or t
  misc_feature (712)..(712): n is a, c, g, or t
  misc_feature (714)..(714): n is a, c, g, or t
  misc_feature (724)..(724): n is a, c, g, or t
  misc_feature (809)..(809): n is a, c, g, or t
  misc_feature (866)..(866): n is a, c, g, or t
  misc_feature (870)..(870): n is a, c, g, or t
  misc_feature (898)..(898): n is a, c, g, or t
  misc_feature (903)..(903): n is a, c, g, or t
  misc_feature (909)..(909): n is a, c, g, or t
  misc_feature (913)..(913): n is a, c, g, or t
  misc_feature (937)..(937): n is a, c, g, or t
  misc_feature (975)..(975): n is a, c, g, or t
  misc_feature (1045)..(1045): n is a, c, g, or t
taacntgntaagtntttgtttnttttaacatggtagggttntgacctcaaatatttgttaggtctgcnactcaaatgaacnnacagcnggacaacgtatgaaccttgaagatgcctctnctagtccagtttagggtccaatgcagacagttccatactntcatccccaagcccctcaagggcctnngccaatctttcattttatgccaagtcctcnaaaacgcatcagggtattacatcaacttgtacagaatatcaagancttatcttctattttaggttccatgtcaaataaagccgagttaggttgtccaaacaaactcaccagacaggtnacntaagaaagtgtaccacaacaaatttaaattttgaacaaaacacatctctccnccnttggtctcacacagaaatnaaagtntccaaaaacanaaaaaaaaancannctccagccctccnccagaatcacgagtcccagccaggncggcccacccacaccccccgtcgaagtctgggcctttcttcagtagtggcngcatggngtcgtcttccagaattaatgcagcccctccagcacctccagagcgcggagagctccaaccntgagtctcaggtgtcacanacagacccaaagttccagggagcnatcnggtcncacaagananancaaancacctcaaaaatttagaaataaccaccaaagcccgggaacaaangntacttctgcnagagcttacaatctaggccctaattcctgtatgtgagagcattttcaaacaaaattacttcccaaacaaaaacacgttaacaatngaaactcatattgaggtcatcaaccacagaccatagcagaaaacgtattttaaagtnaganagagcatagacaggaaaaaagagaaaanaaaangctctntggnttcggcttctccagggtgtcagcnaatctccaccagttgaccagaatccattggctggaaancgccgaccgcgctcacgacgactcgctcttctctattcgccgggaccagcgccaccagcatctctgccancttcgcaat

SEQ ID NO: 629257 - DNA, 166 bp, Homo sapiens
  misc_feature (114)..(114): n is a, c, g, or t
aggaattatcattaaacttgggtactaattttcaacaaagagtgaaattccacacatatatttccaatacttaacagagtagtaatatgtaatttaaaagtatatatttgtggncgggcgcagtggctcacacctgtaattctagcactttgggaggaccaggcgg

SEQ ID NO: 629258 - DNA, 1054 bp, Homo sapiens
  misc_feature (5)..(5): n is a, c, g, or t
  misc_feature (8)..(8): n is a, c, g, or t
  misc_feature (14)..(14): n is a, c, g, or t
  misc_feature (22)..(22): n is a, c, g, or t
  misc_feature (41)..(41): n is a, c, g, or t
  misc_feature (68)..(68): n is a, c, g, or t
  misc_feature (81)..(82): n is a, c, g, or t
  misc_feature (88)..(88): n is a, c, g, or t
  misc_feature (119)..(119): n is a, c, g, or t
  misc_feature (159)..(159): n is a, c, g, or t
  misc_feature (185)..(186): n is a, c, g, or t
  misc_feature (216)..(216): n is a, c, g, or t
  misc_feature (261)..(261): n is a, c, g, or t
  misc_feature (334)..(334): n is a, c, g, or t
  misc_feature (337)..(337): n is a, c, g, or t
  misc_feature (389)..(389): n is a, c, g, or t
  misc_feature (392)..(392): n is a, c, g, or t
  misc_feature (411)..(411): n is a, c, g, or t
  misc_feature (417)..(417): n is a, c, g, or t
  misc_feature (440)..(440): n is a, c, g, or t
  misc_feature (444)..(444): n is a, c, g, or t
  misc_feature (446)..(447): n is a, c, g, or t
  misc_feature (466)..(466): n is a, c, g, or t
  misc_feature (468)..(468): n is a, c, g, or t
  misc_feature (482)..(482): n is a, c, g, or t
  misc_feature (489)..(489): n is a, c, g, or t
  misc_feature (497)..(498): n is a, c, g, or t
  misc_feature (504)..(505): n is a, c, g, or t
  misc_feature (513)..(513): n is a, c, g, or t
  misc_feature (538)..(538): n is a, c, g, or t
  misc_feature (541)..(541): n is a, c, g, or t
  misc_feature (544)..(544): n is a, c, g, or t
  misc_feature (547)..(547): n is a, c, g, or t
  misc_feature (581)..(581): n is a, c, g, or t
  misc_feature (589)..(589): n is a, c, g, or t
  misc_feature (598)..(598): n is a, c, g, or t
  misc_feature (600)..(600): n is a, c, g, or t
  misc_feature (604)..(604): n is a, c, g, or t
  misc_feature (615)..(615): n is a, c, g, or t
  misc_feature (642)..(642): n is a, c, g, or t
  misc_feature (646)..(646): n is a, c, g, or t
  misc_feature (651)..(651): n is a, c, g, or t
  misc_feature (659)..(659): n is a, c, g, or t
  misc_feature (661)..(661): n is a, c, g, or t
  misc_feature (663)..(663): n is a, c, g, or t
  misc_feature (668)..(668): n is a, c, g, or t
  misc_feature (712)..(712): n is a, c, g, or t
  misc_feature (714)..(714): n is a, c, g, or t
  misc_feature (724)..(724): n is a, c, g, or t
  misc_feature (809)..(809): n is a, c, g, or t
  misc_feature (866)..(866): n is a, c, g, or t
  misc_feature (870)..(870): n is a, c, g, or t
  misc_feature (898)..(898): n is a, c, g, or t
  misc_feature (903)..(903): n is a, c, g, or t
  misc_feature (909)..(909): n is a, c, g, or t
  misc_feature (913)..(913): n is a, c, g, or t
  misc_feature (937)..(937): n is a, c, g, or t
  misc_feature (975)..(975): n is a, c, g, or t
  misc_feature (1045)..(1045): n is a, c, g, or t
taacntgntaagtntttgtttnttttaacatggtagggttntgacctcaaatatttgttaggtctgcnactcaaatgaacnnacagcnggacaacgtatgaaccttgaagatgcctctnctagtccagtttagggtccaatgcagacagttccatactntcatccccaagcccctcaagggcctnngccaatctttcattttatgccaagtcctcnaaaacgcatcagggtattacatcaacttgtacagaatatcaagancttatcttctattttaggttccatgtcaaataaagccgagttaggttgtccaaacaaactcaccagacaggtnacntaagaaagtgtaccacaacaaatttaaattttgaacaaaacacatctctccnccnttggtctcacacagaaatnaaagtntccaaatagagagaatatttttntttntnnggctcttctccagattttngngtttcagataggtnggaaatnaaattttnnagttgnngtttggtntttttttttgttgttgttgcttggngtngtnttnaggtttttttgtagattttttagcaaatacagtnttggagtnatttaaatntntgtntaatgtgttanatatagaacaaaaagttccagggagcnatcnggtcncacaagananancaaancacctcaaaaatttagaaataaccaccaaagcccgggaacaaangntacttctgcnagagcttacaatctaggccctaattcctgtatgtgagagcattttcaaacaaaattacttcccaaacaaaaacacgttaacaatngaaactcatattgaggtcatcaaccacagaccatagcagaaaacgtattttaaagtnaganagagcatagacaggaaaaaagagaaaanaaaangctctntggnttcggcttctccagggtgtcagcnaatctccaccagttgaccagaatccattggctggaaancgccgaccgcgctcacgacgactcgctcttctctattcgccgggaccagcgccaccagcatctctgccancttcgcaat

SEQ ID NO: 629259 - DNA, 346 bp, Homo sapiens
cgaagccttcctttcatcccgaagttcatcgacctttgccaacagccagacgcaaagaaaagaagttccgggccataaaagtaagaatttcttctgccaatttcatataagtatttttctcaaaaatgtctcttcatggtcatgaaaaccagtgcacttcacatcaacctctggtctcaccaatcggggaaggtttgggttgtcatctttgtgtcgcaagaagcattcatttctctcaggttcttgttttgcacaacagtcagccatttcaccataggtctcacaaagagtcgcaactgtgcataatgtgtctccaaagagtgtataagtaatgtgccctcgtgcc

SEQ ID NO: 629260 - DNA, 316 bp, Homo sapiens
  misc_feature (152)..(152): n is a, c, g, or t
  misc_feature (193)..(193): n is a, c, g, or t
  misc_feature (208)..(208): n is a, c, g, or t
  misc_feature (216)..(216): n is a, c, g, or t
  misc_feature (231)..(231): n is a, c, g, or t
gccagtgagggatgctggtggactgtgtgcccctggtggaggtggacgacatgatgatcatgggcaaaaagcctgaccccaagtgtgttttcccctatgtgcagtcgctctacaaccccctgggacgccccgaactgggcctgcgcggcaanaatgtttagcctgcccgcccgcatggccagccagtggcaanctgccgccccccctntccgggcnccgtttcctgcctgngggtccgccccccgctgccctgtttgttgggaccccctcccccccccatacacacgcagggttttgataaattattggttttcca

SEQ ID NO: 629261 - DNA, 173 bp, Homo sapiens
ccctaatggaatccattatactgagtgagtcttctgatatacagcagtggacagtcacaaagaagaataatcttaattaaccagccagataccttttattcattaaagtttttttgatttccataagttattggcgaacagtgtggtatttggtacgatgagtaggttctata

SEQ ID NO: 629262 - DNA, 489 bp, Homo sapiens
  misc_feature (46)..(46): n is a, c, g, or t
  misc_feature (290)..(290): n is a, c, g, or t
agcggggggggctaggctctctgaggaggctgccacagtgaagcanccgtgacaagtggtgcccgaccaggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggantctgaatgcaaagacagaacaagggccgaccggagtcacaatgacatccaaccccataacatggggacagatcaagaaaacgacacaagaagctgagaaactactggagcgccaggtcaggcaaaaacccctgactccatgttcttggccatgctagctgtagtgtcctgtgcgtctataggatcgggtgaaccaccaa

SEQ ID NO: 629263 - DNA, 374 bp, Homo sapiens
tctgagcggtttcttttttcctggtgctttcagttactgtcacactggacatccaggattgtctctcccatcacttctctcaggcatctcagtgcaacggttaggtataacaatgtacacggactctcaaagctgagccccagccctcatcattctctggaattccactcacatgtgatgccacttgacaggacagtgaagaggtacacagacttagcatgtctgcaacagacccgcccaaggagcctgcaatcatgaacaaataaagcagaccctccccagcctagctttctccatttgagtgaacggcatttttttttttaatttgtagagatgaggtctccctatgttgctcaggctagtcttgaaatccc

SEQ ID NO: 629264 - DNA, 1282 bp, Homo sapiens
ggtcaactctatgtatcagctctggatcctcgtgggccctggacaacacaagtggtcttgaccctctaccggtgccgggtgatggtggagttgcccgctggatcctgggcctgtgcaatgatgctcagtcgtgtcctgtgacgtgggcttgctgcttccgacgcatcctgactcacttcgtttccatgctctcgcgtcccagcacatcttctagcagtggacctgggttctaagacggacggatgagtgatcatagtccgtggacgaacgttcgctgttcctgatagcagatcatattgcagccgtaccgtgagagtgattctgacctgacagcttggagacgcatacagataagttacctaccacgcgattctggatgctaacgcagtcatatatcgatctcatgctaacggccatgcaggacaggtccgggaaggctgcggagctcaagctcaagtgacttcatgagtgcagcacggggaacttagcctgggctcgctgtgcgcactgacgtggcgacagtcagtcagagataggtgcagtctgttgctgcctgatttctcaccagagtcgagcacaagcgtcaagggaagtcggggagtacgtgagcatggcgcgacagggatgccctgaccaggttgcaaccccgatccacgtttccgctttcttgtgaactgggttacagcgccacgaattacactagctgtagtcacgaagttgggtcagtgaccgaccaaggagtatactgcaggtgctgtgaccgcatgtgcgacgggggcaagtggcttggcgtaaacctgggggcccaactgttggtattagcgttgaaaaggcggggccatgtccacggcgaggcagacaccgtcgtgcggaccccaagaagtgaaggccgtactggcattggccgaggacgaataggcgctggcccgaggaaggcaccgttggcaaggcccggcgggcaggagccaaggagcaaagtgcaagacccccctggcgcaagcagttgtagggcctttacgaaggactcttacagaggtccaccaggccgagaacgagcacaagggggagcgcccaataatccccgtggttcggaaacacgaagccccgcagttgggtcttgtgaagcctagaaggctgttcccacataaggactgggcgaacgcactttggggccctgagacatatggcagaggagacgcaatagtgtgttgagaaaagcctttcattgagagagatagacatgtgaaattcatcgccccaggagagatctgtgagcgaaatt

SEQ ID NO: 629265 - DNA, 1020 bp, Homo sapiens
  misc_feature (1017)..(1018): n is a, c, g, or t
  misc_feature (1020)..(1020): n is a, c, g, or t
ggctaagagaggcggggtaattggcgaggggtccttccacactgtggagcttgtctttcactcttgcaataaatgtgctgctgctcactcttgggtccacactgctttatgagctgtaacactcaccgaaaagtctgcagcttcactcctgagccagtgagagcataagcccaccgggaggaacgaacaactccagacgcgccgcttaagagctgtaacactcaccgctaaggtctgcagcttcatcctgagccagtgagaccacgaacccaccagaaggaacaaactctgaacacatccaaacatcagaaggaacaaactccagacgcgccaccttaagagctgtaacactcaccgtgagggtccgtggcttcattcttgaagtcagcgagaccaagaacccaccaattccggacacatcttggcaaccacgaagggactttcgcctatcgccgagcagtaagaccatcgcctatcgccgagcggtgagacaatcgcttatcgccaagcaaatcgaggccatcaagctacagatggtcttacaaatggaaccccaaatgagttcaactaacaacttctaccaaggacccctggaccgacccactgcacttcccctggctagagagttcccctctgaaggacactacaactgcagggccccttcttcacccctatccagcaggaagtagctagagtggtcatcggccaattccaacagcagttggggtgtctgtttagaggggggatgggaggtgacagtgtgctggcagtctcacagcctcgcttgtctcgggaactcctctgctgggctccactttggcggactgaggagcttcagcatgtacattgggagccttctggggcagcgagcagtcctcagtcggaggtggggaggcccggaccggtgcgggtggcactggttgtgggtgtgggccgccaaggcccgcggaggtccgccggggggccggggcacatcaggagggcgcccctgcgcctcccggccggctcgttctgctnntn

SEQ ID NO: 629266 - DNA, 947 bp, Homo sapiens
gacgagtgtgatgtggatgtgtttccctgacggccgtaactgttgctgcgcggaacgccgtcatgtccgtagttcctgtcgtcacaccccaccgcatggtcgcttgccgggatgtgctctgggtggcgtcggctgcgaccgtctatcgctaaggattgctaggcagtattacccccttccgtcaggatggatctacgcgttgcggagagaactgtctcctcccccatcttcagtcctgttggcctcgtgcactcgtggattggtcacgtggcatcgcgccttgtgctatgcaagactcttatccgactgtagatgccaggatgcccgaattgtggtcacattgttgtggctctccgtcatctggggacgggtgagacagaccctcgactagatcatgggtagagagagcgggacgaacgcgtcatgggagaacttatacctgttgatcgttccaatgtaacgcaggataagggacagcctagtagctaggagtagatcgacgcacacgtgaaagaagtaagtaagtaatagtcacgacaccaagaacgtgggcacaaggacgtagtccacttccttccctaagtacacgatgcctctgacaagtcgatggcgcacgtatggtatgattgcctgttgagacttgtgccccgcaggttttccagagccgcaatgggagcaggagtctgacttcgcttcgcgcctcttgacggtgtctcagtctaccatcatgactagagtgctccgcatgggctccccatctaaactcttcccaggttgtgtgttacctggagcctattttatgtgcgaatatatgaatagcgggatggtctgcagtacgactgtgttagacttgtcaacaactgcgacgtatgatacgactaaccttccgagaaggaccaacaaaccattggggcccaagattgtattgactaatgctcgtaagtaaa

SEQ ID NO: 629267 - DNA, 209 bp, Homo sapiens
agactgagcaacacggggagactcatctctacaaaaaattaaaagaaattaattgggcatcatggcacgagcctgtggttcccgctactcgggaggctgaggtggggggatcacctgagcccaggaggttgcgacttggagtgagctgagttcacaccactgcacccgatgccttgatgacagaagtgagactggctcaaaaaaaaaaa

SEQ ID NO: 629268 - DNA, 598 bp, Homo sapiens
  misc_feature (223)..(223): n is a, c, g, or t
gcaacggacgacttctatgacgacccgtgtttcgactccccgtgactgcgcttcttcgaagacctggacccgcgcctgatgcacgtgggcgcgctcctgaaacccgaagagcactcgcacttccccgctggctggtgcaccctggtcccgggctgcacgtgagtgacgagcatgtgctgcgctgcccatgcgggcaccaccagtgcgggccagtgcctactgntgggcctgcaaggcgtgcaagcgcaaagaacaccaactgccgacctgacgcaagggcgccaccatgcgcgaagcggtgccgcctgagcaaagtaaatgaggcctttgagacactcaatgcgctgcactgtcgagcaatccaaaaccagcggtttgcccaaggttggagatcctgcgcaaaagccatccgcgtatatcgacgggcctgcaggctctgctgcgctgacaggactgccggtgccccctgtgcgccgacagaacgcacttctattgcgccgggcccgcgtgaccccggtgcgtggatggcgagcactacagccggcgactccgacgcgtccagaccgcgctccaactggtccgacggcatgatggacta

SEQ ID NO: 629269 - DNA, 325 bp, Homo sapiens
gtagtataacctgtcaattatacttaatgtaaatacatgtcgcaccagaatattcacgggtttaagaaagcatgaaataaaatgtacgtctgttactagattatgctttcacatcgtcagtaagataattagatatcctgaaaaaccacgcatagcagccaagaatacatataatgaaaaaaaaaaggatctaacataatgaccttacaaaatggaacttacataataggtcactgtcctccagagatggcacatgaaatcacacaagcaaagagcctctacaaagaaaatagtgcatatgattaaagaactggaaacctcaaac

SEQ ID NO: 629270 - DNA, 732 bp, Homo sapiens
gctttgtgtgagcacaaaagccacgtgccaagccacctggcccgattccacagatgtatgtgcggccagatgacttccccaggagtgtggagggggtggtgaggaggagcagctgggctctctaccgcctctcctcacagaagtacctgaaactaggtctggggcaccgtcccaatgacagcgcctatggtcagccaagggtgggctaggcgaggggaccgttgtaggcaagcttatgtcgcaaagggagccccgcaatgcacaggaagccaacaagaggttcctcttgtttcccctcgcatcagcattctagcctcttcgtcatagctgctccgggctgagggactaaaggacatctcgcgtcgtttgaggggcatggccagtcgtggcaggccggcttcagcgtccgtgtcagggagagcgtgcagcctaaatgggcgacttgtccgatgggagcataacagaggagcgtccctggggatcgtgggaccatgctgccctgcactccacgactttcgttggggctctaagttctggaaggtgtgtgcacagagggtggtcatgggactcgcatgcagctctcagcactggggtgggagggcgttggcttgtccagaatggggacgtgggggcagcacccctgccaggcgagagcgcagacaccgtgtgaggggaccagcagcctgggttgcaaagcagagaatgatcctggtctgacggtgaagagggaga

SEQ ID NO: 629271 - DNA, 207 bp, Homo sapiens
cccttcataatgtgtgccaactccatcctgtgtgctaagggactgagcttgagtctgaatctgttctgaatccagctgccatgtgctagaaattcagatggcagagaaacatgttgacttgcaccttggacaagtgcagtcccagcaaaactcatacggatgagccaaatccacaggaataaaacagccaggttccttctacaggat

SEQ ID NO: 629272 - DNA, 306 bp, Homo sapiens
tggtgatgcatgtaatcccagctactcgggaggctgaagcaggatgatagcttgaacctgggaggtggaggttgcagtgaactgagattgtgccactgcactccagcctgggtgacacagcaaaactccgactcaaaaaaaaaaaaaggtggaagaaaattttttttctttatccgggtcccctctgttcccaataattttatcaccattaaccttccacctattgtttcaaagacgccctaattttgggggcacatcaggtgggcaagaagaccaattttcctcaaagatcaccaccaaaatttc

SEQ ID NO: 629273 - DNA, 186 bp, Homo sapiens
caactgttttggatgggtacggggtttggtctcctttggtgtgaagaaaatattttagaactacaggtgatgtttgtcacaaccttgtgaagatactaaatgcctttgaaatgtgtgttttaaattggctcattttatattatgtgaatttcacctcaattttttgcaacagaggctccttcaggg

SEQ ID NO: 629274 - DNA, 136 bp, Homo sapiens
aactggtagttcacgtcactatcctagtagattgtttcttggtgatgtcagaactttccagttaattctccctcacttaattcacgtacattgtttccattaagtaatctctcatcatccacctccttaatgataa

SEQ ID NO: 629275 - DNA, 116 bp, Homo sapiens
gcaagttcttgaaagataagtctccttgtagtaccccaattccttacttaagttgtaccttaatggtaacctggacttcccaacaaataccccgtggggtgggaaatttttaaagg

SEQ ID NO: 629276 - DNA, 117 bp, Homo sapiens
ctggagtacattcgtcagtacagtgagaagccacatggaaaggttgtttttttgttttctgtttttgagacagagtctagctctgtcacccaggcagactagcagtggtgcaatctt

SEQ ID NO: 629277 - DNA, 624 bp, Homo sapiens
  misc_feature (6)..(6): n is a, c, g, or t
  misc_feature (8)..(8): n is a, c, g, or t
  misc_feature (18)..(19): n is a, c, g, or t
  misc_feature (150)..(151): n is a, c, g, or t
  misc_feature (159)..(160): n is a, c, g, or t
  misc_feature (165)..(165): n is a, c, g, or t
  misc_feature (169)..(169): n is a, c, g, or t
gctacnangccggcagcnncggagctgcccgcgccatgtccgcgcacaatcggggcaccgagctcgaccttagctggatctccaaaatacaagtgaatcacccggcagttctgaggcgtgcggacacaaatccaggctcgcagaaccgtnnacaacagnnagtgnccangcgctgctgggctccctgaaacgctgtacacctttatagatcttactacacttccagcgtgatgattacattcttccaacattttcaccagggcctcttgtcaataaaagggccaaataccccaattccggggaacgactcctcttaaaaagcgctttataacattatttgcattgactacacacgcgcatttacctaacaggccgccggaccggtcgtaaaactacccgcccgggactgttggtagctcgcctgttaaacagccacctctacgggcttgcaagcgcttgtaacataatctccttgtggcgcactcaaggtgcgcccgcttgggcatttcccatgcttggaccaggccctccacttttgaacgaacaccgaatttagcaacgacgaatcacgcctcggagctgctgcgaccgactcgcaagctaccagcaaactcgacgtcgcgc

SEQ ID NO: 629278 - DNA, 251 bp, Homo sapiens
agctcgccccgcgttggttcttgcagtactgtctctctgaaggatagcaggagctcagactcttagagccagctgtggcttcggacccaaggcctgacctaggctgctatcctgatattgcaggaggggcctctcttccagagccccaccctgaagggttagcccttgagccaaatctttgtgccgtcatagtgcccagccaggcttttctagactaaattaagcaataagacggctctaagtctgactga

SEQ ID NO: 629279 - DNA, 740 bp, Homo sapiens
  misc_feature (6)..(6): n is a, c, g, or t
  misc_feature (8)..(8): n is a, c, g, or t
  misc_feature (18)..(19): n is a, c, g, or t
gctacnangccggcagcnncggagctgcccgcgccatgtccgcgcacaatcggggcaccgagctcgaccttagctggatctccaaaatacaagtgaatcacccggcagttctgaggcgtgcggacacaaatccaggctcgcagaaccgggaaaaaagagaaggcaagcttgtttgcttcctgaaagccgtgaccttattagagacttacacaccttttgggggaggaacaacttttcaacaattataaggggcttgggttaaagcccaaaaaccccatccgggggaagttctttaaaaggctttaaaaaggccggaaaaaggggtttttaccacggcccggttgtggttttcttccccccgggggggggtgcttttaaaaaaacccaaggggtgggggggggaaaatccccggggggaaaaggggcgccgggatttttcccccggcggaaccctttttttgaaacacctttaaaaaatacaataagtgggtgggagaagggggctccaaaataaccggggggtttaacacaaaaatttttgggtttctaacccgccggggagacccccctctgaaaaaaaaaaatccagttttcagggggggggtgggaggggggccttattaaaaaatttattggccggggggaggaaggggggttcttttatatgatgtttattaccgcccttttaataacaaggggggggaggaaaactatttttttaacaccctctccgggaaaaa

SEQ ID NO: 629280 - DNA, 258 bp, Homo sapiens
  misc_feature (42)..(42): n is a, c, g, or t
gatccctgaatttcgtagatctataccatataccaccaaganccataacagcggatattacactaataatgtagaatttctagagctgaaaggctagacaccatgtacacttgagcagaatgggggctggaaaacctaccagtttcttgactgttccatgctctcacagaaaggtatataacgaaaattaaatattttccttttttatacgatcttagaaattaccttactggaataactggactttacaggctgtgg

SEQ ID NO: 629281 - DNA, 841 bp, Homo sapiens
gtagagtgacctgaatacgtacaagaaggttggataaccatgtcgacggaccgagcatatgaacagatggattgtagcattctttaaatctatctactgaaatgtatttgacattcacgcagaatattcggtccttcatctttatagaatagtggcactatctatggtacagtttaaagccatttaatatgtcttatccattgataattcatacagataagtaggtctcattcatttgacagttatcaaagatgtactttccacagttcccctcacattaatggcaattttgatagttttatggctttttactgttagactaatcaaaaataactttaaaaggaacaaagaaactccaacatttcacattatgcatagttatgtagccatttcaccagtttctttaagatgtgtaaactcattgtcctcgatagttcaattatcatccatcaaaattataccaggagattcttttaagatacctgagtaagcagagttcaaaacaattggtggaaacaagccaaatagtaacaatgcagcaacactacaggttagtaattctttccccaatgctaggaaatcccgaccagattgcacgtctgacggagaaaaccaggtcggctccaggagacaaccgaccgccttgtgcaaggcgtggtcacgtccaccaccaatctgcgacgcaaggacccgcctagcaccaacatatcaaggcgaaaacagcatcccccaacagggagcagccgagcgaaacgggggtcgcacgacacgaaaggaccagaaaaaagcagggacaggcatgaaaaacgaaagagaacaacaaaccagcatagccccccta

SEQ ID NO: 629282 - DNA, 420 bp, Homo sapiens
aacccatattgtgaaaaacatgatttaaactttagaaaataatacttttaatacttgagagataacatgatgcacacgttgcttgtatggtctgactttccatggactaagaccctctgtgcatcattggggctcggtgacatggcgtaacctgctactgaggtgtggactcatatacaaaatcacactgtatgttggtccacagaggcagcatgctctcattgtcgtatctctctccctgatgaagcctttgcctattgttacacatttggctttacaatcttcattgacaaatagttcggcaaagagtagaggagcacggccacgaagagcagcaggataagcaggaacagcaagccgatgatgacccacttaaagcggcgccacacgatgaacttcatggtcttacggttacaagta

SEQ ID NO: 629283 - DNA, 138 bp, Homo sapiens
cagcgtttcagaagcatgcccagaacagaaagtagtcaacaagctcatacagtacatgatctcactggtgcagtcaaaccggatcctgggggctgaagagaaagatcccaccgtatgctgaacgacagatggcctcag

SEQ ID NO: 629284 - DNA, 398 bp, Homo sapiens
tttaaaacaaaaccaaccaaacaaagaaagggttttagggcagtaaggaaccgaggtaaagtacacttggaagagggtcaagcaggtgacttgagagagtcaagtgcactgtttgatcttggacttggggtttgataggttggcatccttccggggcttgcgttaactttcccctggttcttcccttggggtggtctgtccgcatgcgcagtggcctgccagcgctccggaggggcctcatgcgcagcgtgtttactgaagtgcgcatgctcacttgaggcattcttcctttaccagtcaaatgctcccaggtcatatgccagttaaactccaccatgttgcctcttagtgcacatgcttgagcccactcgcccagctcctgagatcttatcaggaag

SEQ ID NO: 629285 - DNA, 345 bp, Homo sapiens
gtggggagccatgccccaagaaatgccggatctgccacatggatgaggtcacccaaatattctttggctttgaggatgagcctgatgcccgctttgtgcacttggaagactgcaaccacatctttgaggtgcaagccctataccgctacatgaatgaacagaaggatgatgaattcgccatcatattgaaagtctgccctatctgccaggtgcccatccgcaaaaacttgaggtatggaactagcataaaacagcggcttgatgagattgaatttatccttggaatgatccctggcttatctagggaaatagcatcctacccggaacggattaagggccctgttg

SEQ ID NO: 629286 - DNA, 128 bp, Homo sapiens
acctaaagcatcctgtaggtctaactaggtgtagccagccccatactagaaatcacattgtatagactatctaatgtaacccaaggtccccaggcaaacaacgacactacctactttggcatgatatt

SEQ ID NO: 629287 - DNA, 417 bp, Homo sapiens
ctccttccttcttcctcccctcctgacgtgcatttcccccgtcccatcttctttccttgcatccttcctgttcatgtatttttttcgtaaagtttatatcttataaagtagtaaaagatacaaaaataccctagctctttaaaaattgatttcagccaggtgcagtgactcacatctctaattccagcactttgggagccaaggcaggaggattgcttgagcccaggattccgagaccagcctgggaaacatagtggacccccccctcaccaaaaataataataactaatagtaataatcataataataataatgggtgtggtagtgcatgcttttagtcccagctactcaggaggacaaagagggaggattgtatgagaccggcctgggcaacatagtgggaccccatttctacaa

SEQ ID NO: 629288 - DNA, 452 bp, Homo sapiens
  misc_feature (311)..(311): n is a, c, g, or t
  misc_feature (405)..(405): n is a, c, g, or t
  misc_feature (434)..(434): n is a, c, g, or t
  misc_feature (443)..(443): n is a, c, g, or t
ctatttataaaatacatataactacaggtttataattttttcatctctatgggaaatctgtcaatatcattagcccctattttatcaaaattatggaaaatgttattaccatatattactctgctatcattattgggtttattttctggggtttttttgggtattcttttttccaaagtacaaaatttgttcaagagatgaaaatgggacctgctccatggaagtccccaagcagaagcctgtgttaactaagtcatcaaattctctgctttggataaattgttactgccatcattcagagacaaaaaganaaacaatttattatacagaaggcaatgacttcattttacattcctactccatttttttgtcaagcattttctaaggtccaccgaatccagcttnaaaacatgttcaggattcatttcagcctntaatttcangggttaaaa

SEQ ID NO: 629289 - DNA, 298 bp, Homo sapiens
cgtcttcaactgcggctgaggcataaagaggtataatgctatttttttttccttctcttttttttttttggagaggaaatctcactctgtggcccagaattggagtgcaagggtgcgatctcggctaattgaaacctccgcctcccgggtccaagtgatcctcttgcctcagcctcccaagtagctggaatacacaggcgcccacaatcagcgcccagttaatttttgtattttaagaagagacggggttcccacaggtgggcctgggttgatctcaaactcctaaccgcagtgaaaa

SEQ ID NO: 629290 - DNA, 83 bp, Homo sapiens
agcggggggggggactgcaggggcgccggcgggcggatcgagaggaaggtcgtgggccatggtgccggcactgcgcctcggga

SEQ ID NO: 629291 - DNA, 396 bp, Homo sapiens
tctgactagtgattatgcgagcggagcccgagtaacacacgtcggcggggagcggataacggctacatctcaccgcagcgtagagttaagtcacagcttctccccacaatatggcaagtttagggtggagagtcgcaaagaaaaaacacaagaaaccccaaataataataacaacaaaaacaacaataacaacggtaataataataataataataataaaaaccctaagggatgtatgaacgggtttaaactaagtaggccaggggatcatgggtccggattggcatacatctctacggtaaataaaacctcgttttaaaactgggttcatacaccccttaatacagttaaaaatcatatatacctcaaccttttttccttcggaaggcgaggata

SEQ ID NO: 629292 - DNA, 298 bp, Homo sapiens
tctacaggatctgtgctgctccaaagaaaggtgcagcaaaaagtcaaaaaggcagaaatgaaatccacaagcagacagcccggtgccacaccccgggctcgtagttaaagatcgacccctgacctaatcagttatgttatctatagattccagacattgtatagaaaagcactgtgaaaatccctgtcccatcctgttccgttctaattaccggtgcatgcagcccccagtcacataccccctgcttgctcaatcgatcacgaccctctcacgtggaccctcttagagttgtgagccc

SEQ ID NO: 629293 - DNA, 442 bp, Homo sapiens
atccctgcagtccctcggagaccatgatgagtgagcgagtgaggaggtggcagacgcatctggagctgaagcttcattctctgttctgattggacgagggggctgggggctgctttattgagctggggatgggaatgggtgtcctctgcacatactcacctgtgttgaccctgccatagtccacaaagatctgcagcatgacagagcccagcaggtacccgaaagccggtccaaatacagagatggcaaataagatggagatgtacaggggcgagttgctgggctctgagaagtcatccacataggagatcccaaatggctgaataggcactgtcccgatgccagccagcagctgggcaaccaccatcaggccccacatgctgctggtctccttctgggggttctgggtggtgctgtggcactgactgggaggcaggtctgc

SEQ ID NO: 629294 - DNA, 339 bp, Homo sapiens
  misc_feature (7)..(7): n is a, c, g, or t
  misc_feature (22)..(22): n is a, c, g, or t
  misc_feature (40)..(40): n is a, c, g, or t
ttcctancctcctaatccctancctttttttttttctttnccctggagatggagtcttgcctcactcgtcccaggctggagtacagtggtatgatctcggctcactgcaacctccatttcccaggttcaagcgattctcctgtctcagcctcccgagtagctgggattacaggtgcacaccactatgcccagctaatttttgtatttttagtagagctggggtttcaccatgttggccaggctggtctcaacctcctgaccttgtgatccgcccaactcggcctcccaaagtgctgtgattacaggcgtgagtcaccgcgcccggcacccgttatataa

SEQ ID NO: 629295 - DNA, 302 bp, Homo sapiens
tcgcttagagccttaacctgatgtcctgaagagagttcagtggggtaaggtccagtatgtggctaacaaaggtcactttaccttttccagctggagttcataaagtcttgcagccttgtttccttgtggggctgacagtctggcatattttcaaagccagtgcattcaacgaatacatgtaagatcccacaccatgcagggctaggccgatgaacttgggctactcataaaccatgtaatatcctacaagcattcacatcaaccttgtgaatcagtgtcttcattgtatggtattacttttt

SEQ ID NO: 629296 - DNA, 1023 bp, Homo sapiens
ttcaagcctccaccacacactagccgagcccccgttaatcagcacgaggggagacctggtgatactggcggggctcttggtcagcctcctgatgctccctctggctgtcaggttgccctggcttcagcgcttgtgatgtttcttcttcctcactgccctccacatctacgccaaactacctgctgcggtcctgagccctggtcatggagaccttgaacgaaggcctggctccggctggtcctgaagcactacctttcagaagtgtgtgatgagtgtaactcagaaccgcaaacttgacatgaccaattactgcattggatgacctgactggtgagacagagtatatcttggccagactcctgtcgtctataccctgggtggtccccattaacaccgacttgtgtctcacagatgtctttgagctgcagcagcgtggttgaggggcaccaaagaatcctacctcctctgctgggaccatgtcacaaacaccagtgtacaggtacgttctgaaccatgaaggcaggccccaagaccatcctaagggccgacacacatgggctgatgcttggtggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaacaggactgcagcgatgccggctggaagaccgagaagcaccagctacacgcgtgtctgcactgccgcggccacatggctcctgtctcccgaacagaaggtcttgtgagcagcccacgacggtaggcccaatcccagtgcatgaaccttgagcaggaccccttgggtcacaggcagcgacagtggcacaggcagcttcacttatcacttagggcacctgagcaggattggccagtccctcatcggacatcatgcaatccatgcaattgccccgtgcacatgaggcctgcaacaggacaccggactttcaccact

SEQ ID NO: 629297 - DNA, 178 bp, Homo sapiens
ggcttggctggaatccaggactgtattttcatggagaagaacctgcagattcttccatcctcagggggccatggcccacagctctgcatctgcatctgagcttctcaagactcctggagcatggcgggaatggggcgtacatcgttgctctgtgctgacgggctccgtctcggagatt

SEQ ID NO: 629298 - DNA, 119 bp, Homo sapiens
atcagtttgagcaacagtttcacaagctactttggacatcaggcatcctggctgaaggtgggcatcaagggacagcatcactgatttggtcacaaatcttataagcgtggccagaagga

SEQ ID NO: 629299 - DNA, 896 bp, Homo sapiens
tataaggcacataactgcctttttacccttaggaacagacttttatgcccttagacactatgcttgtgggccatttcatgcagtgacatctaattgaagaacagaaatgccagaaacctatggccattacgccgtagaaggacggacagcgtgttataggatacttgaacacggtcgtggtgacatcactggcccttgcttcaatcgcgtcagactcagaagtatgtgtactagcaagttttgtatgctgtaccacaaaattttaggttaggtcgaattctcaaatacggaatccatgaagtaagcgaggatcatgctgtacttgagctatattgtctatgagctgtgacatttatctacctggtttatggaactagacatttattgctgaatcatgctccagttattcgagtgaggttttaaagtatcctatgtctgaaatataacttgcctgcgctaattgtgtggtaactttgcttttactgtttccacagtatttgcaggtctttgctcacttcactcagtaatactgatgcacttacctagtgtgccagaattttactaggcacaatccatgaatcaaaatacaattctcttgcaccatcattaataaatgcttaaatgtccttataacctgtcgggagtcccagtcatggaaaagtttgcatacatggccgtggcatgccgggtcaccacttgtatccaaaatgtttgataacgggcgtagcgcagggaggaactcagttgacctgtacagcgagttgcatgtaccaccatgttacaaaactcctcgaggcctgccatgcgacttagaatacacccacttagcggaatgttgggggcaacaaggggatatcaccagggagtccccagccacacggaggtaaattgtccca

SEQ ID NO: 629300 - DNA, 262 bp, Homo sapiens
ggcagaggttgcagtgagccgagattgtacttgccgcactccagcctgggcgacagagcaatgactccgtctcaaaaaaaaaaaaaaaaaaagaaaaaaaacacagttttattccaggcctcagggatttgtgaaacaaattttcaggaaaattaagcagtcccttgtcaacattcccaaaattcataagaaattagggccccatggggttaaacccaaggagatgttgtaaacagcagattcagccccaggggggatcacg

SEQ ID NO: 629301 - DNA, 1517 bp, Homo sapiens
  misc_feature (1240)..(1240): n is a, c, g, or t
gcgacactcgcgcttgtgttgcgccgcccattataatgcctccgtggggctgtgttccgtcgtccttccgtagttttttcctgtgggcgctcgtggggcggcgggtgtccaggtctgcgccaccgcggagccctgctttctgcactcctttgggccctatctttttcggtggttcaccctgattgtggataccaactggttttgtctcctacatcataagtacgcgtggctctggttgattcaccggcttcccacggacattttctcccccggggagtgttgttgcttcgcggaatcgacccaaccagcgtgtgttctccgttgcttgggagtgaagtgcccttggggtcgtttccgccgccattgggctcctgtctccgccccttcacgaccccccgtttttggtgtgtagccacccggttgagttgtgttgataggaaccccgagtccgccgggttgccgccccagaggtccttctgcgctgtgcttgccgcggcagggggtggttccctccttggtagtgtcccccagcaggaattgtgcgcgcccattgtttttgcgtaccccctgtgggcgccgggatatatatatgggctcacacaaccggttgggatatgtgagtgttctgtgccactgcgcgttttcttgtgggggccccccacagcataggggtcgtaccacgagttgaaactgagttggggaggccacagccgtggttgcaccctgccttggagaacggcccctcttcggaggggcgcttggtcccccccggagaagtggtttgttggccccacacttatagcgtatacacatatggtatatacaaaagccttctctgttgcgtcgcaacagatttgtggcgttttcacacatattgcccccgggagtctctaaggcattgccagacacgcgccgtgtgccaacacagggcacatgcaccgcaggttcacacgcacaaagagatggtgtgttgcccccttgttcgctttggggtgcctagatccacggtcttccccatacccacgagcattttccgagagcgtggcccctctcttggtaatgccccccccggggcacacttggtcgtgcccacgcggctgttcaccacatgtgggccccacagttacatcactgtgccagctcccgcacacccacagcttgccaggcacccatggaggcactcgtcgagtttgaaggcccctggcgccacgggcgccaagtttcacaagtttgcctcggnccgccacgagagagttccaccacttcttccaatgagagttggggctttcaccccatgttccactgctgagtgaaatttgaagaacactggtgcgctgaagaatgcggctcactcccacgatggctcgtggggtctcagtagcactcccccgttcctggccctctggaaccaagtgtcgggcccctgcaccttcactgaagggcttcccatgtgctgccccccttttaatactccacccattcatttctacttcctgtcccaaagaaaacaaaaaaaa

SEQ ID NO: 629302 - DNA, 1793 bp, Homo sapiens
tgtctgtcgctacgctgtgttggtggtccgtcgctgctgcggctttgtcttcgtgcgtgtgcgtgctcggtcatcgttgtgttggtttggtcgtcgagccatctgtggtagcgtctttctcggttcttcaggaccgcatcagtgggggggcgtctctgcgtgctcagccctcgtttgggtagacctcgtgcgtccgttgtggtcgctcactttgtcgttttgctcgagcagttgtgtggtgcgtgtggtaggcccgttcgtgttgttgtgtgtctgctcgcttgtgtgtttgtatcacctcactcggttgtgtttctcgttatcgtcagtggggaggtctggtctcttcgtatcggcttggttgtgttgggtccaccgacgtgtgtcgatgagtgttttgtgtttctacatagcgttgtgttctattcaatacttacgtgtgtggggggctacctatcgcccctccgttcgtttgctatgtggagtttgtgtgtgcggtgttggtggttgtggttgcttcgttcgtcgggtgtgtgtttcctccgtgtcccgcgtgtggtttgtgttagtgggtggtgggaacacccccgtgtgtatacgaggttgattttcgcagcttgtttttgttgttgtggcagccaccgatgtggtgttgcgcgttgccgtcgatgatggcaagcaccagctgtggttggggttgggcgtgtgccagcatctggtttctgactcgccggctggtaatgtccccccccttggtgggccgctcggggtggcctcttcggtgccactagtgtgtttgctcttcgtccccgcgggggagagtccaccgttcatgtgcgtcaactgccgcttggcgtgcgacagcggcgtcatcgctcgttgggttgcagctcttcggtgttggcccccctcttctctgtggagtgttcgtctttccgtcgcttgtgttgggaggtgtttctataaagaggtttcttcttgtcgagggtatgtgggggtggttgtgcttcgttggtctcccctgcgccgccgtttctcctcaatcggcagcacgcccgcgcgcgcccacgtaggtgtgttgtttgtgtgttctcacctgtgtgtatttgtggtgtgtcccccacaatacccacactctgtgtgtgggaagaagagtattgtgtgtgtctctgtgtggagatatctgtgggcgtgtgccgctcacactcttctgtgggagagagatagtgtgtgcgcacgctctctcacattgcgcacacacactctgtttcgcaccactgtgagagagagatgtgtgtgccccccttgtcgcacaccggtgcgcacacacaccgtgtcacattgagctcctgctgttctcgccaccgccgcccgcggtgtgttcgcttgtttgtgtgttgtataaagagtgtcacacctcgtgtctctccacactgtcactcccactcctcacgcgccctctctcacggtgcgcctcttctaactctgcccacacgtggcccacaagccacgcagacccactcggggtgtttctctctgtctcgccacagcgaaatttgggtgctgggaacacacacacacaaaggggagatatagaaattctggtgtgaaggtgtgaagtgggcacaccccctatgcctaaccgaaaaggcccacatcttttgggccccctgagactgccctgggaatttttcacctttgcccctcccttcccttagggccaatatacccccccggaccccctgggtattttagtgacctttttttatatttaaagaattgtaaattgccca

SEQ ID NO: 629303 - DNA, 774 bp, Homo sapiens
  misc_feature (13)..(13): n is a, c, g, or t
  misc_feature (87)..(88): n is a, c, g, or t
  misc_feature (94)..(94): n is a, c, g, or t
  misc_feature (97)..(97): n is a, c, g, or t
  misc_feature (104)..(104): n is a, c, g, or t
  misc_feature (111)..(112): n is a, c, g, or t
  misc_feature (223)..(223): n is a, c, g, or t
  misc_feature (244)..(244): n is a, c, g, or t
  misc_feature (262)..(262): n is a, c, g, or t
  misc_feature (267)..(267): n is a, c, g, or t
  misc_feature (392)..(393): n is a, c, g, or t
  misc_feature (494)..(494): n is a, c, g, or t
  misc_feature (672)..(672): n is a, c, g, or t
  misc_feature (679)..(679): n is a, c, g, or t
  misc_feature (687)..(687): n is a, c, g, or t
  misc_feature (741)..(741): n is a, c, g, or t
attatgaatgtgntgggaaggtgaagaaagaaaatggaaaaaaagttatatgtaggtggtgaaaaaaagataagaatggtaaagagnnaaaagngtnaaatganaggaatnnaaatgtaaagataagtgaagaataaaaaaggaagtgatggatgaatgatgaaattaagtataaaaaaaagatataaggttgaggggggggaaggagagaaaaatgaatganaaaaaagatttaaaaaaaganatgataaggaataagggnaatgnaggaatgaaggggaataaaaaaatgggatatgaggtgatataaaggtgagagatgggataatgagaattgaaggtgaaggaaaaatggggattaaggataaagggatgatgaatggaggaaaaanngaggagggaagaggtattaatgattaattaaaaaggaaaggataagtgatggtgataaggataagaattaaaaaggaattaaataagtataagtggaaganaagggatattgtaaatgtatttgtgaatgtagaaaaggtatgaatgaaagggaaaaaaatgaaatttgaagtataggaagattagagatggtgaggagatgatatagagatttatgaaaagatggaagggaaaaaaagggtagtaataagagtgaaggatgagaaggggaaaggagangtgattnaagttttnataatttgaaaatttaattaaaataattgtaataggataaaggaagaaaaagtnaaaaaaagggaagtatagatatataaatgaaaa

SEQ ID NO: 629304 - DNA, 468 bp, Homo sapiens
gaattccccccccccccccccccccggatgtggtttttggttttgggttttttggttttagagacagggtctcgctctatgacccaggctgaaatatagtggaacaatcatcactcactgcagcctctaacttttgggctcaagtgatcctcccacctgagcctcccaagtagctaggactacaggtgcaagccaccaagccccactaattttaaaatttttggtagagataggggtctcactatgttgcccagactggtcttgaacccctggattcagggggtcctcctgtttctgcctctcagagtgctgtgattacaggcgtgagccaccgtgcccagcctctctgaactgtctttaacacattaaaaatatttactgagcatctatttcatctaaagaactaatcttgataaaaccagccagatgtttgctccatgagctgaagagcccttggaggggttactg

SEQ ID NO: 629305 - DNA, 1959 bp, Homo sapiens
  misc_feature (775)..(775): n is a, c, g, or t
  misc_feature (809)..(809): n is a, c, g, or t
  misc_feature (821)..(821): n is a, c, g, or t
  misc_feature (839)..(839): n is a, c, g, or t
  misc_feature (871)..(871): n is a, c, g, or t
  misc_feature (904)..(904): n is a, c, g, or t
  misc_feature (908)..(908): n is a, c, g, or t
atttgccgtgctgtttatttacaaataactgcgtcttcttttcagaaaagttaagtggtgtgacaacacattgctcgagtgtcttctcccccattgtacacgatatttacaagagatctggcactatttctttggcctttttttaagcggcgctagatatcctccatgctcttcatgtgttcactaactgttatccttttacccccactctagtgtataaagggtgtaataaaagatacgtgttgcctcccccttagtgggtgggaagaaactccttttcgtcagactctttaagtgtgtggccactaatataggcaaattttgtcctttccactggggggaaacgtacatttgcaggttgcgcgcgttctaaagccgtggtaaccttttcaggggggcccctagttcattcctggatgtgacccaggtacatggaaatgcgccgttggcttcgtgccttcctctggcccaatgcccagaaatatggtgtggcctgggaaccttgggggataaaaagcgtaaaaaggatgcgggaaacgattgcaccagcaaggagataacaagtaatttgaaagttttggggaaacttctagagtctgggcaaaagatgcagtgggtcttgttcttccttattgtgtgaataacactcccgagttacacaaaaagaaaaataaggtggccaccttacctttaatagttgaaatgatgataatcctaattatataaaaatatatatataaacacacatatatatagtgatttctaaagattgttnacttttgtgttctgttttactgtactaagaactngtcctttctccntgaatcaaagtaggacangcatcatcctcctaattttaaatgttggctcngattttaaagtggtgcatttgattccagcctgntaanggagagtttgcaaacacacagcggcccacagcttcacgtggtggtgtgcagtgtgaggcagctccttggctttcctggttttacaacaagctagagattttcaaagctacacttttgagtaaaaacccttattaaaagaaaaacatgattaataaaaaaaaaaaaaaaaaactcgagactagttctctctctctctctccaagaagcgccagcgaaccagaggcccgttaagtttcatctcagaacatcggcctaaggtttggctagcagctctaaaaagggcaccgcgggtgcgaccttttggaggtgcacccatagcctgccgaggcagcactaagtgactcgccgcactgacggtggccaccaggtcgctcaagaaaggttgccactcgcgaacgccggcactgcctccgagggattacgcaatctccggggtttacgcgccggccggcagcacagccgctacaacccgcagactagcacttgaagacgccatcttctccggattaccatttctccacaagacgccccacgaaggcgacccatagggttctgggggtccctcgccctcaggggcacagagaaaccgcgaacaccgagccggctgcgttctatccccggggtaatcgcagaggacgcgacacgccccagacagcgacagcaccgacaaaggggaaacacccggagctccgagcaccgagaaatcgcgaaaacccacctcgtgcgacacattgggcacacaagtgggacgtgcccacagtagcggccctcttaaagaccagtgccacacgaaacaggtgctcccacgctggacacttacacccgctgctagtctttcgggcaacgtttcccccattaaactgaaaaattaaccaaaagccaccaacataacacacgtctataaccacaattccagagtggcggagtttttatcaatccttggccaggcccgggacctaacgaggtctcccaaaacgctttggggcgcataccacgcttatggaacaactccctaggggcccttcggggctttggtgctcatccggtgaga

SEQ ID NO: 629306 - DNA, 449 bp, Homo sapiens
acaacagttactaccttatctcagctgtggggacgctccaccccagccggacagctggagggggtgggggcgggggcggggctgcgccccgccctcaattccatcccctctgtcactccgcccatccccggctacctacaacagctaaaaccccagccctcaatgaagcactcgcgtatcgcgttgtaggcctgaacctcattcacggagcctggacgtctgggtggaaccctgccccttaccacgccttgatggccgcgggaatctggtgctggcggcagccggtgcagccccggcgagccctgtgcctggttgacctcgtccggctcttcttgaatcatgctgggctgccacctgctcagccacacccgccttggtgtgacgcctggtctcagcagcggctgcgtgtcgtggcagccatcacatctccagcaagtctcctggcctct

SEQ ID NO: 629307 - DNA, 1993 bp, Homo sapiens
  misc_feature (809)..(809): n is a, c, g, or t
  misc_feature (843)..(843): n is a, c, g, or t
  misc_feature (855)..(855): n is a, c, g, or t
  misc_feature (873)..(873): n is a, c, g, or t
  misc_feature (905)..(905): n is a, c, g, or t
  misc_feature (938)..(938): n is a, c, g, or t
  misc_feature (942)..(942): n is a, c, g, or t
atttgccgtgctgtttatttacaaataactgcgtcttcttttcagaaaagttaagtggtgtgacaacacattgctcgagtgtcttctcccccattgtacacgatatttacaagagatctggcactatttctttggcctttttttaagcggcgctagatatcctccatgctcttcatgtgttcactaactgttatccttttacccccactctagtgtataaagggtgtaataaaagatacgtgttgcctcccccttagtgggtgggaagaaactccttttcgtcagactctttaagtgtgtggccactaatataggcaaattttgtcctttccactggggggaaacgtacatttgcaggttgcgcgcgttctaaagccgtggtaaccttttcaggggggcccctagttcattcctggatgtgacccaggtacatggaaatgcgccgttggcttcgtgccttcctctggcccaatgcccagaaatatggtgtggcctgggaaccttgggggataaaaagcgtaaaaaggatgcgggaaacgattgcaccagcaaggagataacaagtaatttgaaagttttggggaaacttctagagtctgggcaaaagatgcagtgggtcttgttcttccttattgtgtgaataacactcccgagttacacaaaaagaaaaataaggtggccaccttacctttaatagttgaaatgatgataatcctaattatataaaaatatatatataaacacacaaatctttagaaatcactatatatatgtgtgtttatatatatagtgatttctaaagattgttnacttttgtgttctgttttactgtactaagaactngtcctttctccntgaatcaaagtaggacangcatcatcctcctaattttaaatgttggctcngattttaaagtggtgcatttgattccagcctgntaanggagagtttgcaaacacacagcggcccacagcttcacgtggtggtgtgcagtgtgaggcagctccttggctttcctggttttacaacaagctagagattttcaaagctacacttttgagtaaaaacccttattaaaagaaaaacatgattaataaaaaaaaaaaaaaaaaactcgagactagttctctctctctctctccaagaagcgccagcgaaccagaggcccgttaagtttcatctcagaacatcggcctaaggtttggctagcagctctaaaaagggcaccgcgggtgcgaccttttggaggtgcacccatagcctgccgaggcagcactaagtgactcgccgcactgacggtggccaccaggtcgctcaagaaaggttgccactcgcgaacgccggcactgcctccgagggattacgcaatctccggggtttacgcgccggccggcagcacagccgctacaacccgcagactagcacttgaagacgccatcttctccggattaccatttctccacaagacgccccacgaaggcgacccatagggttctgggggtccctcgccctcaggggcacagagaaaccgcgaacaccgagccggctgcgttctatccccggggtaatcgcagaggacgcgacacgccccagacagcgacagcaccgacaaaggggaaacacccggagctccgagcaccgagaaatcgcgaaaacccacctcgtgcgacacattgggcacacaagtgggacgtgcccacagtagcggccctcttaaagaccagtgccacacgaaacaggtgctcccacgctggacacttacacccgctgctagtctttcgggcaacgtttcccccattaaactgaaaaattaaccaaaagccaccaacataacacacgtctataaccacaattccagagtggcggagtttttatcaatccttggccaggcccgggacctaacgaggtctcccaaaacgctttggggcgcataccacgcttatggaacaactccctaggggcccttcggggctttggtgctcatccggtgaga

SEQ ID NO: 629308 - DNA, 256 bp, Homo sapiens
attaatttgcccccctttacccaaaatgtatagcttagtcaaaggtttctattggggagagtatggggattgaatgttgttcccttaaaaaattaaaaggactaatgtaattgtcttaccccggcatgaattgaaataccccccaaagccccttcgttgttttatgatttttaaaatcgtggaaaaaactggcctttgcaagatcttaaattttctaaaattatttcttaaggattaaaaatcttttctggtttta

SEQ ID NO: 629309 - DNA, 369 bp, Homo sapiens
ccggaccggtgttcctttgtctaaaccctgctgctgggttctagggtatccttgagcttttgctcaaaacatcgtgtacaggctgggtgtggtggctcatgcctgtaatcccagcactctgggaggccaaggcgggaagatcacttgaggccaggagttcaggaccagcctgggcaacacagtgagaccttgtcttcacaaaaaaatcaaaaaatgagctgggcatggtggcgggtgcctgtggtcccaggtacatgggaggccaaggcaggaggatcgcttttgcccgagaggtcgagcctgcagtgagctatgattgcaccaccgtactccagcctgggttacagagcgagatgctatctcaaagag

SEQ ID NO: 629310 - DNA, 230 bp, Homo sapiens
tagctggtcctggcgcgttgggtatgcttagtgtagaggtgcaggattgcaagcccacctggctacagtgccgacagctacatctccaactgaccctgatcacgaagagccacaccaatgatgccgcacaaagagcctctcaatgggccacactaagggccaccccaagagcctcgcaacgagccacacgatgagcccacaatgagccccccaatgagccaccccacgag

SEQ ID NO: 629311 - DNA, 1337 bp, Homo sapiens
gggctgagctctacactggcaacagctcagcagcttccaagggaatgacccggccatctcgacggagccaaagccttcgccccaccaagaccgagagctccctcaaactggctgcaagacccagcttttgtggcctcagcctacattccatgagagcctgggcagcattgcaaggcgatgatgacaagatctactttttcttcagcgcagcactggccaggcaatatgagtgctattgagaacacccattgtgtcccgcattgcccgcaatctgcaagggcgatgagggtggagagcagggtcgctacagcagacgctggaactaccttacctcaaggcaccagctagctgtgctcacggccctgacgcatggacttaccccatatcaacgtgctagcaggcatagtcctctcacgctagagcacccagaaccccaggacctggacgtgccaccccttactctatggggtcttcaccattcccagatggcacccacggggacactacagacgggctctgccgactggtgtctatcaccaactgcaggctgtgcagagacgtctacacgccggcactcttacacggaggtgaaacccgaggcagcacacagcagggggtacacccgacgaccccaagccgggatgcccaggagccccgggcctggcacgcagcgcaatcacccaacaggggccacgagcacaaagggaaggaaccacacgtcacaaccactgcaaagacgaccccaaaacccgcgcatgctgaaagccagccgatcaaaggacacccacatccccgcatggcaacggggcccaggtcccgaacacccacacaagcagctgcactgcagacccccagcgcactccgcgaacacacacagtgaccagcataacaaccagagcgccaggcgaccctgcaccaccagacccatccgagcggcacaccataccctagggcacactagaagagcacagcacgtgcaacccacaagagcaaaaagacccaagcgtaggacccaccggggggggcacgaacaacaatgaaacgcgcacaggacagaaactaacaccagcggagagaccacacgccgtcacaaagaacacgccatcagagggaacaaccacacacgcaggagcaacacgagccacagaggagcaccaaaccggacgcgcataacaagaggcccatagcccagtggaacggatacgaacacggaggaacaacccaccggcaccacagggacgaaagaacacgaagaaccagaaacacaaacgaggcaacagagcgagacgacaaggaacgaacacagaacgcaacagaccagatacacgaaaagaaaa

SEQ ID NO: 629312 - DNA, 720 bp, Homo sapiens
aaaggctcaccccacttttttttatttgaaaggggggggacttttcctccccaggggggcaaagccccaaaaagcggcccttcatttgaagggggaacccaagttaacaggggggccacaattctttcaataaaaactaccgttccacagaccagagggaaatttcaattcccgggggcccctcctggaaaacaaacctgcgttttttgggggcaaaggggtaattgccctgaaccctaagggggcgttggccgtaatttgatgctggtggagaccccaaaaacaccttctggaaaaaatggccaggggtccctcaaacggggttgaaaaagcggtcagggttacccaaaaggagccggaccccttcccaacggccttccaaaaacaacaggcggaggggaattttgtttgggacactgaaaaacaggaaaccccgttttgcacatggaaatttaaggcgcggcataaatgaaaaaaggggttccttccatttggcccagagcttttttggtttcggaacaccaccagtgtttaggggatgcgggaacccaacacaaggggtttttggaggtcatttttatccatgaaaccacactttttctttttaatagggcacgagaaccaaactcctttgttagggttttagaaacagtttactggcccctgggggtgttgtgtggccaaaaaggaccgttccaaattttgcccagcagggggggg

SEQ ID NO: 629313 - DNA, 120 bp, Homo sapiens
catattccacgattgcctggccaggcattctgggcatcgtttcttgcacagggtgcacatacaaatcgtcatgtcacacacattgctgcacatttctcttcgttcccagcagcgttgttt

SEQ ID NO: 629314 - DNA, 289 bp, Homo sapiens
  misc_feature (239)..(239): n is a, c, g, or t
  misc_feature (247)..(247): n is a, c, g, or t
ctgcatgttctctctgttgttggagcctggagccttgcatctctgggcacatgaaggggtccactctccatgccatgcatgggacctatggaaggggcttccatggcacaaaggccccctcttccagaggaccccccggatctgggtttccttttttttttctgttatcagggtgtactctaggggaccagcattgggatgcggcggtaacgctgagggcttcgcggtggtgctatcanttacagcnctgggtcttgacgtatactatgcacagagttgtccccccccc

SEQ ID NO: 629315 - DNA, 167 bp, Homo sapiens
tctctcagtacaaagtaactactacgtacacacaaaatgcttgtgaatgtaataatttccctggctcatccaacgcgcaattgcacactacttcaaagacaattttgtgcaagtgtacatgaactgagaaaacagctctccaagtttcaaatcctgctcttacatta

SEQ ID NO: 629316 - DNA, 931 bp, Homo sapiens
ggcagcacagctcccctcaaacagtcgtttccaagaacaattgacatgggttacaacaaagcggggaacctccctccagagggtcccctcacatactggggttaacgaaatgaggggcccgcgatgacaaataagaggagatggggtaggcctccgctccccaacaccggtagaagtgggcgacgcccgccgccctccgaaattggggcccggtgctccccccttacaatggctccccttttccccactcgtgtaaaggaaaaaatagtttcacaagcgacatgcgtagcagttttccataacacaacgttggatgggagcacctttttgaacgacccgactttgtcacgcacatatggtcccagcaaggggagttgtctaaaagaaagataccaccgactgcgctaggaaaggtttcaaaaagaatggggccaccacacacctaaggagaagatttctcagacgggttgacaaaaaaagtcacacttaccccatacgcgttgaatctcgccccgggagttcttaagatactttaacatttgtggagctcttgtggaggcttataaattaatttcgtagggactcttatctcaagtttgaaaatatcatgtaaatgggaaagattccccgcaactgtttaatggaaccacacactgggaattctagtcaggcagtagtgtcagctttaaagaagacttgtacaaagaaatttaaatacccaacggtgttcaatacagaggccgcatttattgggggctttcgagaaaagggagtggcttgcctccgacagcagtgttggaatgaaccccagcttggtggtagctataaatcaagtactgcccctattttcaatataatgaagttagtgttaccgctaaattataggggacccaaaaacaataaaaacacaagggaacaccccaaaaaaaca

SEQ ID NO: 629317 - DNA, 428 bp, Homo sapiens
cctacacaaaaatctttcctaagactcggaaaaaatactggatggatattcgtacatgacacaagaataaggcaattccacttcttatgtatatgaaagaggaaagatttttgtaaactacaaaagtcacgattgaccataacctgaaagcaaaaaaaactaaaagtaggttggggattaggttgtatctctttgggcgagctgcaaagtagccaaacctgactaccaaaggtaagaatgtggatacacaaatgtcacctaccccaccctgctttgttgaggtaggggacgaggaggacaaagtggagtgtggagggaggagggggccaggcaggtgtggaaagccagcaaggttgtctgaaatgtctgttgtcagaacagggcttccccttctctgtcatgaaaacaggatagaaaaagcttgtggc

SEQ ID NO: 629318 - DNA, 934 bp, Homo sapiens
cgcacagtgggggggccaaacaccagtggtggagaacaaaagaccacggggtgtccacacacgaattgtaacaccggtattaaccacaacagggttgacccccgacgtctgtggctcgaggaaaacacccaccactcgctttgcgggaggtcacccagttgggtgtaaaaaaggcccccctgcggctgaatgcccgctagggaatccctcagatcctggggagcccacctgcggtgacgacctgcctaaataatcccatatgtcctgcggggaaccactcgcccagcaacaagtgtctagcgaggtggcgccgcaacctccacagccggtggataacaaaaatatgtagtgggctcctgcgaaagcacccgctctagacaaccgaaagagggcgttaacaccagcgggaaatctctcctgcgggggtctaatactgagggcggaagaaattggcttaagacaccggcaaatagacgaatcgctgttggcaacaaacaccacgcgtggcctcacgagaacacctctcctccgccaacaaccgaccgagacaaaagtggtgaacaaaaaaacaacgaattgttcggtggagaaaaacacgcgggctcctctccgcgcactcgcagagtccacagcccccggggcccacgctggaagattatttcctccactgcactcccgagagagctttgtttaaaagagctcgcctctttccactaaatacacaatgattgtcaacaaagttcgctcttggacaaaacatgtgggtggagcaggaacggtggatgcctgagttcttcaagtggggagtgtaataaaatcccacaataatctggtgtgcggtgaaccccctgtgtttcttctcttttgaggcgatcaatctgggatagggaaaaaaaataaaagcaaacaaacccaaaacaaaaaaaaacagaca

SEQ ID NO: 629319 - DNA, 779 bp, Homo sapiens
  misc_feature (74)..(74): n is a, c, g, or t
  misc_feature (82)..(82): n is a, c, g, or t
  misc_feature (88)..(88): n is a, c, g, or t
  misc_feature (95)..(95): n is a, c, g, or t
  misc_feature (98)..(98): n is a, c, g, or t
  misc_feature (102)..(102): n is a, c, g, or t
  misc_feature (106)..(107): n is a, c, g, or t
  misc_feature (110)..(110): n is a, c, g, or t
  misc_feature (115)..(115): n is a, c, g, or t
  misc_feature (124)..(124): n is a, c, g, or t
  misc_feature (142)..(142): n is a, c, g, or t
  misc_feature (152)..(152): n is a, c, g, or t
  misc_feature (156)..(156): n is a, c, g, or t
  misc_feature (163)..(163): n is a, c, g, or t
  misc_feature (177)..(177): n is a, c, g, or t
  misc_feature (185)..(185): n is a, c, g, or t
  misc_feature (187)..(187): n is a, c, g, or t
gtgagggtgggccctaataagtacaagtgaggatcaagccacagttgtttggctctttcatttgctagtgtgtnatgtagtnaatgtnaagggtnctnactngagnnctnatagnaaggcgctncgttcgaaaaggtcttangagttactancctnacatttnatgaccattttccntccgcttngnagaagccccaactctgctgtgcatttttccattgtatttatggcagttggcgtatctgacattcagttctggcggtaggtttaacgcatgcttacgttcactttcttgtaaaccatcaaaggtacaggtcatctagcactaaagcaccaaaactctctgagggcataacagctgcttgaaacgacgaggttaccattggactattaaggagttaactgaaataactcccatagcaatagtgtcatatcacttatcatcttcccccttcctctgcgggacgtggaacgaacttgctctgacatgtatatctgaaaagaggcctggtaggtaaaccaggccctggctctttaccagcagtcatctctatcattgctctggcggaccagccacgaacaaacaaacaatcccggggcacattggcgtagactcagtgctagtgcaaaaatggtggcagaatccaactgatttattatctggctgcacattcgtaacgtcattaatgaaccgcgaacttaacggaggaagccttaatgcgctggctcacaaactcagatctccgcactgggtatccttagcctctagccaggatgac

SEQ ID NO: 629320 - DNA, 1106 bp, Homo sapiens
ccgagcgcttccggtgcgtgtggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaaaaaaaaaaa

SEQ ID NO: 629321 - DNA, 890 bp, Homo sapiens
  misc_feature (47)..(47): n is a, c, g, or t
  misc_feature (57)..(57): n is a, c, g, or t
  misc_feature (254)..(254): n is a, c, g, or t
  misc_feature (310)..(310): n is a, c, g, or t
  misc_feature (328)..(328): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (343)..(343): n is a, c, g, or t
  misc_feature (349)..(349): n is a, c, g, or t
  misc_feature (356)..(357): n is a, c, g, or t
  misc_feature (367)..(367): n is a, c, g, or t
  misc_feature (371)..(372): n is a, c, g, or t
  misc_feature (375)..(375): n is a, c, g, or t
  misc_feature (385)..(385): n is a, c, g, or t
  misc_feature (387)..(387): n is a, c, g, or t
  misc_feature (398)..(399): n is a, c, g, or t
  misc_feature (452)..(452): n is a, c, g, or t
  misc_feature (494)..(494): n is a, c, g, or t
  misc_feature (504)..(504): n is a, c, g, or t
gtagctggcaccaggagccgtgggcaagggaagaggccacaccctgncctgctctgntgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcnacgatcacatcgacacctgggagtggaatgatgtgacgctctacggcatgctcaanacactcaagaacaggaancccnaacntgangantctctngtcggcnngaggatggancttnnggntctcaagatntnttccaagtatnncctccaacacccagagtcgccggactttcatcaagtcagtaccgcatttctgngcacccatggctttgatgggctggaccgttgcctggctctancctggacggngagacaaacagcattttaccaccctaatcaaggaaatgaaggccgaatttataaaggaagcccagccagggaaaaagcagctcctgctcagcgcagcactgtctgcggggaaggtcaccattgacagagctatgacattgccaagatatcccaacacctggatttcattagcatcatgacctacgatttcatggagcctggcgtgggaccacaggccatcacagtcccctgttccgaggtcaggaggatgcaagtcctgacagattcagcaacactgactatgctgtggggtacatgtttgagggctgggggctcctgccagtaagcttgttgatgggcattcccaacttcgggaggagcttcactctgggttcttctgagactgg

SEQ ID NO: 629322 - DNA, 1089 bp, Homo sapiens
tcagcccccgtccccgaagactgctggattcccgttggcagagcggggttgggttctggacagatgggacagatgcatgctaccgcaggtcactgggggagcttgtgagtctgctgctgcttccaaggctcatccctatgtatgtatcagcattccttgtgctgagtcatagtccattgtatggacataccgcagttgtttatccagtcacctgtggatggacgtttgagttgtctccagttttggctgttatgagtaaagctgctgagaacgttcatgaacaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaaaaaaaaaaa

SEQ ID NO: 629323 - DNA, 1043 bp, Homo sapiens
agcataagctttccctgtcaacatttttcctacatgttcatgagtctgtggatgtgaacaaagcactaggagaagcaaaggtcacgaataactggcggcgatgcaaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaaaaaaaaaaa

SEQ ID NO: 629324 - DNA, 659 bp, Homo sapiens
cagctgatctagaggatcccatgcgcgagctccatcaaatcctcaacatgagtactattcgcaagcctgctgtctgctgagttgtctttttttttattaggaaatgaagtctggctctgtgtaactcaggctagagggcgagggcttgatctcagctcacggcagcgtccgcctcctgagtacaagtgattctctggcctcagcctcccaatgtagccggggaccacgggctatccgccaccactatcgggctaagtttctggattttaagcagagagggggtaccaccaggcgggccaggctgggccgggagctcccgacctcaatgtgatctgcccgtctcgacctcccaaggcgtggggtattacaacccacccatggcctcaggcaaaggacaggtgggctttcccaaaatttaaggtcagaaataggcgttggctaactaaacacagattcaaaatagtgcttatgtccgagcactggggaaggccaagaggggaggatcactggagcccaggagttcagggccggccggggcaacatagtgagacccggtctctatgtcctaaaaaggacctagtaacagtatattcacatgaacacttatgctatcatttcttcctaagcccagtgtaagataagacatattggatggacgc

SEQ ID NO: 629325 - DNA, 965 bp, Homo sapiens
ccgagcgcttccggtgcgtgtggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaaaaaaaaaaa

SEQ ID NO: 629326 - DNA, 260 bp, Homo sapiens
  misc_feature (196)..(196): n is a, c, g, or t
catctgtggtcaggtgatgcagtggtgccatcttgtgctcagtgtaacctttgtctcccgggttcgagtgattctcctgcctcagcctcccaagtagctgggattacaggcgcctgctacaacacctggctaatttttgtatttttagtagagatggggtttcgcctgtgttggctagtgctgacctctgaactcnttgacttccaggtgttcttgccttgcgcttgtgcctcccaaagttgctgggtttaccaggtgtg

SEQ ID NO: 629327 - DNA, 824 bp, Homo sapiens
  misc_feature (57)..(58): n is a, c, g, or t
  misc_feature (195)..(195): n is a, c, g, or t
  misc_feature (412)..(412): n is a, c, g, or t
  misc_feature (491)..(491): n is a, c, g, or t
gcccccggactacgcacctcttgcttgttcctcctgagtatgttatgtgaagttttnncgtgctcgcatcgacgtctgttggcgcttggactcagcagtcgtatcatacacaacggttctatgtactttgagcacgacgacatcatagcatttaggattgggtctccgtctgattgccgtatacgcgtataacantccgcgagatggaatatcacaagagcaccatcttcttgttactttggcatccctggctccacagccagtgacaaggtcgtgatgccttggtctgctaggactggcattactccagtacccgacgcccaacactcgctttgatctatactcttggtggtcttcacacttaagcaagtatattggcgacgctactaaccacgtccagccagcaacttangaaccaccatagaatttcgcaaacactctggatgacgatacccaacagtcgagcattgtatggcaacacgtgggatccnttcccacaaactcatgatgcaagatctaggaagcacacgggtattgagtggtaggcagagatcctggagattccgcagcacaaacagaacagcttgcatcaaacctactttgactctttatacaactaagattgcgagaagcttaagttcagtgcggatggcaggtgatgagcactcagccaactcggtttgcttttagtggaatttgcagaccaaaattctgtaccaagggcccttgcttctaatggagttatgtatggagacaggccactgaaaactaaatcactccaacaatgcaatagtaaaaccccctgagatgacacctcaggctgc

SEQ ID NO: 629328 - DNA, 762 bp, Homo sapiens
ccgagcgcttccggtgcgtgtggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccaacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaaaaaaaaaaa

SEQ ID NO: 629329 - DNA, 241 bp, Homo sapiens
gcacgagacttatagcctgctacatacctaggccatatgatatagcctcttattcctaggctccaaacctgtacagcatgttattgtagtgaatactgtagacaattgtggtacagtggtaagtatttatgtatccaaatattatctaaacatagaaaaggtacaataaatgatacacctgtacagggcacttaccaatacagaagcatgaccatttatatagaaagttttaaggaatctc

SEQ ID NO: 629330 - DNA, 231 bp, Homo sapiens
ttagaggaccctgtggagaaaagcaggcacgttggctcacactgagcacctgtaattccggcgcatgggagactaaggtgggaggatggcttgtggccaggagttcgagaacagcctgggcaacatagtgagacctgcccccccatctctacaaaaattaaaattaaaaaaattagccaggtgtggtggcgcatacctgtagtcccagctgtactggggaggctaaggcag

SEQ ID NO: 629331 - DNA, 81 bp, Homo sapiens
  misc_feature (73)..(73): n is a, c, g, or t
tgagttagcatgagatagtatcaaaattgagggccaagtgagggtgaggaaaagcagcaaaagatggggagcnccctgagc

SEQ ID NO: 629332 - DNA, 336 bp, Homo sapiens
ccaggcataaactgaacactggtcagacaagagccacaggagtgtctgccaatataaacaagtttcccatgtgaaggactccttggcaaatgatcagacaactaagcattaggtcacctgccaggtaaaagaaatatcccctgaaaggcacactgtaaacatctatgtccagctctccttcatttctatcacggtagggttgttgctagctgctctggcgctggagccccagtttgagctgggggctctcaaaacccttgcacactgttagagaagccaaggtaggcggatcacgaagtcaggagattgagaccatcctggccctggtgccctgtt

SEQ ID NO: 629333 - DNA, 314 bp, Homo sapiens
  misc_feature (295)..(295): n is a, c, g, or t
ggaccccacattgcaggactacaacagaagcatgttctagcagcactaatggcggcactcaccctcccaaagtacctttatataacagcattttggcaaacgtggtagtagtcatatctcagactttcttgtgaacacctgaacactggggaggttagactaagcatctttatgagggggtatctgtactaccgggcactgtttaacagacattggccgcagaatatctttggtatgccaggagtcaaacagcagtcatcatgccagctgctcttcaagatggcatcactcttancaatcctgccagatgttgg

SEQ ID NO: 629334 - DNA, 120 bp, Homo sapiens
catggatttgctggtgcagtacaactaggcttaatagggactcgaattcgagctcgaattcgagcctcgaattcgagcaagcttctaacgttagaagcttgaattcgagccgtctcaaaa

SEQ ID NO: 629335 - DNA, 149 bp, Homo sapiens
gtccctccaggcaggtgactgaggccgtgaaggtggcattgacgtcgggtacgcacatcgactgtgccatgtgtacagatgagatgagtggggtgcatcagagagctcaggagcagtgtgagctagagctctcatcgtcacagctttgt

SEQ ID NO: 629336 - DNA, 107 bp, Homo sapiens
catggatttgctggtgcagtacaactaggcttaatagggactcgaattcgagctcgaattcgagcctcgaattcgagcctcgaattcgagattcaagcttctaacgt

SEQ ID NO: 629337 - DNA, 186 bp, Homo sapiens
atgtcaagaactgagaatgatcatgaagggagccggcacatgatgagggctgactaattagagatccatgacctcccagacccctgaaggagatccggcgcataagccaaacctaccagcagcaatatggacggagccttgaagattacattcgctctgacacatcgttcatgttccagctgagtg

SEQ ID NO: 629338 - DNA, 240 bp, Homo sapiens
atcagaaatatcccgatgagtgcagccagttattgaaggttcagtttgttcaacggttaaagtctagcggtgatatgagttctagccggaggaaatgcgggttggtttctatatacttcaattcctccctgtacgtaaggtcaagagatataaggcatcttcacaaggtgctttcccccgtaagaatatgatgtcaaattagtatatagacccactccctccctagaacagggtttgtta

SEQ ID NO: 629339 - DNA, 337 bp, Homo sapiens
ttattctgaactttctaggcaggtacgtgttggagatactgctgtggctagctgaggtgaatgttcaaatggaatatggcactatcaagcatctggcgacagaaacctaaagccctggttgcctcagtgtcatgagtgaagcatagaatgcagaggggcccggttgccccaatgtcaaaatcgtgttttcgagtacttaagcacaagacaagcaatcagtgaatatctcaaatctgaactagattgtccaactccatctctgtggcaccttcatagatggtgcccacctgccttggcagtgatgaccgacactgcgaacgctgtgctggcagtgtgt

SEQ ID NO: 629340 - DNA, 151 bp, Homo sapiens
atattataacgtgtgtgtcagtgacaatatgtatgtctttggttgttagttatatactgtctacctttgagatgcaaggtaggtggtgtcacagatactctcaaactttatgaatacggcgtaccgagcctcgcaatttcgtagatcatgg

SEQ ID NO: 629341 - DNA, 101 bp, Homo sapiens
cagcagagtgctgatcttgctggaaaacagctggaagatgggcgcaccctgtctgactacaacatcctcaatgatgccagtactggagctcggatgttcgt

SEQ ID NO: 629342 - DNA, 194 bp, Homo sapiens
tcatgctcggacctctccctactgtatctagactggagtgcagtggtgagatctctgcttgctgcaacctctgcctcccaggttcaagtgattctcctgcctcaggctcccgaatagctgggattactggcgcatgccactacccctggctaattttccatttttattagaggaagtaggatacagtagggaga

SEQ ID NO: 629343 - DNA, 591 bp, Homo sapiens
tgtagctgatccgtgctaagaaaaaagcttatagctacaggtgactatttaaaaaaggagaatttacttcaaataatctgatgatgcatcttaaagaattagaaaagcaagattaaaccaaacccaaaattaataaaagaaataataaagatcaaagcagaaataaataaaattgaaatgaggaatacaaaagatcaatgaaacaaaaagttgttttgaaaagttgacaaaactttagccagaccaagaaaaaaaagagaagatccaaataaaatcagagatgaaaaagaagacattacaactgacatcacagaaattcaaaggatggttagtagttactgggagtaattacatgtcaatacactggaaaatctagaaaaaaatggacaaatttctagacacatacaacctaccaagattgaaccacgaagaaatctaaaacctaaacagaccattaataagtaacgagatcaaacctgtaataaaaagttttccaataaagaaaacctcaggacctggtggcttcacttgctgaagtctacccaaacatttaaaaaagaactaataccaatcctatttaaactactctga

SEQ ID NO: 629344 - DNA, 295 bp, Homo sapiens
  misc_feature (25)..(25): n is a, c, g, or t
aggtgattagaggatctcgggagcnttacctaggagaaggtgaagggagatggggaggggagatgagataccccaaaattagatttgaagtctaacgatcaagagataaaacctcttgcacgggaagctgggtcattgtgacttgtacttctgtgttttctataaatagaatggtaacaactaccatgattagggagctggactaaggggaagctaggggttttcttactctaactggtagcctttccatggtcctgtgagatggggaattcctaacttaacagatggggaaatg

SEQ ID NO: 629345 - DNA, 338 bp, Homo sapiens
gatgatgcaaatcctcagattcttgcagccttcagaagacttgatggtctggtagaaccaccaacaggatacattgaaagcctgcctagggtagttaaaagacgagtaaatgcttcaaaaacctccaagttaaatttgcacagatagaggccaaattctatgaggagtacatgatcttgaaagggagtatgctgttctctatcagcctctatgtgataggcgatgtgaaattatgaatgcatttatgcacctacggaagagatgtgatggacaccagatgaggagatgagatttcggaggattgaaagaaaggccagattgagatgagaaaaggatga

SEQ ID NO: 629346 - DNA, 405 bp, Homo sapiens
gtcccgttattactctgccatccaggagtatccaatcaccctgaggctcaccaatagtctaaatagagaaaccaccggaacccaatatattcacagcacctgcttattaccattttactgggtctctattttaccctcctaccagcctcagagtacttcgagtctcccctcaccatttccgggcggcatttacgggtcaacattttttgtagccacccggcttccaccgaagcttcacgtcaattattgggtcaactttcctcactatttggttcatccccccactaatatttccctttacaacccaacatcactttgggtttgaaacccccccctgaaaactggcattttgtagaattggtttgactatttttgtaagtttccatttattgatgagggttttta

SEQ ID NO: 629347 - DNA, 851 bp, Homo sapiens
  misc_feature (64)..(64): n is a, c, g, or t
  misc_feature (83)..(83): n is a, c, g, or t
  misc_feature (93)..(93): n is a, c, g, or t
  misc_feature (106)..(107): n is a, c, g, or t
  misc_feature (111)..(111): n is a, c, g, or t
  misc_feature (114)..(114): n is a, c, g, or t
  misc_feature (182)..(182): n is a, c, g, or t
  misc_feature (189)..(189): n is a, c, g, or t
  misc_feature (227)..(228): n is a, c, g, or t
cctatcaatcactgattcatgcccctcgaacccagaaaacacgggctaagagctaacgtcaaanatttttctctacaacccancgctacatcnacagcaaagttgnnaaancanttcagaaggcgaatggctctccttcgatgtaactgatgctgttcatgaatggcttcaccataaagacnggaaccngggatttaaaataagcttacactgtccctgctgcactnntgtaccatctaataattacatcatcccaaataaaagtgaagaactagaagcaagatttgcaggtattgatggcacctctacatataccagaggtgatcagaaaactataaagtccactatgaaaaaaaacagtgggaagaccccacatctcctgctaatggtaatgccctcctacatacttaggttacaacagaccaaccggtggaataagcgtgctctaggatgctgactattgctttagaaacgcgccaggatacttgctgtctacaaccaatcttctctgatataaaaggcatatatgctggagtggatacacgaacccaaaggatgcgacaccaatttctagagatggagctatgcccgttttcattggagttcatactactcatgtcacgcagggtttagagtttctataatatcctgcagttaaaagtgtcgtgtttcatccctagagttccagcccccaaatatacaaaggcttctaacctctctgtacttacttgggcaagataactgaaacatggtactaagtaatttattagcgcggtttcatgcgtgcttaatgcttctaaacatatttatgaagagttgcaaagatccgaaccgacatcgttgcgtgattt

SEQ ID NO: 629348 - DNA, 260 bp, Homo sapiens
gcgcgtagttcatatcctggctccaggacgtggatacaagtatgaccgcatgaagacttgcctcctcatgcgcgcaggatcacgaggccgcgcgcctctaaggccgtgcagagaatggagtggcaggtgaaggtgcaggaactggaccccggtggagagaagtccctgtgcgtgaactgagggtgccctcatatcaaacgtgctcattgatcgtacgtcaatgagcgactttgtagtggtgtgccggcgatgacaccgcg

SEQ ID NO: 629349 - DNA, 1685 bp, Homo sapiens
tgatttctgtttgttgtttgttgttgttagtttgtttgagggagtgaatgatggtgaaattgtgtttgagtgtatttagttgagggtggtgtgatatgaggtgtggtgtgtcgttgtagatgtttatttgttgatattgtgttaagattgatttatggattagagttgtagaatatgtgaattgtatattgtagatgtgtcatgttgatgttgtgtttggttttgttgttgtatgggtgggcttgtctcggttgtggcttcttgcgttcgtgttggaggttcttcttgttggtttggggggttcctgcgtggcgtgtgggactttgttgtgtttgccccgcggcggggtgggtttctcggcgccccagctggttgtgtcgatgctgtccccctgtagtggggtgtgtgatggacgcccgctatgccgggtgttttttgggggtcctccaccacgtatttggtggtgaccctttcttgaagggtggtcctcccccccacacaggggtggtggggagccaccacagagaaacccccacgggcgcttttgtttgtgaaaacccgcgctccgcgcccccccttgttgatcgtatattttatcccgcggggcttcctaataaagggtgttttcctcagagggccccccttgtgggggtgggggcgcgacaaatttcttcgcggccacccctacagagtggaggtgtaataataaaccgttatgagaatatagtgttgtgtctccgcccgttggctccatagtgagttattaggagagtggtggcgcacagacagcacagcgggttgttgtcctcactcgaggagagaacgccgcttctcttgtttcacactgtagaaaaagtagtgtgaagacacaacacagcagtgtgggtggtgtgttttttgtgagagacacacttgtgttgtcacagcggtgatgtgttgttatatgttgtcacagagagaggagagtgtcacacacaatgtttcacagtccccgagagtaacactactctgttgatgagagagcgctgttgtcacacaagactctctctgatgatactcccgctgagagtgagaggatctctctctctcacactttctctgtgagatagagttgtgtgagagatatgtgagagagtagagagatatactctgagatatgtgtgtctccccgtagtagttatttgagggtcacagagagtgacacacagcggagagtagtgttctgttttgcacacacatctcagcggcgacatctctctcagagacacacacacagcggtgtccccctgcatattgtgtttgtgcacaccaccactgtacacacactctcatcacatctctcgagaggagacgacaagagagtctctctctcccgcttttagagccacagcaacaccccacttgtgataatggagagagatttgtaaaactttcttatgccaacattccacagagagggagtaaaatttcttgtgctcttttaactcttaaaattaggagaaattttttttttaaaactataaaaatacctgaaattgttccgcaaccacagtgtttatattccccgcacactgtgtgtagttatgaggtgttgttgtgaatagacactccccctctgcgagagagaaagggtacacccacaacccctggataaaatgtggaaataaaattataaaattcaccca

SEQ ID NO: 629350 - DNA, 863 bp, Homo sapiens
  misc_feature (69)..(69): n is a, c, g, or t
  misc_feature (95)..(95): n is a, c, g, or t
  misc_feature (105)..(105): n is a, c, g, or t
  misc_feature (118)..(119): n is a, c, g, or t
  misc_feature (123)..(123): n is a, c, g, or t
  misc_feature (126)..(126): n is a, c, g, or t
  misc_feature (194)..(194): n is a, c, g, or t
  misc_feature (201)..(201): n is a, c, g, or t
  misc_feature (239)..(240): n is a, c, g, or t
ttgcttgtttttgtcgaatgtgtcctcacccgcctgcgttcttttgtctgttcctcactatcacacatntcacgcatgttcatccttcaacccancgctacatcnacagcaaagttgnnaaancanttcagaaggcgaatggctctccttcgatgtaactgatgctgttcatgaatggcttcaccataaagacnggaaccngggatttaaaataagcttacactgtccctgctgcactnntgtaccatctaataattacatcatcccaaataaaagtgaagaactagaagcaagatttgcaggtattgatggcacctctacatataccagaggtgatcagaaaactataaagtccactatgaaaaaaaacagtgggaagaccccacatctcctgctaatggtaatgccctcctacatacttaggttacaacagaccaaccggtggaataagcgtgctctaggatgctgactattgctttagaaacgcgccaggatacttgctgtctacaaccaatcttctctgatataaaaggcatatatgctggagtggatacacgaacccaaaggatgcgacaccaatttctagagatggagctatgcccgttttcattggagttcatactactcatgtcacgcagggtttagagtttctataatatcctgcagttaaaagtgtcgtgtttcatccctagagttccagcccccaaatatacaaaggcttctaacctctctgtacttacttgggcaagataactgaaacatggtactaagtaatttattagcgcggtttcatgcgtgcttaatgcttctaaacatatttatgaagagttgcaaagatccgaaccgacatcgttgcgtgattt

SEQ ID NO: 629351 - DNA, 277 bp, Homo sapiens
  misc_feature (7)..(7): n is a, c, g, or t
  misc_feature (76)..(76): n is a, c, g, or t
  misc_feature (120)..(120): n is a, c, g, or t
  misc_feature (130)..(130): n is a, c, g, or t
  misc_feature (138)..(139): n is a, c, g, or t
  misc_feature (159)..(159): n is a, c, g, or t
  misc_feature (161)..(161): n is a, c, g, or t
  misc_feature (167)..(168): n is a, c, g, or t
  misc_feature (171)..(171): n is a, c, g, or t
  misc_feature (189)..(189): n is a, c, g, or t
  misc_feature (194)..(194): n is a, c, g, or t
  misc_feature (222)..(222): n is a, c, g, or t
  misc_feature (255)..(255): n is a, c, g, or t
aaaagtncttcatggtttttgtataataaaaaccaaaaaagtgacattttaaactaattagtgctttttgctttcnagatcttttgctcacaattcactgcaactgagggggtgtgaatntcattatgcnataaattnngggccccagttggctggggngntttggnngcnaacctgccttgggggggnttggnagatgtgtatctttcgcaaacttttaanacaacgtaagtgtgagataagaacatatttganggcactgtttgggaaggggtgt

SEQ ID NO: 629352 - DNA, 155 bp, Homo sapiens
tgtaattggggtcgttataggaccgcacctgtagcttcatgtccatgggcacgatgcgcatcacgtggttcatgccattgatcagtgtcagtacggcgatcgggcttggcggccttgagcaggcgggcatccttgacctctacctgaatgtcgtg

SEQ ID NO: 629353 - DNA, 359 bp, Homo sapiens
ctgcagtttgtatcactcgttcttgatgttatagccatcatatctcgcgagtgcctgtcggcaagtgaggtattcccttagtgttcagcgcctccgaatttgtggtggatccgcttaaagctcatttgctgctttctctcatgtcactcgctcttattcttgctcgttttggctgtagtgaagcgtgcgcggcaggaacaggttgcccagtctaccctcccttagcatggacctactcccaccctggatcctccgtacacctaaccatctcctccttacatctagcatgtgtctcctctatcttagggcgccatcaatttcatcacaacaattatcaatataaaaacccctgccataac

SEQ ID NO: 629354 - DNA, 270 bp, Homo sapiens
agaggatcccccagaggcataggaggatgtagggagaacggagttatgcttgagacgtggggacaggtacctagaggaggggtgcgtgcccgtgtctggggtctgtcagggaggcgatcccttgggtcttgggaggctggcactgctgagggttgggctggctgaggcccaatttctgtgggaggagctgacttcgcggtccatggcatcggcggtctcagtggcgtcctccagctcgcgctgcagtttccgggcgggaggcgttggccc

SEQ ID NO: 629355 - DNA, 203 bp, Homo sapiens
gggaaaaggagcggagcagggaacctcaaggcggtctgcaggagggagggcccggaaggagggagggggcaagccacttggccccgcgctttcaggagctagagaggtataagaaccttattctggccaacttgcagcaggagggtcttctcttcccttacaagcagcagccacctttttacaattcttcccttccctactgg

SEQ ID NO: 629356 - DNA, 231 bp, Homo sapiens
agagcccaaactgtgcctgagggctgatgcatccagaccttgtaaacattcacctaggtgtaacataaccagaaaggctgaaggaaggcttttggccttcccagcttcccaagtaggggcctcatgtgtatctggcggcctgcaaagcccaaagcagagagctatgatgaataaaatattcttattgcttttctaaaataactcctttaatatgggactgtttggactctg

SEQ ID NO: 629357 - DNA, 1361 bp, Homo sapiens
gctgcatgctcacactaacctcgcaggatccgacagacgttctcttgagcgtgtgtccccaggtcatgtctccgggtcctgagcacccgagagggaggtcgaagggctgtgattcgtaggagtctgcagaagcaagcgagctcgtccgtgctcatgtgggatgtggtcgtgaacatggtcaaggcctgcgtgaccccacagccccttaagtcctctagcagttgtgtgggcctcggtggctagcggcgagcatggacgacaggctaggagtgggtgccagacctcattcttctgactagccttctagctattaggaggaacttccgtaccatggtgggcccgagtgtgacgtgatgaccggatcccgtgactagaacttagggccattgtgatccctcatcttacctttggaagggatgcgttggcttgccacgatccaactttaatctttgcgtccacttgctctccccttacaagtttccctgagcgggaaggcgatccggtcgtgcacgtcgcgagacactacaggcaccgtcgcatggggcatcaagtgaacggttagcagatcggtttacgtacacttgatcccttgaaggtgccaaaccttgtttggggcaccctcaacgcttcgaactccaaggggcgcaccattgtatcgggcatagcaagatggttgcacgcttctgtgggcataggtatctaggggacttaacaagcctggctgtggcagtgaaccagctggtctggcgaaaaggaataggttatgcccctaggttggtactttacggtccatcaattaaggggataatcttgcatccctcgcgtcggtctatcgccgacacccgagggccggatgccctgtcaccgtgcgagggacaccgccgcatgcaatgtccatgcccagcagcatgccggccttcttttgggtggcacggtgctcagaggagtgttggatcttttccccaccacggtggaactcacccactggcttataatgtggttacccaaggggtaccccagctggacaaaagccatagtgggcagttgtgtggaccgcggagtgtcacgcaccttgtgataattcttctctatactgtcgtggccccgacgcagctcgcagtgggactgcgcagggtcccggattcgaaataggcagtaccatgacgggcagtctgctgacgactttcggtgcaaatgtcgctaggctgcctgtatcatactttattagcgcctatgacgcctgcccactgaacaaagtaacacaatgctgtgagacaccgcggcttcaaatgttcaatcaagcatgacaatcccaggtggtactacacataggagtggtgcctaccgatgcgcagattgaa

SEQ ID NO: 629358 - DNA, 137 bp, Homo sapiens
  misc_feature (1)..(1): n is a, c, g, or t
  misc_feature (65)..(65): n is a, c, g, or t
  misc_feature (74)..(74): n is a, c, g, or t
  misc_feature (83)..(83): n is a, c, g, or t
  misc_feature (86)..(86): n is a, c, g, or t
nttgttttctggcttttgtgggtgggtaaaatctgtttgtaattaatggtatttctactggcctnttccggggngggccaggnccncatttatggtttctgggggtgtgtactgtaattctttgtttgggatagtgg

SEQ ID NO: 629359 - DNA, 352 bp, Homo sapiens
  misc_feature (11)..(11): n is a, c, g, or t
  misc_feature (63)..(63): n is a, c, g, or t
  misc_feature (66)..(66): n is a, c, g, or t
  misc_feature (85)..(85): n is a, c, g, or t
  misc_feature (150)..(150): n is a, c, g, or t
  misc_feature (157)..(157): n is a, c, g, or t
  misc_feature (181)..(181): n is a, c, g, or t
  misc_feature (243)..(243): n is a, c, g, or t
  misc_feature (257)..(257): n is a, c, g, or t
  misc_feature (290)..(290): n is a, c, g, or t
  misc_feature (328)..(328): n is a, c, g, or t
  misc_feature (333)..(333): n is a, c, g, or t
cttcctgtaantggggaacagaatgtaaaaaaatccatccaagtggccaccgataaaagaaanaanaaaatgcatttacactcanaaaatcagtcaactcacatgcaaaaggagaagcgtctccaatcggagcttagggccaaaaattanaaatggnagagacttgagctatccataaganaattttaaaaatccttccactggacactccccttcattaaaaaagtatgcaaaaaatcttgntataaatggaaaanaggggtgtggctctctccctgggacatgagggnatagctaaaattccctggggggaattaaagcctggacnattgntcctccctttcaggacaaa

SEQ ID NO: 629360 - DNA, 443 bp, Homo sapiens
atcgcccaatataggaacttactaactacacccttcccatttacgaatcaaacataactgtaaacttagtataacagtaaggcatgagtaatcctctgctagttagaacagataggtctagtattcttcaggaaacctcttactatacctgaaggcaacaggcactatgagtaggaggtctcagctgtcagtagagaattagctagaccggctggggagtaggggcacttaatttccactagaagagaaatttatatactggagcaccaactctaatctctactagcaagcagcctgtacaattcctttatacaaacaacaacagaaacaataacaagaaatatatacctggtatcaatagtggcgactgcctgtgtactgtgcataaagagttgggggagagtaggagagggctcaatcttacaactggagtaattcttcag

SEQ ID NO: 629361 - DNA, 1079 bp, Homo sapiens
  misc_feature (555)..(555): n is a, c, g, or t
ttattcttttctatatatttagttataaatctttctctgggccgggcgtggtggctcacgccagtaatctcagcactttgggaggctgagacaggcgaatcacgaggtcaggagttcgagaccagcctggccaacatggtgaaaccccgtctctactgaaaatacaaaaaaaaaaaaaaaaagagaaaaaaaaatcttaatcgggaatctgcttaaacccaatatatttatgggatcattggccaggttgaaatctttggaagaagaagtggttccagagtattaagggtgcagtgaaacaactttggggaaatcatggccttgggtcacaagagaaatttttaagtgctcttaactcttccatagaagagaaagagccaatttattattattactattgttggggcataaatttaccattaagccatttgtaattaaccattcgaggggtctcaaattttacaccgtgtgccttatacctcaactttggaggggccccactttttctaaaattattctcagataccctcttgtgggacatataagagaagcgcntctggacatatattctccctagaaatgtgccttttaaggctctcttataggaaaaggctccaacgcttttataacacgagtgatactcggtgccaaacgcaaaaaacccttttccaatatatgtgtcggggggaactataaaattcgttggcgacccacttcgggggaattatatatacctttccagggtgggacagtacaaacgggggggggatttttgggcacaaatttttgggaaaaggggggcacaatatgggataggcataattatatatgatttgttaaaccaagttgtgcatctctaggaaggtgtgtgaatataacatctattaaagagacagtcttttttataaaacgtggggattaaaaaagggcgccacacatgggaggtccattatttggtgggagattaacaccaaaagaagttgtgttgtgatataggacaaacttttatagaaaaagcctgtgtggtggggggacaagaaaaatgttggtaaacctctaaaggtgttagacattaaccg

SEQ ID NO: 629362 - DNA, 788 bp, Homo sapiens
  misc_feature (143)..(143): n is a, c, g, or t
cactagaacatgattgcgcaagtacccttggagccctcgaaaagggttttcccctgtgaagggcacctcctctctccggtaccatcattttccacgtagttcacctcttgaaggggagtaaaaaatatttggtgcggtgcggngggacttggaaccattgatcaaaaggtccaaagttgcagtaaggaccgtgtccaagagttccattgaacagcatgctgtcacaagttcatgccagtgcatagtcttcttgatggatgcccaaagagtagattctaaatgttctcgctccaaatgaatatgtcaggtaatgcacatgaattagtgtgattagccacttccacgatgaagacatgtttcagagcctcatggtgtatgccagatatatatgcagtctgtgtcaatttaaacagtaaatacaagttttgtattcatcaatatgcactcatatttatacccaagagcaagcgttttatgagataacttatgttatttcgccatttaatagcaacttcaggctggacatggtggctctcacttgtaatcctagcgcttttgcaggtagggtggcaggtagcagattgcatcgcattaggacagactggggaacatgcagaaactctgtctctacttaaaattaacggggcgtggtggcgtgtgcctactgtagtcctagctctctgggaaactgaggtgggaggatcacttgaccccaggaggtctaggatgcagcgagccgtgaccatgctcgtgtcaatgcattccagcttgggtgagagagtcatgcc

SEQ ID NO: 629363 - DNA, 704 bp, Homo sapiens
gccttgctctcgcccctactctttctggtgttagatcgagctaccctctaaaagcagtttagagtggtaacaaaaaaaaaaaaacacaccaaacgctcgagccacaaaagggatgaaatttcttctggacatcctcctgcttctcccgttacgggatcgtctgctccctaaagtccttcgcgaagctttttattcctaagaggagaaaatcagcccccggcgaaatccgtgctggattacaggagctggggcattcgaccttgggcgacactggactggcctatgaatttcggctacacttaaaagcaagctgggtctctgggcgatataaataacgctttggactgggaggaaccacgcttgccaaattgcaagggactggggttgccacgcgtccatcacctctggtggcacgactcgcagcaaccgacaacgatattctcccagctctgccaacagaaggtgaaggccgcacacttgcggacccattgtctcgaatcttcaacgtcacatcaaggctgcatgtaccacacaccacacatctcggcaccgctaccccacaagatccataagaacacccacaacactttctccgaacgtctcaccgtacaatgcaaacctcctcccgcacacaacaggccccaccaccagcaactcacgcaccaactcaaaccggccatatcgccacatgacatcgcacctca

SEQ ID NO: 629364 - DNA, 1856 bp, Homo sapiens
taggcgttgatgcgcgttcgtggcagggctgacagattccgatcaagaccgacaacgcccatgggcggcccgtattcaggacatcgacggttcggaaatcatccgccgtatggaaatgggtcaggttgccgtcgttgccgggttccagggcatcggccctgacaaccgtgtggcaacgcttgggtgtggcggttcagacacctctgttgtcgccatcgctgccggtgtgaaggccgatcgctgcgatatttatacagatgtcgatggcgtctacaccaccgacccccgcgtagagccgaaggacgcgtctttcgaagatttccttcgaggaaatgctggaaatggcatcgcttggtgccaaggttctgcaggtgcgctcggtcgaacttgccatggtgcacaaggtgcgcactttcgtgcgtcgagctttacggacccagatgcgccgggcatgggtgatccgatcaacccgcccggaacccttatttgcgacgaggatgaaatcgtggaacagcaggtcgtcacaggtatcgcctttgcgaaggatgaagctcagatttcgctgcggcgcgtggccgaccggccgggcgtttcggcagccattttcgggccgctcgccgaagagcacatcaatgtcgacatgatcgtgcagaacgtgtcggaagacggctccaagaccgacatgaccttcaccattccgacgggtgatgtcgataaggcgctgaaggtgctggacaaggtcgagggcgagatcggcttcgacaatatccagtctgaaaccggccttgccaagatttcggtgatcggcatcggtatgcgcacatgcaggcgttgccgcacagccttcaaggcactggccgaaaagggcatcaatatccgcgccatcacaacgtctgaaatcaagatttcgatcctgattgacggccctatgcggaactggccgtcgtacctgcacgcggtctatggcctcgacaagtaagcagccagctcagattccattttgaaacataattgtatgcagggccgcgcagccgaaagggtgcgcggccctgcaacattttgcgagcagcgactatttgttctggacgcgggtgtcaaaaatgctcacaaagggattggcgtaacttcgcgggcgggtattgggaatcggctggcggaacgcacgtcagcaattttgaaggagcccccgacgatcatgcgtgagctgacaaccggtccccgcgtactgctaaagcggttgcgcgaattgatggcagagccgctggaaccgcaggcgcgcctcgaccggatcgttcgtgaaatcgcccagaatatggtcgcggaagtctgctccttctatatattgcgcgctgacggcgtccttgagctttacgctaccgaaggtctcaatccgcaggcagtccaccttgcccacttcgcctcggtcagggtctggtcggcacgattggccgcaagcgcccgtcccctcaatctgaccgatgcgcaaagccataccgctttcgcctatctgccggaaacgggcgaagaagcctataattccttcctcggcgttcccgttctacgcgctggccgcactttgggcgttcttgtcgtccagaacaagaccaagcgggcatatcgggaagacgaggtcgaagcacttgaaaccaccgctatggtccttgccgaaatcatcgcgaccggcgacggtctgcgtcgggcccgtccgggcatagagcttgatctcggtcgcccgatgagtgtgacaggacaggctttcaacgacggtatcggccttggccatgtggtgctgcatgagccgcgcatcgtcgtcaccaatcttttcaacgaggatagccaagccgagctgaaccggc

SEQ ID NO: 629365 - DNA, 172 bp, Homo sapiens
  misc_feature (60)..(60): n is a, c, g, or t
  misc_feature (120)..(120): n is a, c, g, or t
  misc_feature (138)..(138): n is a, c, g, or t
  misc_feature (145)..(145): n is a, c, g, or t
tgagacagcctctgtctatcgcccaggagcatgatttcggctgactgcaacctccacctnccgggttcaagagagtctcctgcctcggcctccgggtagctgggactataggtgcacgancaccgcaccctggttaanttttgtntttttggtagagatgcagttttcacca

SEQ ID NO: 629366 - DNA, 1214 bp, Homo sapiens
ttgtcttgtgtcagtgcctttgttttaatttggcactgattgcctgctggatgttgtgatgctttgatgcgatgcctggctagatggccatgctgcctgcctgcctgcctgccgcctctgatgcctgggcatgcaacatgccccggcatgctggtgctgcatgtgctccatgctgctgccgtgtgccctgggcctggcctgcatgccccctgactgcctgtgtgtgctgcctgcctgccttgcctcctgcacctgtcctgcctgcctgctccctgtgtgtgcttgttgttgtcttgctggacttgctccctgtgcctggattgtgtaccagttgatgctcattgcctgatgcctgcctgcttgccagtccctgtgatgctgagcaagctgatgctgatgctgctgctgtggatgtgtgatgggaatgtgctgtgctggcttgtgagtgaggtgagtgtgatgtgagggatgctggggaggtgagtgcttgctggtgtgcttgtgtttttgctgtgtgtgtgccttgccctgtgtgcggggggcgagaattattccataattgtggagatgcccaaccgaatgtttgccaaaaactttgcaggcagtggcggaattttgcaggcatggttttgcttgcctggcttgctgcccggttgccctttaaaagcctggcttgccctgttgcctggggcccctggaatgtgggcgttccctttgaggctttgcttctgcctgccgcaggtttccggtggaggtggcgggatgaagatcgggacctgagtggactttgatgaactttggccagctttctttgcctttcccctgtgtcctggcccctgggcgactttacgccctgggttgtagccccccccagaacccggcccgcccaaggaaagacaaaacagcaggagttttttaagaaaagagaatctaaaaagaaatgcccgcgccttttatattgagccacacattaacttccacactttcccagtagcatatctttgggagagaagattcccattccgcttcaccctacaggtattcagatagaggccatagcgaggtcctttctcatctgtatatagcacagagcgggtgatatagagcgaatttacagcgcgggtccgagtactataaagaatttagatattatagagcagataagagccaacatttaagatctggtgagagtttagtaagtcgcccatgtatag

SEQ ID NO: 629367 - DNA, 104 bp, Homo sapiens
  misc_feature (75)..(75): n is a, c, g, or t
  misc_feature (95)..(95): n is a, c, g, or t
cctggttgatcttctcatggagtgtgtagtgatgtctctgtataactgaattgaatattggctgcctgctaggtngcggaagtctcctgccaganaatatcacg

SEQ ID NO: 629368 - DNA, 103 bp, Homo sapiens
tgaactaatcttatagagttcaactgaggccaggcacaggaatcacacctgtaatctcagctactcgggaggctgaggcaggagaatggcctgaactcgggag

SEQ ID NO: 629369 - DNA, 898 bp, Homo sapiens
  misc_feature (31)..(31): n is a, c, g, or t
  misc_feature (71)..(71): n is a, c, g, or t
  misc_feature (80)..(80): n is a, c, g, or t
  misc_feature (201)..(201): n is a, c, g, or t
  misc_feature (215)..(215): n is a, c, g, or t
  misc_feature (256)..(256): n is a, c, g, or t
  misc_feature (267)..(267): n is a, c, g, or t
  misc_feature (271)..(271): n is a, c, g, or t
  misc_feature (274)..(274): n is a, c, g, or t
  misc_feature (327)..(327): n is a, c, g, or t
  misc_feature (341)..(341): n is a, c, g, or t
  misc_feature (433)..(433): n is a, c, g, or t
  misc_feature (439)..(439): n is a, c, g, or t
  misc_feature (441)..(441): n is a, c, g, or t
  misc_feature (446)..(446): n is a, c, g, or t
  misc_feature (448)..(448): n is a, c, g, or t
  misc_feature (453)..(453): n is a, c, g, or t
  misc_feature (503)..(503): n is a, c, g, or t
  misc_feature (728)..(728): n is a, c, g, or t
  misc_feature (734)..(734): n is a, c, g, or t
  misc_feature (780)..(780): n is a, c, g, or t
  misc_feature (787)..(788): n is a, c, g, or t
  misc_feature (794)..(794): n is a, c, g, or t
  misc_feature (808)..(808): n is a, c, g, or t
  misc_feature (820)..(820): n is a, c, g, or t
  misc_feature (836)..(836): n is a, c, g, or t
  misc_feature (869)..(869): n is a, c, g, or t
cgcgggtccccgggtctgcgcagtgtgcggncctgtcgcgcgcgtccgcggccggctacgtgtcgcgcggncggcgcggngggtccgttgccgcgccgcccctggccccgccatggggcctcctgtcggaccgcggttgcgccggcgccgcgctctgcccgcctagctgctgcgcctcagcgcgccgttgtgcgtgctganctacgtggcgggcntcgcctggttcttgtgcgctggttttcccgccgctgacccngcgccctttcntgtnggngagcgccatgggctccaccatggtggaggagcagtttgcgggcggagaccgtncccgggcttttgcncgggcacttcgccgcccgaccgcaagaggtcgggggctctgccagtggcgctggcttgaacgggcgatgcggtcagttgggctgggggtctncacgcngngtttntnccggnaactgcccttcccagatgagacccacgagcgctatatgagtgtcgggcancaacgtgtacggcatcctgcgggctccgcgtgctgtcagcccgagtcgcttgtgctcaccgtgccctgtggctctgactcttccaacagccaagctgtggggctgctgctggcactggctgcccacttccgggggcagatttattgggccaaagatatcgtcttcctggtaacagaacatgaccttctgggcactgaggcttggcttgaagcctaccacgatgtnaatgtnactggcatgcagtcgtctcccctgcagggccgagctggggcaattnaggcagnngtggcnctggagctgagcantgatgtggtcancagcctcgatgtggcngtggaggggcttaacgggcagctgcccaacttngactgctcaatctcttccagaccttctgc

SEQ ID NO: 629370 - DNA, 252 bp, Homo sapiens
ttcttcagagccatcctcaaagctggttattgcacgaggtagggcacagatggttccagttttctttcacaaagggttagggaggtgccagcgagccccacaaatgagtccctctgtaccatggcaaccacaatttaaaaggggcttttgtccacccctgtagactacccccgccacgcagatttataccgtaaagcgaatgattttaggggttggggcccaaacgatctcaacctatattcaaactttaaa

SEQ ID NO: 629371 - DNA, 278 bp, Homo sapiens
  misc_feature (211)..(211): n is a, c, g, or t
acagatattgacgcgctacggggccactagctaaacgtcaaaaccacatgagatctattgttgctggcgcaaggcttttacggtcttactgcggggtatctcatagtgggtgacacgtaaggattctctacagtggcttcgcttaaatcgcgctgtctttttacggtgacgaaagctaatatcggcggccttacacggctatcaggtatgntcgaatagcgcggtctagcggtcccaaacgatgggagatacacaagagaggcttagtcagagggccc

SEQ ID NO: 629372 - DNA, 180 bp, Homo sapiens
gtcccagttgctcgggaggctgaggcaggagaatcgcttgaacccgggaggtggagattgcagtgagcccagatcgcgccactgcactccagtctggcaacagagcaagactccatctcaaaaagaaaagaaaagaagactctgacctgtactcttgaatacaagtttctgataccactg

SEQ ID NO: 629373 - DNA, 360 bp, Homo sapiens
  misc_feature (275)..(275): n is a, c, g, or t
gtggatgatctagaggatctcgggagccttacctgactatgctttgtctcagccactttttaagaataaatagctgggcaggtgggggagtgctagtcacggaatgaaactgtaagccggaacaggtgtgaggaggggaggcgataaaaagattatagggtggaggagtggaggctgaggaagaattgggacctagctcagcctgtcgaggaggggagaggtcagatgggtctgtagaaaaggaagattagaaagactcagcgacacttggggtnggtactgaggggacaggcgggagggaaagaaagaagatttgggaggagttgcactgggcacagagactaggaggggactgatgtg

SEQ ID NO: 629374 - DNA, 195 bp, Homo sapiens
tcaggaaaatcaggcgtgagcaccgtgtctggcccggcctacgtaggaacagttgtgtccagcggtgtgcttcttgaagagtagatccatgaggcgcagatggtgagggtgcaggctgtctgcacactagagccatggcaccctgggcaccgggagaaacgccactccagactctgccacgtgtggccttgacag

SEQ ID NO: 629375 - DNA, 800 bp, Homo sapiens
  misc_feature (7)..(7): n is a, c, g, or t
  misc_feature (33)..(33): n is a, c, g, or t
  misc_feature (52)..(52): n is a, c, g, or t
  misc_feature (54)..(54): n is a, c, g, or t
  misc_feature (59)..(59): n is a, c, g, or t
  misc_feature (69)..(69): n is a, c, g, or t
  misc_feature (100)..(100): n is a, c, g, or t
  misc_feature (147)..(147): n is a, c, g, or t
  misc_feature (149)..(149): n is a, c, g, or t
  misc_feature (192)..(192): n is a, c, g, or t
  misc_feature (214)..(214): n is a, c, g, or t
  misc_feature (233)..(233): n is a, c, g, or t
  misc_feature (240)..(240): n is a, c, g, or t
  misc_feature (300)..(300): n is a, c, g, or t
  misc_feature (310)..(310): n is a, c, g, or t
  misc_feature (330)..(330): n is a, c, g, or t
  misc_feature (349)..(349): n is a, c, g, or t
  misc_feature (373)..(373): n is a, c, g, or t
  misc_feature (376)..(376): n is a, c, g, or t
  misc_feature (391)..(391): n is a, c, g, or t
  misc_feature (397)..(397): n is a, c, g, or t
  misc_feature (404)..(404): n is a, c, g, or t
  misc_feature (414)..(414): n is a, c, g, or t
  misc_feature (419)..(419): n is a, c, g, or t
  misc_feature (423)..(423): n is a, c, g, or t
  misc_feature (434)..(434): n is a, c, g, or t
  misc_feature (447)..(447): n is a, c, g, or t
  misc_feature (457)..(457): n is a, c, g, or t
  misc_feature (461)..(461): n is a, c, g, or t
  misc_feature (488)..(488): n is a, c, g, or t
  misc_feature (499)..(499): n is a, c, g, or t
  misc_feature (509)..(509): n is a, c, g, or t
  misc_feature (539)..(539): n is a, c, g, or t
  misc_feature (567)..(567): n is a, c, g, or t
  misc_feature (614)..(614): n is a, c, g, or t
  misc_feature (787)..(787): n is a, c, g, or t
tagcagngcaaaaattttatttctgtttccccnccccaccactttacaagangnaaaantttacttaanccaccggattctccttttttaaagaaaagtnatcagtcatgtcaaatgtgaggaaaaaaacactaatcaattaaaaananccgtccctcttccccactgctacagcaaatttaggataaatcnacagcattcacttactttagcnggttctgatactgaggaanacttttntatttgagaatcaacacctaaagacttggctaattgtacagcatttgaatcatcactganaagtgttccnagagccacaagaaggctaanaggggcgtctagggcttgnactacttccaagattgggctaatnagngacaaacattgggcnttcccntcaaggntaggggcggnagganaacnaacagaatagntcagggccaatgnagccagagcnatgngaatgttcttattgccccctgatttcngttctattgcntgggacatcngggattcccccggggacatcatgagttttnggccggcctggccaacaaaacaattgcnaaaagtcctgagagcaagcagctggtttgctggctttcctttagggntcagaagattgataagatgactgctgaactgagccccttccttttcattgcagaagttctcattcacactggggggtttaattgacaaccgaagaatgtcaagtgcaggaaagacaatatcttcaggacagttaatagctttccacaaaatctgaagttgctggactgtgggnttttctgaagaac

SEQ ID NO: 629376 - DNA, 489 bp, Homo sapiens
cgatacacttaggtcatatgctgtttcaggggactgagtctggctctgttgcccaggctgtagtcgcagtggctggtcacttcggtctcactagctacctctgcctccgcgggttcaacgcgtttctcgctgcctcagcctcctgaagtagctcgtgactacagtgcgtgcaccaccactgcccagtctaattttttcgtaatttatagcagacatcggggtttcactggtattacgccatggatggcctcatatttccgtgaccttagtgatcatacctgccttgtgcctcccaaatgagctgggattacagtgcacagaaccacgcgcaccttggccaatcgagcaataaactatcttttctattttaccccaatttcttattaattcacacttcaaaaaagcatttcctggaagtatttctaagtgtgatggtttgtaatatataacaaatgacaagatgtaattagattataagaaaagcatctg

SEQ ID NO: 629377 - DNA, 414 bp, Homo sapiens
tatcctagtccttacagatgaacagaggcgtatatctccaaattaaaaacaaaaaaggctaaaaaattgggcttgaggtctccaccagcccgtgtgtgcgaggattttcaggacacgattatcacgggcgactacttgggaatttatccccaagaggacaggtccatcgtgtgaagaatgagtctacttcaaaggggacaggaagaacaaagaggtgaggtggaagatgggtccccccagggtctacaccagggacagaatggttgcctgctgctctggagtctgctccagcaagtatcgggcaaagggctgctccatcttcactgtgataagattctgtggagtatggctggagccatgggtctcttcccagaaatacagtgtaacctggaacttcggtaccaactcagatta

SEQ ID NO: 629378 - DNA, 393 bp, Homo sapiens
  misc_feature (17)..(17): n is a, c, g, or t
  misc_feature (84)..(84): n is a, c, g, or t
  misc_feature (159)..(159): n is a, c, g, or t
  misc_feature (271)..(271): n is a, c, g, or t
  misc_feature (375)..(375): n is a, c, g, or t
  misc_feature (381)..(381): n is a, c, g, or t
  misc_feature (391)..(391): n is a, c, g, or t
cattgggtttttcacanaactagaagttagatgaaatgatatttaaagaatattgtttaaagaatgtctgaatatcaataaagnttaattaacctttaattttaaaaagtaatctaaaatttcttacctggtagggctgaaaggcactatcttcagttnaaaaatccagttgcttatcttcaaggaattctactgcagtgactgaactgggtatatttctttcaaccagaggtttgaaagtctgccaagaaaaaaaaaatttctaatgatnattttctgggtagtatcctgaaattatgaaggaacacacaccaatacaatgtatcaatgtcattatcactacagagtcttagggacctaatattaattttcacncgtccnaatccatcancc

SEQ ID NO: 629379 - DNA, 215 bp, Homo sapiens
ctttttatttgctatcagtattatttgccatctttttatgctaatttggagggttacttttaacattagtttatagggatctacagtcttatctcgaaattttcattcctcttgtttacgatgtctctccctcctgtattctccctttactccttttgacaatttcttcttgtcctaatttcactatctccttgtgtctctgtcctcgattaggc

SEQ ID NO: 629380 - DNA, 601 bp, Homo sapiens
tcgcaggttaaaactgcttttttattatttttttaacataaaaaattcttggtagtggacatgtggccattggatgtttttatgactaagagagttcaggctcaatcttttacagaatgtaaatgtccccctatgcatgcacatgtaatccttatcaaatttttcctaaaacactaaaagaagatcccttatctgaactttcttttacagtttttttactttcgccatcaggcactggaccatctggcctgtaaaaaagatctgggcctaaaccttcggatatcattttgttgcttattgccatcactggaacacccacttgaaccattccgagatatccggcatatcttggatccttggctacagataaaatatttcctgctgaaacttcactttcctgtagtccagagcctggagtactgacccgcgggggttgctctgaagtggcttcaggatgtgctccatttgtgacactggagacattaaaaggagatccttcaacggagacaccctctaggcctgggatagatgacccctttgcatctacaatattggaagttggttcaatttggtggataccaaaggaaaggtccgccatgtt

SEQ ID NO: 629381 - DNA, 385 bp, Homo sapiens
  misc_feature (71)..(71): n is a, c, g, or t
cattttgacaatgtgtcttgcctctcaatatattgttgtagacattatgagacgtattaccattttacacnctagtaatagagataaataccataattcaaaatgaaacatcacatcaagagacaactgctttcgatgactccagactgtagaaagactcatcaaagccatctgctggcacctcttctgtctacttctcctgttcgctggggccttcctgggaactttggctgccttgttgttggtctgtggccttctaagtcacctggggcggacatccattcttgacaatggctgcagtgaggggcatcactgggagaggaaggaggacgtgtgttcgagagatattgattgatgccatccctggctgtttccacattggcag

SEQ ID NO: 629382 - DNA, 1577 bp, Homo sapiens
agcggaggctacaatgctggctgtgctgtgctgtgcggtgacctgtgacctgtgacgcgctgggcgtgtgctgtgtgtgtggtgcgctgtgtgctcatgggtgctgctggagccaatgggatgcctggcaatgggtgctgtccatgggtgctgctcatgacctggccatctgcccatgctcctctccctgcagacacaatgatggtgaatggatgacccatgtactatgacacctctgtgcgcgttgaatggccctaggatgctgatcccctgtgtagtgattgattctaacgacatcgtgtcccttattcgtgaacatgctttggcgtctgccatcaaaatgcgtatcctaccctctgtggagcaaatgtagacgcgctgtgactttgaatgtgcgctgagtggacatggtctacaaattcttctagttacttccactacggtgacattagcttgatgtgtgtggcatattctcacgtatttgcctaggatgtagaacaacgcggtaaattgcatccctatttgcacccagtggtgtctgtcggcagaaaggccagggcgccagcatattcaacgacgttacaatgtgaatcgggcttccatgagtcctgcaccgacgccaagaccattatccgtatccattatccaactccgtcaaatgtatcgtagcccttccttaacctataagacaatgtggatacacagattctagggtgactagacactaggagacttgtggcgatcctgatgaaagttgtggtctctaactaccacccgagggaacgtgtcaacagccaatgtgcgcatcaacggacacatcatggctatgtgcataacccactaccgcagaaggttgtgagcattacactagagttaagtatccatctccggttgtggtacacacacgcagacacttttcttaactgtatcagtataaccttatggtgcgaagtcggtacgcaccgcgtaacacttgctaaaccctcattttgtggtggttcactcactctatcgctccaagagtgatcacactccacacactcttgcgttacacaagtatctagtggcttcggagtagcgagcaactagtatggtcattgatatagatgtgcgtcatcggtgctgggacagtattgcgtcggagaacagcgacgaaaacggtgggcgaaactatccggcaggtatggcgctacagacatacgttctttgcccgccctgtccttagttgattagtcaaccaataggtgagtgtctcacggtaggtcagtagaatatttgcagtcagcgagagtactccaaccgacacttcgccctaacgacagctgctcactctagtatgtgcacgtcctaggcggcgtccattttgtcgagtaatataacaagggctcaagcgataactcacgactagacaacagcaccgggggtcgtgtctgcaacacactagtccagagcgtagttagtttctcatcatggtgtgtctatccacagcttacgtggatgtgactgactcagtccgaatctaatagacacgctcaagatgtgtcagcacgcagctagcgtcgacgcataacagatct

SEQ ID NO: 629383 - DNA, 888 bp, Homo sapiens
ctttcaatctgtgtgattcattaaatggaccattgatgataagaatacacatgtatgtttctgtgcacatgacagtgtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaaggaaagggaaaaaaaattagattataccttttccttgtttcaaccgccttgaaatttttgaacctccaaattcggtggaataatccaaacaaattttttacgtctaacacataatttacttctaatagcactagtatacttaaaaagcctcagggtataataatcttccttaaacaaggctaaacaattccgctgcggctaattttaacccacttttgttctctagcttgagaaaccacctaggggcctatttcactggggtgtggttcccccagggcctacactggcgtgcacataaaatatttggagaaatgcaccgggattgttaacacactcggtttggttaccattgccacaacttacagcgccgggattatgaactcgggaagaactatacattaacccaaagcacgggggggcgacacaagatcctatattacccacttgttgttccacttcgtttaaa

SEQ ID NO: 629384 - DNA, 402 bp, Homo sapiens
gggggttttctgggccccaattccctttttaagggttccccaaaaaaacaattaaatttttccaaaacccccaggaagtggggtaaaaaattttaaaaaaaacccgtttttttcccccccaccccccaaataagaccccccccctccccttttgggtggggggtattggaaattccaacccctccttcccaaggcccccctttttggaggaaaccggtgccattttccttttaagggttcccaaaaagggggggggcccccccccaaggcccttttttggccaaggaagcaagggaaaaccgtttgggcccctaacccatggggtttttttccttttaaaaggggaagaattcttttccaagccccccggccccagtttttaaaaaaaaaggggggggggga

SEQ ID NO: 629385 - DNA, 201 bp, Homo sapiens
cgccagtacttcgacgaggccaattaaatctgtccatacttcgagatagctgctggcgatacattgtctgcggacatcagggacctgctagttaatgaagttgtcataacaccactgaaccgatacatgatttagtataaaagcatggtagacgttcagcagtgtcagatgatctccatctatgtgggcaaatctcatcta

SEQ ID NO: 629386 - DNA, 455 bp, Homo sapiens
gagcgggggggccgccgtgagaggtcatgatcaggaactcagtctacggcaaatgaccggaagctctttccaggatgaacggatgcccacagaggcctgcggggtgggggcatcgctgcactggagagactgaggagttaccgctagtgatcggggacagctaatggtgtcaggtgcagcagaggtcctaccattgtctggttctagcacccgtctcgctaccacagaccatttgctgggatgacacgtgcaggccggtgacacacggccgacacctgccccaaagcgggccgcccgagacgtccactccaagcctgagcatcacacagaagttccagtgggcacctcgcgtgcctgctgtgaactgcgttgccctcggaatgttgccggaacgaggacatgcaggaccttggatttggagccgacgacaagacgagaaaacattcacaagcggg

SEQ ID NO: 629387 - DNA, 1534 bp, Homo sapiens
tacggactaggcccctatatcttctgcattatgaattaagctagaagataactttgcaatgagagcctaagctaagaccccctgaatccagtactgagctacctaagaactagcttagaaagagcacgacccgtctatgttagcagaaatagtgtgggaagatttatagtgctaggaggcgactaaatcctaccggagcctggtgcatagctgggttggtgccaagtactagaattcattagtgttcgaagctttataatgtgtgctccacatgaaatcctctcttaaacgtcccacttgctaatactttaagcgtggttcacgtccagagacggaggtaaacagacctacttctggaacaagcgtaagggacacaaaacaccgcttgctcaggagaatggaggtacacacagacacttgtgcaccagcctctgagtagtctatgggctcgtaatgaatgctagtctcacgcgaagtttaatgcaacaggacagcttccaaggcgtcgaacgaagccatcttaccgtagaaaagagttcccgataaaacgatttatatagcttcgtaagcgtcacatgcatcgatcgcccatagtttggagagcaccacattcataattgccacctctctataatgatatgcacacctcaacttgattaagtaattagagttacagcgactgtaatacaccgatgtatcatacacttcccggctattaacgccgtagctgcttcacgtatttcaaataccatctcgacacctttgcaccaatgtcaactattgccccaagttattcctacatagtccaacctcgagatccatatgtgcaattcaattggagcgctatcaaggtggtcagacgccagatcaacatggggccattgtccttctagtgcaacgggacacacgggtgttacacacgaataagaagttcaacaccacgggaaaaacctcccggggcaataaatgcttgtgagccccccgggaccctgggtgattaccccgacaagagcaatcatttctcaccctcatatacacagatcctagccaaagggtagtatacggaacgaggcacacccggccgtggtctccaaaggtgaaacaccatttgttttacaatatcagggacccgccagaggagtaatccagctttaatagaccgaggggcagacacgaggagtgacgagcaatacaatgcaaagcaatgagttatcccctgttactaccaaatacgggacaccctggaatgtttgaaaatgggcgcccaccagagagggattacgcgaccgagcacaccgttcaactctgttgtaagccacgacggaaaattgttgccctggccccggtcgtaatgaaggcgacgctacttataccaccgcatgtagacatgatagaccctcatggaggcgtaagtgagtaaatactgacgaaagactaccatacgagacccacacaggtcgtctatagatgaagcaacgtgctcgtatacattatcgtggagcaagcgacactatgcaataagcacaccgtcata

SEQ ID NO: 629388 - DNA, 453 bp, Homo sapiens
cgcttgactctgtcagaggttggatgcctaacagatcacgctctggaagatccaatgactctgcggacacgggcactcagctgagccctcagccctcatggcttacccgatgctcagcggtgcagaggagccagctggggagcctctgtgtatcgctttatattaacttatggctgaagttctccaagacgcccagagttgaattcctccagagctctgtgcagaccgtccaagcaggggatggcagagaggtccttgctagcaagaaacttacaggccaggctggtctcctgctccaggatgctggtgagcatgcaccgtccccgcagggcacaggggtatcctttgaaggtgtcaagggacaccttgagtccgtgccagacacttagggattggagaaagtgcaaccccagactactgccatctccggaactcggggggttgttcaactgt

SEQ ID NO: 629389 - DNA, 1566 bp, Homo sapiens
agcgtactgtactggcgctgcaagggccactgtaggggatctgtaagctcgctgggtctcgcggctgcggccctagcgcgcgccagggtccggcagataaatcagtaccgcgagatcccctgggaacgggatagcagtagcttgccagatgagtctcacgccgcgatgctggatgcacacgtctcgagcgctgctcacctagacgaaaatactagggatactaaggaaataagaggcaggcagcgagacctctgggttcaatgcatacgacgcagaagaaccaaaaagttgacgtacgggacgttacctgaggatgtcaaggacaatgacaatactgcatacctgggcggccacgttatactaggacgtatcatctgatcaaagcatcttcacctctccgaacatgcgagcacctcacgacctacgaaggaattaatctgcacgacactttggagctcttcaagtactcagggaaaaggtgatgcgaccggacacaaatacctcacggccacaaaatcggcgccaagcactggcggcaaaagggctatacagacgaaggtacgaccgaccccgaggaagcgcacaagcggagacatgcacgcccagcaagcagcatgctgacatcacgcacgccgagtacaccaggatccgcaaagaccagaagataggacagcgaaccgcagccacagacggccagatgcggcagaacaatcccaggtgctgagaaacctaccgaatgaggatgaaaagaaaaaagaagacaccgcacaataacgtgagtagcaagcacgggagagaatccacctatgaaagctttcagaacaataaccacgcacaacttaaccacacgaacaaacacagcctcaaccccaatccacccgcacagccgtaaagtagaggtaagacatgagcgtggccgtgtggtcctctctctcccccttcctctctcgccgacaagaaaggcacaaaggatgagacacgaacagacaggagaaaaaccttaaaagcagacaaacgaggaacaagcagcccaccaactgcaaagacgaggagaaacgaaatgacgggagagaaaaaagagacgtcaagaagaggggaaaagaggcggaacaggagacagagaaaaaggagagaggagggaaagagcagaagaaggaagcagggagacagagcgcgacaaggaaacgaggaaaggaaaagagagaaggagagaagcagaagcaagagagagagaggaaagacagaagaggagaaaagcggagagagaggcgaagaagagaaggcgaaacaagaaagaggagagggggagaggagcaggcagaaaaaaacacgaaagagaaaaaaagaaaaaaaagaaaagaaacgaacaaagtaaaaacagaggaaagaaaacaagggaacagaaaaaagaccaaagagaagaaaaaaaaaaaaacagaagaaaaaaacaagaagaaaagagacgacgaaaaaaagaaacgaaccgaaagacagaaagaagacaaagaaaaacagaaactaacacaggcagacgcaaaaagcaaaagagaaaacagacgaagaagg

SEQ ID NO: 629390 - DNA, 683 bp, Homo sapiens
caggcagagaagtagaaccaattgcgtgccacctagtggccagcctaacaaagtcagggtagcatacttgagaaaacggtcatagtctgctttcctgtcgtggttaaaaatgcctattatcaagccacctaactccttacttttccacaaaaaaacacaaccacatatcttaagcaagccctcctccacagtcataatccaaatacttgaatacagcaaccaaagtctgtcttgttaaacacactacttctcatgaaactttcctctgcctattttaaggtaggtttgcccggtcctatggcccagtagagatgacacaggagaacacggaaacatccaaaatgttcactggttcagagtgtgtacacagtaatttcgatgtctgttgcctcaaatacctcctcgatcatcgcagatacattttcccattgcagacgatcaagaccacatccaatcctgggcatggagaggtcagtgactccattctttcagacaatgagacttcattgcctctaaactcttctgtaagttttcataagttggcttgtgcgaagcccttttctttgtaatcaagtaatatgtatatcgcccatctctcttcagaacagccacttctccagatttctttcggtgatttacaagttctggcacccctccaatttcttcttaagaggaagctatcc

SEQ ID NO: 629391 - DNA, 423 bp, Homo sapiens
catgcagagatttagattcactttgtctggggtggcatttccatgaacgcttcttgggtggtttaattgtacaaccagggtcgagaatcacagctctaatgaaagttcttctacataggaaggagaggttgaggagatggaggatccctcaagctgtccaagcacaaagagattggttcctacaatgagaacagaatgtacacgcgagctgcttgcacaatgcggtacctgtacctacggggttgctcatgcattatctccattaccaagatctatgtgggacgtcagaaaaacgtttttatgcccagccacttcagccggagcttccagagtgtgcccagccgattcctcaagccctggtgtgactgaatggtggctgaccacagatggcgagcgctgacaccctagggacatagagattgg

SEQ ID NO: 629392 - DNA, 3331 bp, Homo sapiens
gctttcttttctccagaggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629393 - DNA, 834 bp, Homo sapiens
agctttatcagaggctgcaggggccctgctctgggtttcctcaggaagcaccaccccctcatcccccactctcacaactggcccatgtgatggatcgtctgtttccctgtgcgggccccatagccccatttcctgtgctggccccggcctggacggggagggggctgagactctgggcccagatcccacctcccccccaccccccaccccctggctcctgtttcctgctagtccagctcttcccctaggaaaggctgctggtaactgggatgggggttggggggaggtaagaagtctctgactcctcctctacctcatcccagttccatcacctgaagtggacctcttgggaccgtctgaaggtaccagctgggcagcctgagaggaccctggagtcgctgctggctcatcttcaggtgtgccctgttgctaccccaacccccaggctcagcccagcccggcccagctggtgtctgacctttctcctctaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629394 - DNA, 277 bp, Homo sapiens
ggaccaagcagtagtacagactcaccaagcacagacttgtttccacaagccgtcttaccttagccacgaagtcccaagccacacgtactaagggttgaactcaaagatatgtacaggggtataaaacaaataccagggggaacagttacctccaatacaaggacaaaatcagcaacaagtcctacaatccagtgctgatatcagatacaagcttcagggcacaattcctttccggaaggcttatcccagttccgtgaggctagcatgaggtgtgtgc

SEQ ID NO: 629395 - DNA, 367 bp, Homo sapiens
  misc_feature (75)..(75): n is a, c, g, or t
  misc_feature (86)..(86): n is a, c, g, or t
cctcagctcctgctcctggcttgggctcctgacggcctgccagcaccctctctaggtccatgacaggctgccttntgcttgccatngtctttccaatattctccccataaacccacccctaccagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629396 - DNA, 431 bp, Homo sapiens
ccccagggagattgacatctgtagattatgaaacacaaacaaatggagctccacaaatgagattacaaatcaatcacatgaatgacagccgggcatcagttgtggcgaaccctgtctgggtctcaagggaaatctgtcattggggccgcctcgccctggcaagatggggttaggtcctggaagtgggccaactggatcaaagcgtggtctcagtggaggaaactttttttgcgtctccccaggaccaagaatgagtgaactgagtgggtctccaacataaggaaatgttggtctttgggcatattcacccccgataaatcccggaggaaagcgggagctaggaaaagggccaaggtgcaaggggttgggatagaatggaatggggtgagttgacgatggcaggagcatcacaaaccggcctctcggggata

SEQ ID NO: 629397 - DNA, 3419 bp, Homo sapiens
gctttcttttctccagaggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtgtgagtgctgacccctctccacactcctgcatcccagaccgtcctcccatacagcttcccacccaacatcttcctgccttcttcccagagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629398 - DNA, 1018 bp, Homo sapiens
  misc_feature (45)..(45): n is a, c, g, or t
  misc_feature (85)..(85): n is a, c, g, or t
  misc_feature (100)..(100): n is a, c, g, or t
  misc_feature (182)..(182): n is a, c, g, or t
  misc_feature (190)..(190): n is a, c, g, or t
  misc_feature (245)..(245): n is a, c, g, or t
  misc_feature (253)..(254): n is a, c, g, or t
  misc_feature (283)..(283): n is a, c, g, or t
  misc_feature (297)..(297): n is a, c, g, or t
  misc_feature (300)..(302): n is a, c, g, or t
  misc_feature (305)..(305): n is a, c, g, or t
  misc_feature (307)..(307): n is a, c, g, or t
  misc_feature (330)..(331): n is a, c, g, or t
  misc_feature (338)..(338): n is a, c, g, or t
  misc_feature (346)..(346): n is a, c, g, or t
  misc_feature (348)..(348): n is a, c, g, or t
  misc_feature (370)..(370): n is a, c, g, or t
  misc_feature (431)..(431): n is a, c, g, or t
  misc_feature (561)..(561): n is a, c, g, or t
  misc_feature (924)..(924): n is a, c, g, or t
  misc_feature (954)..(954): n is a, c, g, or t
  misc_feature (992)..(992): n is a, c, g, or t
aatataaaattctcatttttcaaagtgaaagtttgaagatactanctaaagttgataacttaaatagtgtgtaaaagtaaataanttagtatattatggnagctatcactatagtaagaaacagaaaacagggggactagtggattcggtggtagacttttactttaaaatagagctatgcngcagattntccatttacttggcttacatgcagtatgtcctatggaagttataattttcttatncctctttnnttttttgtttctctatattaataaagttnaagccaggtatatnatnnntgntnccagtatataaacatatacatcnnttggttncccaggtnanccaaaaggtgttttttaaaatntccccaccataccttttaagacaacttttccgctaccctacagtaggaagtaaccacattnaaattagttaagctataaaaaagtaaaaggggccacaagctttattaaaagtaaatgcaacagttatatgtacagatggcacatggtgccaattttatttgtgaatatagtattccaactcaagtttacnagttacacctttgccacagccttggctaaatcttgaactagtgcagaattcagctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattcaccattatccagaattttcagtgctaagcaaaaagctcctgctgcaatttgagaaggaggaaagtgcaccatgtcatagtccaacatagttagttccatcaggtatttggctaaagtatgtttgctcgacatcaanctctccaatcttagatgctctccgaagaangtgcaaaggtagaggccgaccagaacaaagtttaagtnttagatctcatttcatctgtctgatt

SEQ ID NO: 629399 - DNA, 272 bp, Homo sapiens
ctctcgtcagcctcccgccggccgtctccttaacaccgaacaccatgccttcaattaaggttgcagagttcttaattgagagatatttgaaggtgatgttggaattgcccaacaatcttgtgactaataaggaccaggttggaggatttgggattggatgatgaagggagttgatgacccagttccctctaccaaattgtgaattacaggcaaatattaaaaaggggaaatacagggggcacaccccaccacagggatgaccctcctcctcc

SEQ ID NO: 629400 - DNA, 3601 bp, Homo sapiens
gctttcttttctccagaggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggtgggcagaggcataggtgtggggggtactgggaagatgtggagatcagtgtgtgtgtcagagggcacccagcgctagagagcagccctggagccttcaccaacctgggtgaagcctccagccaggatctgagggggggtcaggaggtggcaggagtgcccagcctgaagtgctgcccctaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtgtgagtgctgacccctctccacactcctgcatcccagaccgtcctcccatacagcttcccacccaacatcttcctgccttcttcccagagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629401 - DNA, 3141 bp, Homo sapiens
gctttcttttctccagaggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629402 - DNA, 631 bp, Homo sapiens
cctgctcctgaggaggagatggatggattgacacgcgctggctgctgagccccaggcccaggaccccttcgctcacctgccccagagtacccttgtgttggatggatttaagcgccagtactcccatgaggacacactctctgtggcactgccatatttctgggagcactttgataaggacggctggtccctgtggtactcagagtatcgcttccctgagaactcactccgaccttcatgagctgccatctcatcactggatgttcccgcgactggaccagctgaggaagatgccctcgcccgtgtcatcccttttgggaccccaccatagccgctccctttctggagtctgggtcttccgaggcccaggagcttgcccttccgctgagtccacgaattggcacggtggactacgagtcatacaccactggcggaaactggagtcctggcacgcgaggagacccacgacgcctggttcgagagtacttttcctgggagggggccttcccgcacagtgggccaagccttccatcagggcacagatcttcaagtgaacatctcttgccatcacctagctgcctgcacctgcccttcagggagatgggggtcattaaaggaaactgaaccttga

SEQ ID NO: 629403 - DNA, 3256 bp, Homo sapiens
gctttcttttctccagaggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629404 - DNA, 601 bp, Homo sapiens
acaaatggaacagacacttgagtctgatggttctgcaggaattgcagtgcggctaccaagggaaggcaatatccaacctgactaaggagtgctttccataaactttcagagaacatggtgcccaggtgtagggttactggccgacgtcagccaacaggccaagtaaggatagtaaacaagtacgggtaatccttctgatatggtttcgctctgtgtccccagccaactctcatttggaattgtaatccccacgtgtcaggatagggtctggtgggaggtgattgcatcatggaggcggacttcccccttgctgtatatgtgacagtgagttctcacaagatctggttgtttgcaagtgtgtggcacttccccctttgctcgctctctcttctgctctgccattgtgaagacatgcgtgcttccccatcaccttccaccatgatagtaagtttcctgaggcctcccagtcatgcttcctgtaaagcctacagtcaattaaacctcttttcttcataaattacgcagtctcaggtagttctacatagctagtgtgagaatggataataaactttcttagtttccaagaaatacactctaaaga

SEQ ID NO: 629405 - DNA, 2814 bp, Homo sapiens
ccctatctctgatctcccaacactgcagcctttagagtagagactggttccatggaagtgccaggcacacatcctggggactcctgctacaccccgacccctcagatctgtgctggaagctgcactcagattagtgaagcctcctggactgctgtctggtacttgggcatcctctggtggtgctgtgcaggctggcagcagggccaggccttcccacccaggcttctgcttcctcttctgtggaacagggtggatggagggtggctggaaggatttgagtcaggagtagagctcaggctggggctactatgcccacagagtcctaccaacaggttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggtgggcagaggcataggtgtggggggtactgggaagatgtggagatcagtgtgtgtgtcagagggcacccagcgctagagagcagccctggagccttcaccaacctgggtgaagcctccagccaggatctgagggggggtcaggaggtggcaggagtgcccagcctgaagtgctgcccctaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtgtgagtgctgacccctctccacactcctgcatcccagaccgtcctcccatacagcttcccacccaacatcttcctgccttcttcccagagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629406 - DNA, 319 bp, Homo sapiens
  misc_feature (251)..(251): n is a, c, g, or t
attcgcggccgcgtcgacgcggtagctcatgcctataatcccagcactgtgagaggccaaggcgcatggatcacttaaggtcaacagttcgagactagcccaataaacatggtgaaaccccacctctactaaggatacaaaaattagccaggcatggtggcgggcgcctgtaatcccagctactcgggaggctgaggcgggaggattgcttgaacctggggggtggaggttgcagtgagccaagatcacanggaagagtctttcctgtccctgggcaacagggaagactccgtctcaaaaaaaaagtcgacgcggccgc

SEQ ID NO: 629407 - DNA, 1412 bp, Homo sapiens
tctcctgaatgcagcctgctgaggcacttcccacctaataaagtgtgtggctaggggttgggacgctgggggctcagggggaccagactgagcccagcagcttctacttacctacctaggtgcttgaggatggaactcccttctggtcaggtcccaaacagtgtccccagcccttggagtttgacaccaaccaagtgagtgggattctgtagggagctccaagatagagatgtggcccctcagagcagaggtaggcatttctgcattctgcagagatgcacagatgcccagagagagccatgcttgtgcatatatgggtgtctacatgtgaggcaaaggcaggcactcaaacagatccacaaatggacagtgacccccaccccatgcacccatgcctctgttcctgctcttggtctggctgcaggacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629408 - DNA, 250 bp, Homo sapiens
  misc_feature (8)..(8): n is a, c, g, or t
  misc_feature (14)..(14): n is a, c, g, or t
  misc_feature (17)..(17): n is a, c, g, or t
  misc_feature (33)..(33): n is a, c, g, or t
  misc_feature (35)..(35): n is a, c, g, or t
  misc_feature (38)..(39): n is a, c, g, or t
  misc_feature (56)..(56): n is a, c, g, or t
  misc_feature (73)..(75): n is a, c, g, or t
  misc_feature (94)..(95): n is a, c, g, or t
  misc_feature (106)..(106): n is a, c, g, or t
  misc_feature (126)..(126): n is a, c, g, or t
  misc_feature (135)..(135): n is a, c, g, or t
  misc_feature (149)..(150): n is a, c, g, or t
  misc_feature (154)..(154): n is a, c, g, or t
  misc_feature (201)..(203): n is a, c, g, or t
  misc_feature (228)..(228): n is a, c, g, or t
  misc_feature (240)..(240): n is a, c, g, or t
agctgcgnttcccngangtagactctacgatananacnntcatgtaggagtcagantcagctcaaacattttnnncagagataagatgggaaannacatcacattnggggaaccaccaggattctnacattcttngtggtgtgtatttnngggntctctactgtgcagctccagagagacgtgaacatgtgaacactcaannngagcaaaagccttccatgattacantgttgcagcagntcccagtcca

SEQ ID NO: 629409 - DNA, 285 bp, Homo sapiens
  misc_feature (15)..(15): n is a, c, g, or t
  misc_feature (77)..(77): n is a, c, g, or t
  misc_feature (79)..(79): n is a, c, g, or t
  misc_feature (91)..(91): n is a, c, g, or t
  misc_feature (116)..(116): n is a, c, g, or t
  misc_feature (259)..(259): n is a, c, g, or t
ctttagaagagctanctgctgcggcgtcggagaggctcctgggaaactccacggcccagggactttcgaaagcagangnggaccctcgacngcgctagtctgcgagtgagcctcanccggcacctgttcctccagcgccgccgccttcccacccctcggacccgcgccgctcgccggcccgttcctgcgatgaatccggccctaggaaccagacggacgtggcgggcctgttcctggccaacagcagcgaggcgctggnagcgagccgtgcgcttgcttgcaccc

SEQ ID NO: 629410 - DNA, 824 bp, Homo sapiens
cgggggcataatgtgtcggcggacaacactaactcaaacctttattttatctccccgaccagcgcgcccctacgcgggggggtgctccgcgcggatggggtgcgcccatcccaaaacaaaatttttgttgcgcagcgagacagcgagccgcacgcgcaaaggaccgatcgaatacaacaccacgacatcacaagacgccgaggcactaagccccgtataccaccctcgcctgacggccgggaacgtcgcaagcacttcccgcagaggacgagccacacggtacagacacccgcgaagccggcacgcagctcacctacgaacaggctaaaaggagcaccaccccgtcaactgcgaccacaacaacgcgggcaagaatgtacacgcggcgagcgcgaacaaacccaacacgagaccaggcgaatagccaggctcgtccaaacatacgacacgcgcaggctacaacgccaaagagaggcgcacacgagaccccgctaacaccccctggcgacagtccaccgggctacggccacaaccacgaaacaggctctttgcacacctaggaaataaacactcgcgagagagaggcaacaacaagtcagcgacccagacgcacggcctaacacggacccccacccaattacagaaggcgggcccaagcaccaccagcgccattaccccgaaggaaacagacacaaacggcacgcgacacgccaggcgcgcccggcgcgcgaacgcgcccatgcgggattcaaacacctacgagcaggcccgcgagccacgggcgggcccaactagatggccaaactagggcgacaaaccgcgcc

SEQ ID NO: 629411 - DNA, 1182 bp, Homo sapiens
tctcctgaatgcagcctgctgaggcacttcccacctaataaagtgtgtggctaggggttgggacgctgggggctcagggggaccagactgagcccagcagcttctacttacctacctaggtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 629412 - DNA, 173 bp, Homo sapiens
  misc_feature (5)..(5): n is a, c, g, or t
  misc_feature (33)..(33): n is a, c, g, or t
  misc_feature (125)..(125): n is a, c, g, or t
  misc_feature (142)..(142): n is a, c, g, or t
  misc_feature (149)..(149): n is a, c, g, or t
gagtnaggcgtggtggtgcgtgcatctagtccnaactatttgggaggctgaggcaggaggatcgcttgagcccaggagtttaaaggctgcagtgccctgtggttgcacctgtgaataactgcacntccaccctgggcaacantagcganaccgtcatctccaaaaaagaaaac

SEQ ID NO: 629413 - DNA, 351 bp, Homo sapiens
ccagaatatgccctggctatattcagtgcaaagttctgaaacagttgagagaacttggaacagcagaaatacgatgataagattcagcgaagatatcaaatttcttttgacacaaacttggagagagtgatcaggaccttagttcatttgctgaatacagttcagagcttaaatctgacaaggttgaaatggagtcctgtacacaaatctcagacatttaggagcacgagacctgctgtgaggttcactgcgacgacttctgactctcttgaacactcttgaccaaccttttggacgtgtcagatgatccccaagtcttagctgttgctgctcacgactgttagcgagtcg

SEQ ID NO: 629414 - DNA, 118 bp, Homo sapiens
  misc_feature (42)..(42): n is a, c, g, or t
  misc_feature (47)..(47): n is a, c, g, or t
  misc_feature (79)..(79): n is a, c, g, or t
  misc_feature (105)..(106): n is a, c, g, or t
gatctccataattttaagatactctatgttaaactatttttnaagtnctctttttacatcacgtctgaaatgcacgagngtggcggtttctgtttcactggtttnnttgttcattttt

SEQ ID NO: 629415 - DNA, 1050 bp, Homo sapiens
tgttaggaaaattacgactggaatgtgctgaccttctagaaacaagagagagtggtgctccgtgcacccgactctgttctctttcctttgggtggtcagcatttcccacgtcttcctgcccaaggaggcaaaatccacagagcagctggcaatctggcccaaacagccgatttacttgctcccctacccagtgcacataccatctcctgtaccactgagcccaacacaaggccctgtcagcccaaccactgatgcacttcggtttaccacacattggccacatgcaaaatcaggcaggctggttccaaattcgcaattctaccacatgccagagctgccaagctgttgtcatcatcgctgcgccaaccatataacataacaggcaggcatgtgcaaaaattgctctcaccatcatgctcccagggctttcagcattcatcgggagcacccaccctccattggcaggcaattgccattcagcgggtacagaacaagaacttgaatactgcacttgttcaccatggacatcttccacagacacttcagaggcgtgctccatacgacacattcacccaacacgtccttaccgcgggcaccaatgcacgcctcactgcaagccaaactacacccgagactcacatgatcccataccttgaatgagacacctgacacggcccttgattcacttcataccagacgatactcccagaagcccacaacaagaacttcccaaatctggcacgaacaggaggcactcacatttgaaactccattggcattagccagtgcgggaaaaggtctgacggctaaaacgagtaaacgagaccgtacgatggactacccgagaagccctataaaacacaagaattatcaccagttactgcacacaagttctaaacaacataacgccttctaccactgccacgaaatccagacaaaaacttattaccacactactaaaaaaacacaatacacaaataacaaagtatttacataacactacagacctacactgtgacataatatgctaacaaacataacaaacatcct

SEQ ID NO: 629416 - DNA, 123 bp, Homo sapiens
  misc_feature (45)..(45): n is a, c, g, or t
tcggtaccgcttctctcccgcttctgaccgaagtgcggcgtgcgncaccatgacccgcgtaaatatcatcacaggcctcggcccggtactgcagattgccgaaggctgcgcgcaaagcggtgg

SEQ ID NO: 629417 - DNA, 466 bp, Homo sapiens
aaatggtggttagtaagagtcagccttataaaatttacatccacactgtttcacagcgaagattgctctctccaaaacatagccatcaaaagcagcaaacaaaccctatattacatccatttgacataatttcagccaaacatatattttgctggaaatgattaaatggtgagtgtgtcaaatccatctttttgaaaattgttgagtgtgaaaatccggctgattatagattctttaattacaaaaggatgagtatgatatagaagtcgtctatatatggacaggaagaaagtgatactattgcactttggctgttataacttaatctgtgacatggtctcaatactgagcatgctttgttgtggtgctgttgttgtggctgtagtgtagtgtgtgtgtgtagtctcatcagtatgctaactgtcctggcccgtcctcgtacaagtaggaatctaaaaatctattc

SEQ ID NO: 629418 - DNA, 292 bp, Homo sapiens
  misc_feature (45)..(45): n is a, c, g, or t
  misc_feature (63)..(63): n is a, c, g, or t
  misc_feature (209)..(209): n is a, c, g, or t
tggcggagtaaccttgataaaatagattttcctttaaaaaaattnataaatttaaaaaaatcnaatttttaaaaaattaaaaaatgttaaatgtcagagtagttctcaaactttttggtatcagaacccttttagacactcagcaattacagaggatcttaaagaggtcttgttcatgtgggttatatttatccatattcaccatattnaaaattaaaactgataaaattttaaaatgtttactaattgaaaaaggtaagcctatcacatgttaacatgaaaacacattttt

SEQ ID NO: 629419 - DNA, 149 bp, Homo sapiens
tcgccgtgaacttctttgacttatgtccccactaaaacacaacaaaacaacttttactgccttccacattaattagcattttcttgcagttgtttcatggcatttctttaaagatgccctaagtgttgaagaagagtttgcaaatgcaa

SEQ ID NO: 629420 - DNA, 377 bp, Homo sapiens
gtgtcattatacacagatcagagaacagcttttctgtgctccttgcttccagcctcagaggttcttatagacccaggctgggagaccccaggtctccctagtagcccctgtgagcctagcagggacactgcttaggggaaggggggtaaggaaaggtaaggtagccgtccacactactactagcagctactgctggactactagtgcgcaaagcagggatgagcttgtaggcccgccccagccccatcctctacacctatgtagggtataaaagagaagctcccgctcatcacatacctcttactacatccactagcccctactaacctatactctctaaagcttagggagtatggggagcagcaatccccccaggg

SEQ ID NO: 629421 - DNA, 229 bp, Homo sapiens
ctagccttccctagtttctgctactgaccagttcatccagctttcacacatgttgttgctgctattgtggtgccgcctcaggttagtgggctctcagagacctcccagtttccgctactgaccagttcatccagctttccacacagttgttgctgactattgtgtgtgcgactcagagttaggggctctcagccatctctaaactctggcctcgctgctcttggaatag

SEQ ID NO: 629422 - DNA, 778 bp, Homo sapiens
  misc_feature (41)..(41): n is a, c, g, or t
  misc_feature (71)..(71): n is a, c, g, or t
  misc_feature (81)..(81): n is a, c, g, or t
  misc_feature (126)..(126): n is a, c, g, or t
  misc_feature (147)..(147): n is a, c, g, or t
  misc_feature (203)..(203): n is a, c, g, or t
  misc_feature (253)..(253): n is a, c, g, or t
  misc_feature (256)..(258): n is a, c, g, or t
  misc_feature (281)..(281): n is a, c, g, or t
  misc_feature (287)..(287): n is a, c, g, or t
  misc_feature (292)..(293): n is a, c, g, or t
  misc_feature (312)..(312): n is a, c, g, or t
  misc_feature (331)..(331): n is a, c, g, or t
  misc_feature (333)..(333): n is a, c, g, or t
  misc_feature (336)..(337): n is a, c, g, or t
  misc_feature (341)..(341): n is a, c, g, or t
  misc_feature (352)..(352): n is a, c, g, or t
  misc_feature (358)..(358): n is a, c, g, or t
  misc_feature (362)..(362): n is a, c, g, or t
  misc_feature (377)..(377): n is a, c, g, or t
  misc_feature (383)..(383): n is a, c, g, or t
  misc_feature (390)..(390): n is a, c, g, or t
  misc_feature (397)..(397): n is a, c, g, or t
  misc_feature (399)..(399): n is a, c, g, or t
  misc_feature (403)..(403): n is a, c, g, or t
  misc_feature (453)..(454): n is a, c, g, or t
  misc_feature (457)..(457): n is a, c, g, or t
  misc_feature (475)..(475): n is a, c, g, or t
  misc_feature (477)..(478): n is a, c, g, or t
  misc_feature (480)..(481): n is a, c, g, or t
  misc_feature (592)..(592): n is a, c, g, or t
  misc_feature (594)..(594): n is a, c, g, or t
  misc_feature (762)..(762): n is a, c, g, or t
atgctttgcatttacatcaaggacacatttattctaatggnataaaacagtcacacacaagagaccaagtncatgtttttnaaaaatgactacatgtttcacctggtcctatttttgctatttggnccatacttttaagtgaattgntcttacatacatgttaagtctgatttatctccccacatttttaaacactaaatgangcttctcacaatttctaattataaacaaaaggctgaaaacagtatggganacnnngtttcggaacagagagaagtggngtgagnggggnnccctctatgggtcatctgngagggacattttactcagngnggnnaacntttctgatctnggggtnagtntcccactcactttgngagggnccactcnttctgcngngagncctacaagtctttctggtctcaattgcaaagtacgtgaaaatgtgtatgnnagntctaaaagctaaatattngnntnnggctaattgaaatcaaaattgtgtgctggtctaaatatacatcttcggcttcttcctttttagtaagtatttttatttcagatgtatttaaaaataacttacatttttagngngctttatggtcaatgactgtaaagttgaaactcaaatgagtcagtttaaaatttttgtctcatttgattctattgaaattttaatcacctactactttaatcaagttattcatgaggtaagtttcagcttaaaaaaaaaatcatccacaaagataaccatttcaagantacacaaatcataatt

SEQ ID NO: 629423 - DNA, 571 bp, Homo sapiens
  misc_feature (435)..(435): n is a, c, g, or t
  misc_feature (453)..(453): n is a, c, g, or t
  misc_feature (470)..(470): n is a, c, g, or t
  misc_feature (498)..(498): n is a, c, g, or t
  misc_feature (524)..(524): n is a, c, g, or t
  misc_feature (536)..(536): n is a, c, g, or t
  misc_feature (546)..(546): n is a, c, g, or t
aaaaggaagtctcggggctggaagaagacggagctgaaggctgccccacaaattaaactctacctttacacttctaccacagactattaagactgatgatcagtataagtatatactggtggacaccaccggtcctccctcttgtgttttggaaacggactttacctgtgtttcaagctaccttaatgtcactgctcttgaggtttctgcgctttgaaagggatttctgtgtttttaaagagaatagtttgtagtatccgcatagaagcagtccttgagctgtcctatagaagggtaatttgatacggaccttgtggctatatttttataatggtaatttttaaccgtctgagctgggtggtttgcctcaacaacataaacttcctaatgatcagcgctagatgattgaatagtaaatgccttaataatccaacnagtgcacttgaacatttnaaaccttaaggggagtnaattaaagaagttattaataatgttttnaaaatagccgcagatattacctaatnattgaataatgnataattaaanttccctccgctttgtaagatgggca

SEQ ID NO: 629424 - DNA, 470 bp, Homo sapiens
ggctcacactgtgtacgagggttctatatgaatagacactgatacttgtagagtggaatagacagggtatctcgacaaattaggcgtatcttcctctcatctccttcacggaaccacagcacagctctatgcacttaacgagtgctgactcagaggcatcacctgcaactgcccgcttaacaatcggtaggttctcctggttagcctgaaacactgccctgtaacaaagacctagccatactggacagagcaagccagagtagctaaagtctatgtcacacgagacaccactactgatactctgtcgtatcagctatcatggattagatagatcaaaccacatgtgggccacatgtcaatccggttctgagtcagaattccagtattatcaaagcagatggtggacgtgaaccccaaggatctccaacagctcaaagtacttcactaagcagtttttccttgccatgcgt

SEQ ID NO: 629425 - DNA, 838 bp, Homo sapiens
  misc_feature (660)..(660): n is a, c, g, or t
gggtcgctgaaaatatttattcaaaaacagggattgaaaaaatctgtacagaagtgtctgctgctgaaaatggggccccgtggccaagtgccattcccccaggtacctggctagggcccccttttgggggtgcccccgtgaacaacgcccatgccatgttacattcccagtcaaacgtggtgttatcaaggtgggaatgcaggcaaaaaaattctgcgcaggttgggtggggagagaagaacgcctgggccccagttaacccaaggggccctccttcctctgatctcccacaaggtattgcagtaggccagagaacgccctagaggagtatggggagagtgctgtagattgaccacccgccaagtgggtgcggggccactatagcggagctctcctgtgggcatgcctccctgtgtgtatgtccaaggcacgagagcatgaggaaggatagggccccctgtgccctgtgggtgcttgcccgacaaggcttcaagacctcctgtgggcccaagaagaatgtgcgccccactgtctgcagaagaaaaggacaccctcccatgtagagagtggcacgggcagcgggcatagcaggggggtgccatctcacaatgcgacgtcctggggcggcggatacaaccgcgggccgttttcggggagacnccccagggggttggagacgctctctccctttgtgcgcagcgcgcgtatacgcggtgcacataacgcggccacgccccccctttcgtactagagtagctatcccttagcccattgcccgccatttgccctgtggttcacccccttcagaagatgtagggcccctcatagaatacggcgg

SEQ ID NO: 629426 - DNA, 1055 bp, Homo sapiens
tataagggttccccagcattcggcaaggttaggccaaagcccaatttcaaagaaatgggattaactcttaaagtaagggtattagagttacatgttattatttgaaaattatttattaacggggaggttggcaaagttattgggactatttaaaagagtccaaccacttgagatattcaaatttcagctgggtaagtcttacaatgtggggtcttagagctctacacagcagttgttgcggaggccccatctcggagggacacacagcgtgcgtttcacataactctgcggggttctatagacgagccctcacgagttatacactattctccgaatagagtggtggtctactctttaagacagagtctcccctctttttaaaggaactccacgaggggggaataaatcccctgagatcttctcacaacatctgtgttctccacagcatgtagtgtttcccacgaacacttactccgtggcggacgggggtggcagacaaagttctccccccagcagtctttgctgggctcagtgttcccgggagtttgtgggacactcaccacccaaatctctgtttcaatctttcaccgtgcgcaatcacgtggagtcaagcataagcgccgtggggccacaagttggggggccgattattccatattgtggcccctggtgggagttatcaccgcgaccttttttctaagaaggacaccgtggggtgtatccccacgtacaagtccctctactagtggtttaaaacaccccggcgtggacaaaacaccacggtggctggaaacaccctcatagtcgatctatcttccgtgggaagaaggcaaaaccgcgggtgggttatctaatccaagagggggtatcaacagacaacgttggggtgcgcacattccccccgggatgatggagggtaaaactattcccctcttgacgaagaacacttttgtggagcaaactacacagggctgttgttgaagcattccctattcggcggcaaaagcaccggaacacgttggttgtacagcgttaattgattgtgtaggggaaat

SEQ ID NO: 629427 - DNA, 793 bp, Homo sapiens
aaatttttttttttgggacagcttcaaggagatgttagcaatttcagatatactagccagtttaggtatgacttgggaagtgcagaaacagaaggatactgttagaaaatcctaacatgggtctcctgcatggtgtcacaccgggtctcacgtgcctttccttcccacagaccgtgaggtgtgaaagacgtgagaagtgtgaggagtttaccttgtggtggaatctgggtccacaatttctaggtgaaagtgtggaagtcaaccagaccaatgatggaattaaagtgtaaattccaacgagggctttcacagtccacagggttcaaagtgactgtgggtaacagaagtttattcttagacttaccgtgttatggtgacaggtgcatttaccgtggtccattttccaagcccaaacagccgtgtcagaaagcattcttttagcagaaaaccacatttacacttggtggcttaaagctccgtgaaatcgcatacctcctttaaagaaattatacagtgttagtgctcattacagtagggaacacattgttcatcctccaactacttggggaatgaatcccgactataccgggtacactagggagcctggagctgagctatcacggatggtggcctctccaagaaacaaaacagactacacagttggaggcaccctctgggggatcacaacggctacaaaacaaagacacacaacacaacaaacgcgcgagcaaacagaccacagggggggcgcaaccaaagacaaaaaaaaaatagccaccaaacgggacccccc

SEQ ID NO: 629428 - DNA, 223 bp, Homo sapiens
cccccccccttttttttccccccttaaaaaacccgggggcgcttccccccccgggttttttttttgggccgggggggggttcttttttttccccggggacccttttttccctttggcccttttttgggcccccttttacccctttttttcccaaaagccggggggggccgggccgggttttcccgggtttttttcccccccccccccccggggggggggggga

SEQ ID NO: 629429 - DNA, 123 bp, Homo sapiens
acaatcagctcggtaccctctggccatccaatgtacttcaaaatgattccatgtgtttagtccaggaagcaatagtaaggaagtcactatcaggtaggtgagaagcaggttgtggacttgttg

SEQ ID NO: 629430 - DNA, 520 bp, Homo sapiens
tctccccgggttgtttttccacacaagtattttaaaatcccctcctttaaaattttaacttttttgtttttttaaaaagggggttgttcataaaaaaaatattttttaacaatttacacggaattgggaaaaatttgtttttctccaaacttttaacaaaaatctcggtattgcccttttggggtggctcttagaaaccccctttgtttttctctattataagggccccttgctttttaaaatataccacacttttttttccgccagagaaaatataaagatccactcattaagttccttgccaccaataatatagataccacctctttcgggcgagggggcgttattcggtaatataaagaactaatacatttttgctttaatagagtcctatatcattttaatataccctagcgcgtgacatcattacgaaacttctcgctctttaataaattagtgtattataaatatcattagttgaggaaataataaatgggtatgatccttagacaaaaatata

SEQ ID NO: 629431 - DNA, 992 bp, Homo sapiens
  misc_feature (320)..(320): n is a, c, g, or t
ggccgctccggccgggctcgtggtgggggcagccccagcggcgtgcggcggcggcgtggtgctggctgaggccgcgcggacggcgcccgacagcagctggaggagctggtttgcctgacctgtgctggcgagccacttggcaggccatcctgtgctgctgggacgcagtgggacctggcagaactgcgcggcttgcgtcagtgagaacgccctggctgcgtgctcgagaacctggcggcttgaagcgcgagaactcgcaagcctcttccggtcagtgctttggcggctcccctggcgacaggcgtgcaactgggacgccncgctggagggccacgccggggtcccttgaagacggccaggcacgaagccggagtggctagaaggacagcggccagagaggacgaagccgggcaagccccagggcccttgaggggcccgactttgagaagcttggaaggccatgtaccgccgggcccttgctgcaagcttgcacctcgagcagcggggaccacgtcctgagcgggggaacaaggacggatgcaagcctcttacagggaaccccgaagtccggccttccggttcccggggaccttcgggagcccttcttgcgccccttggcttgtagcccgagggcctgctatgccgggtgaggaaggcggaagcctcgaagcgggggcccttccttccttccggttcccagggtacccccccgacctcgccgcaactgccctttggccgcgttccctttgcccggcgggattaccctttggagcttacggggtgcctttcccgggccccagccaggtgggacactttcccgggggtggcgggcttggcccatcccgctttgggtggacagggtcgagttggcgttgcaaggggccccttcaaggaccttccccacatttgtccgagttccccttgccttcttgcccccggggctaagtttcgccttggagcagaggggctaagcaaacaaccgcacgggcgca

SEQ ID NO: 629432 - DNA, 859 bp, Homo sapiens
gctggatgatgaggacgtagaggagctgaggggcagtcagagggaggcatggagatgcgggccatgcggcagcgtgaccgggaggcatggccggggcctgggcgcgcatgcgcgcgtgggctccgtggtatgacagcgatgaggaggacgaggagcgcgcctgcccgcaagcgccgcagggtggagcagggccacggatggacggtcggagtgatggacagaggatgatgattgaggagctatctgaatgaacgcttggagggattctcaaagtgcgcactcatgtgcgctgagatggtgtgagcgatgcgcggggcccccggctgtgaggatccatcatcgattcaagaacttcctgcgcactcacgtcgaccagtcacggcacatagcgtcttcagggagcgcattcagtgactatgtgctagaagtagaagcctgtgacgagcctggtggtgaactagtgagggaccttggcgaagcaggtagctagcgtgctggtcctatcgttcctgtactgtagggcaccggctggagctgcgtgctatgagtctttgatgaggctgcactgtggaggtggtactggccatgtaccccaagtactgacgcatcacaacgcatccagtgtccgcatctcccacctgcctctggtggagggagctcggctcgctgaggcagactgatcttgatagcagctgatccgacccagtggggtggtgacaatgcactgggttcctgcccaagtcaacatggtcactacaagtgcaaacagtgcaaatttcgtccctggggtcctttttgccaatcgcaaacgggaggtgaaacagggtcccggcctgattgcaatggccggaccttttag

SEQ ID NO: 629433 - DNA, 1567 bp, Homo sapiens
ggctgcgtctggaggggcccctgacttctccagcctggaccccgcagctttgcccaacaccagccccatgccccagcccaagtccaaaatgtttacagggagcctcctgaccagtccacccaaccccagccgcatcggaggccccaaaggaaaaagcacaagaagcgtgagacgccgaccattcctgcgacacaccacgagtccaccctgcgtcattctcgctagcctttttaacacaaacatgaacagtcaacaggcacaaaacaaacacaacactggcacaatctcaggaaacacttttatagagcaaacaactaaatatataacgacacctgctcaacgactccgcgtgaacacaagcaaagagggagcccacacgccgaaacgaagaaccccaccaccgaccaacaacggcgagcaaacaacccagcaccaccccgagcacaagagcagccacaccgcacaacagccacccaccacccccggacacacacaccaccgccaacgggccacaagacacacacacggcgacaagcacgcagcgcgacgcacccaacgagcacccacgcgcccaccgcaacgaacacacaccagccaagcgacgcaaacacaacacgcagaaccatgcacaccacgacccaccacccacacacccaccgagtcaaccgacaccgcaacaccgaaccaccccaacacaccacagcccgggccccccacagggagcagcacacaaccacaaccacacaccagcaagaggagccaccacaccgcgctaccacggcagcaagcccgtacacgaacacacacgccacgacgcgaccacacacgagccgcacgagcgcacgagacgacgccccaaccaccgcacgccggagagccacccgagcaccaccgagccaaccacaaacacagccagcgacgccccacaacgccaagacgccgacacaccccaccgaagaccacgacagaagagaaaacaaccgagagacagcgaacgaacaaaaagaacaacacccaaacaggacaagcaccccccgaacgacccaacccagcccgagcagcacgcgacccaacacactagggcggccacaaacgacacgccagaagcgaccccccaacccaacgagcacagcaaatagccgccaaagcaacgaccacgcacgcaccgaacgaccaacgcgcagcggacgcgcaccgccgaggccggcacgagtcgaagcagcgccacgcggcgaacgcccgccaatacgagacaacgagagccggagccgcgtacgacacacgaccggaccgacgaccaccgacgggcgacaaaacacacacaccgcccaacgcgaaagcagctcgacacccagcgcagcgacccacagcacacagcgcgcgacccgcactaccagccagcaagcacctaacgcagaaaagcgccgcacgcacacgccagacacaggcaccagagccgcgcaacgcgggacacagcgaagcagagagcacactcacgaacgcgagcagagagcggccgcaccgcgcaccaacgtacggcgagcaaccgcacccgcccgcgagcaga

SEQ ID NO: 629434 - DNA, 196 bp, Homo sapiens
  misc_feature (33)..(33): n is a, c, g, or t
  misc_feature (37)..(37): n is a, c, g, or t
  misc_feature (110)..(110): n is a, c, g, or t
  misc_feature (163)..(163): n is a, c, g, or t
  misc_feature (165)..(165): n is a, c, g, or t
acaccacccactcaggactcttccccatcatcntttncattgccacaccctagatccagcctcaggaactaacaagttttgagaaaagcaggtggtagagcagcagcttngtgctctcagcggtggctggctggcatttttctctagcgttgtggtgccaccntnccttctttgtcccaaggttataaggccttgt

SEQ ID NO: 629435 - DNA, 1008 bp, Homo sapiens
  misc_feature (151)..(151): n is a, c, g, or t
  misc_feature (155)..(155): n is a, c, g, or t
  misc_feature (175)..(175): n is a, c, g, or t
  misc_feature (182)..(183): n is a, c, g, or t
  misc_feature (211)..(211): n is a, c, g, or t
  misc_feature (217)..(217): n is a, c, g, or t
  misc_feature (222)..(222): n is a, c, g, or t
  misc_feature (230)..(230): n is a, c, g, or t
  misc_feature (232)..(233): n is a, c, g, or t
  misc_feature (237)..(238): n is a, c, g, or t
  misc_feature (245)..(245): n is a, c, g, or t
  misc_feature (247)..(247): n is a, c, g, or t
  misc_feature (250)..(250): n is a, c, g, or t
  misc_feature (260)..(260): n is a, c, g, or t
  misc_feature (279)..(282): n is a, c, g, or t
  misc_feature (284)..(287): n is a, c, g, or t
  misc_feature (289)..(292): n is a, c, g, or t
  misc_feature (294)..(294): n is a, c, g, or t
  misc_feature (296)..(296): n is a, c, g, or t
  misc_feature (305)..(305): n is a, c, g, or t
  misc_feature (310)..(310): n is a, c, g, or t
  misc_feature (326)..(326): n is a, c, g, or t
  misc_feature (356)..(356): n is a, c, g, or t
  misc_feature (372)..(372): n is a, c, g, or t
  misc_feature (376)..(378): n is a, c, g, or t
  misc_feature (381)..(381): n is a, c, g, or t
  misc_feature (391)..(392): n is a, c, g, or t
  misc_feature (411)..(413): n is a, c, g, or t
  misc_feature (420)..(420): n is a, c, g, or t
  misc_feature (475)..(475): n is a, c, g, or t
  misc_feature (489)..(489): n is a, c, g, or t
  misc_feature (542)..(542): n is a, c, g, or t
  misc_feature (562)..(562): n is a, c, g, or t
  misc_feature (564)..(565): n is a, c, g, or t
  misc_feature (581)..(581): n is a, c, g, or t
  misc_feature (604)..(604): n is a, c, g, or t
  misc_feature (608)..(608): n is a, c, g, or t
  misc_feature (615)..(615): n is a, c, g, or t
  misc_feature (628)..(628): n is a, c, g, or t
  misc_feature (632)..(632): n is a, c, g, or t
  misc_feature (639)..(639): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (739)..(739): n is a, c, g, or t
  misc_feature (746)..(746): n is a, c, g, or t
  misc_feature (760)..(760): n is a, c, g, or t
  misc_feature (799)..(799): n is a, c, g, or t
  misc_feature (818)..(818): n is a, c, g, or t
  misc_feature (833)..(833): n is a, c, g, or t
  misc_feature (992)..(992): n is a, c, g, or t
tgccgcgctgtccgcgttatctcctcccggtgagaaggaaccgcagtttccaccggcgaggagccagccctgtcccggtcagagaaagacgacgaggatacctgggagcgggcggcggccgggctgggccgcgccggtgcgggctggcgantctnctcctccgcttgctgctgtntctgggnnctgggtgccagcgctgaggggcttccancggacnggagncccccttncnnggcnnccctgcnanccntgccgggganggcggaagataacggttannnngnnnnannnntncnctggggtgnaaaangccgtagcagaaaganggaggcctcaaaaaatgtaaaaatcatccngctattaaagatcccnacannntantagactaatnnattgagaggaacatttttnnnacaagangttcctagcttggttttataaatatgcagagtactgatgaagattgtaggagccngaaggaatagaaanattttgtgaagacatttgtgttgaacctgaaaatattattatgttagttttancgtggaaattggaggctgananntggggattttttaccnaggaagaatggttaaagggaatnactncattacngtgtgactacccngaanagttacnaaacaaatttgactttttgcgctcacagttgaatgatatttcgtcatttaagaatatctacagatatgcctttgattttgcaagggatanagntcngagnagccttngatattgatactgntaaatctatgttagctcttctgcttggggaggacatggncactgttttcagtattttnccagtacctggagcnatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtcgtcagacatcatagcanaactatgtaaagaaat

SEQ ID NO: 629436 - DNA, 133 bp, Homo sapiens
catatctgtcagtccgcaaagcagcactcgggcgaccgtcggcggcgtccaggcgcttggacttggcatacaactgcattgatctctccatcatgctacacaacgagcgcgcactatccgagctagaggagcg

SEQ ID NO: 629437 - DNA, 165 bp, Homo sapiens
  misc_feature (20)..(20): n is a, c, g, or t
  misc_feature (42)..(42): n is a, c, g, or t
  misc_feature (123)..(123): n is a, c, g, or t
  misc_feature (130)..(130): n is a, c, g, or t
  misc_feature (155)..(155): n is a, c, g, or t
ggaggggccacgtatgccanccttgaagggagaaggccagancacacaaacgctcatctgcccttccccctggggtactactctaccagcttgggaggaagcccagtagccagtaactgcatnccagtanccctctgtacctaataaagtatatntttctcacac

SEQ ID NO: 629438 - DNA, 136 bp, Homo sapiens
tgctgggattacagacgtgagccaccatgcccagacaaggcctctacttaaactgctcattcatttatcttacaagcatttttggtgtcttacaatgtgccagaaaccagtgatggccaacatgggcccaacatgg

SEQ ID NO: 629439 - DNA, 146 bp, Homo sapiens
agagaagcataattttccatagagtcatcagggaagacttctcataggaggtaatatttaaggagggccctgagagatgagaaggtacttatcacaggggaaatgtgcttgtgatggagggaactatatatgcaaaagcccagaga

SEQ ID NO: 629440 - DNA, 398 bp, Homo sapiens
tgtcacacgtccttctggggattcctgtcccttgtatctcttgaatcaggctcttagattcttctgcttcattccatcattgtaacctccttccacgactctcaaatccgtctccttctccatatctccactgccgtccctatgttcctctcctgctttggctctgcacggtacgagcaggtggtctctgtccagccaatgtgggccctttgcacactggtgtgagtgcttctaagtctcgttccagctctcagttcggcctctcccaatctccttgtgtcttcccacagcatgtgggaaaagactaggaggacggcactggggccacaaagataagtccattgtccctgcactccagggatctgacgcccgtggcccccggcatgagtataatgtgg

SEQ ID NO: 629441 - DNA, 711 bp, Homo sapiens
acacgttgagcccaacaaggagcgacgtgaggctgtgaagctgaaaattaccaaatacctgcggactgggcagaggagatcttcaactgccacctgcagcggctgctgagcagtggagccagccccagcgcgggtttcagcagcctgaggctccggcccattcgcacgctgagactctgccgtggagcacgctgaggggctgccaggtgtggtcaggtgcgtcatcgacgaacggtgcagctggtccagtgacccagagcaaccaagagggaccttatgtggtgaagagcctaccccaggtgaccacattgggtgacgcagggaagcgggctgaccatcatcccacacggaagtcaccctaacatgaacgaagcttgctacaggtacgtttcgttgagcgcggaggaacgataccagtacatttcccctggcaacccttgagaaggaccagtgttgccaagggaaagggcagcatccatacattgggatcccgccagccttgggctcgtacccccaagaggccgcaaacattcccccgggaaacagtttaacctgggagcgtacaagaccttcttggggctattccataaccccccaggggaagaaaggaatcgaaacggggcctacaagacattccaaaacgccacccaacactacaaaacacattccaattgaaacccccaagacgaaggagcatatctccacatccag

SEQ ID NO: 629442 - DNA, 156 bp, Homo sapiens
cagggatccctgatcgaggttctctgtggtcgcgtatgatagatagatattaattggtgtgatatttatatgtatcttatacgtatttttgcagttttctaagtgcagaaacagattgtggacattttaggtgattttttttgggtgtttccccca

SEQ ID NO: 629443 - DNA, 1155 bp, Homo sapiens
cagcggtttttatcaatgtggtggtccccttggatgtggggggggctcgtcccccccttgcaagggggtgccttgtgcacaccccccttgaacaacaaagtgtgtttattagggcgcagaccatttgccctgttttgtgtggggccccccctggggcgccaaaaaaccacccaatggtgtagtgtgccccccttaatacaggcgtgtccccggtgttgtttttccccacgaagactggggcagatatctaccccccgtgccaaagtgtggtctttagagagcgcggaatatggtgggtgagattttgttgaacaaggtcgcctttcacagaagagatgtggtggaagatggcgcccccgccaaaattttcgaggggggacaccccccagaaatatgtgggcgcgcccccacttcgccggcaaaaaagtagatgtggtgtttccgcccacaaaatgttaagagtgtataaaatatgtgcgagagtggtgaaatatctcagtgttattaagaagatccagcagagcgccgcaaatatatgcgccccaggggggaaaataaagattcttttagagggggtgatagcgcacagatgtcacacagggggattaaataaataatggtgtctcacccgggcgccaaacattcgcatatttgttgttctcccacggtgtgagaagagaggaggaacaaatttgtggaaaaagttgcccttaatgcgttttaaagagagtgttgccagctgtataaggataaatatttggatatagggggaaggggttttcccaccctcgcaacaatatatggtctcacgcctttttaaaacaaaaaatatggccgccctttctagatgagaaccccagaacatttagccagatagccaaatagcatggcgaaatacctgtcgcgtttttcacaattggtttatttggaataagatgtcgcacccgatatccccgccacagagaccaggtgctgtgagaatgggtaaagaggcgacatcatattgggttcccctgacatttttttgccctttgaataattatccaccaaaatttataaaattccaaaaggggttgaggggaatttctttaaaagggaaaaaaagaggccccctttgcaaattaaataaggtccgggaaacccccctggtgttta

SEQ ID NO: 629444 - DNA, 221 bp, Homo sapiens
tcagctgctagcacggctcgtgcacagagtgtatttcccgtacctggtggtccatatagcagagacagccttttggaggtattattcctacacgctgaaataactctgggttagtaagaggtaatatctatacacctctacttaattcccgagatctgttctgtatagccctccaatctacagaataagaaacattcccagggtccatgctgacccatctt

SEQ ID NO: 629445 - DNA, 1035 bp, Homo sapiens
  misc_feature (568)..(568): n is a, c, g, or t
tgcgtcaggtccgggctcctggacttcgtccttatcccgagtccctggaggtggggagaaaagtggaagaactggccagagagtctggaagatttgggttctggtccatggcttgtgccatgtgaactcacgtgtgaccttgaggatcttgtgactgtgaaatgacatttccccaagatgacttcaatgtttcacgccagtcaataaatctgtacaccccacaacggtgccttgggcagaaggagggctgaacttctggtttaaaggggggtttttggtccaggcctagggaaacgcggccttgcggattccgtcttaaatacccagtggcgttccagggctttcccacgcggttgggggaatcccctcgaaggccccgggttggcgaggaactcacgttagaaacaagtgggcctagggaaagaccctttggggggggggcattggggggaaccctgtattagggctggccaacacctatatccctccactttttccactcagaaaattttggggtggggtctcaaaatcccaaaacgctaggggtcatttggacactacggaattnaacctgcaccttggtctttgaacctgtttgcgtgactcaggtcggacaccgtggatcacctgcccttggcattaccatggggccttccccggagctctaaacccccccttttgaaacggggggccaaagcgggcctttattgtgcccaacatccattaggagactccctcagggggcctccccattttggctggcctttggtggatgggagttaggtggaagacccctcctgactaggagccccttagggtacacagccaaaacgggggcctctttcatcggggactacgggacatttaaccagggaggggcattcccaggaatggcccctagcgattagccttttctccccccaaatagggttaactgaggccccttggaatggccctactgaggggccccataaaggccccttctacccggcccccaaggtgggggattgcggaccatgggggactatggatcgg

SEQ ID NO: 629446 - DNA, 704 bp, Homo sapiens
gcacgagctttttttctttattagtcctgctagcagtgtatcaattttgttgatcctttcataaaaccagctcctggattcattaattttttgaagcgtttttttgttgctatttccttcagttctgctctgattttagttatttcttgccttctgctagcttttgaatgtgtttgctcttgcttttctagttcttttaattgtgatgttagggtgtcaattttggatctttcctgctttcccttgtgggcatttaatgctataaatttccctgtacacactgctttgaatgtgtcccagagattccggtatgttgtgtctttgttctcgttggtttcaaagaacatctttatttctgccttcattttattatgtacccagtagtcattcaggagcaggttgttcagtttccatgtagttgagcagttttgagtgagtttcttaatgccgagttctagtttgattgcactgtggtctgagagacagtttaatttctggtcttttacatttgctgagggctttacttccaagtatgtggtcaattttggaataggtgtggtgtggtgcttgaatgtatattctggtgatttggtgtggagagttctgtagattgctattaaggtccacttggtgcagggctgagttcaattcccttggtatccttggtgaacctttttggcttaatggactggccttggtgacgt

SEQ ID NO: 629447 - DNA, 132 bp, Homo sapiens
gctgcggttgatctaaggatcccccaagcagttaatcagactcacttcagactcatagtatctgaatccagtgtcccaaggacatcagtgactttatattgttgcgcaacctggtaatgcttaaaaacttac

SEQ ID NO: 629448 - DNA, 105 bp, Homo sapiens
  misc_feature (103)..(103): n is a, c, g, or t
ggacaccgctcaggccgcgagcagcagcaaggcgcaccgccactgtcgccgctgcagccagggctgctacgaaggccgaagtggctccttccggctcctcagncc

SEQ ID NO: 629449 - DNA, 920 bp, Homo sapiens
  misc_feature (536)..(536): n is a, c, g, or t
ctgcctgccgctgagggttcccgagcaccatgagggccgtggatcttctatctcctttggctggccgggagggccttggtagcccctcagcaagaagccctgcctgatgagacagaggtggtgagaagaaactgtggcatgaggtgactgagtgtatcgtgtgggagcgtatatctcatgttcctaggttggaaggtaggagagattatgattgactggtgcaagaggaaaaccgaagatggaggtgtgtggcggaagaatcccgtgtcagaagcccacactgcggagacagcggtcaaaggtgtgcaggagctgggatgagataagctaacactcacccagtgttgcgatgatgcccaggtagcgcgccacgcagtctgcgcacagcactcaccattttggcgactttccgagaagggtgctgcagacaatggacaagccaagacctttcgagcgtcttgcctgggcagctatcttttggccaacaagagtgtcgagcgcatggagagcgcactcaaatgaaagggaccatcaangcgatcaaccttgggatctacaatcgggagcctatgccaaaaggagtatcatgccctcgacctttagctcaatggacgtcgtgagccatgaaccgaaattccacccgtggcgcaatgcaggcgacgtggctcacaagaagcgtcctgagtctacccgtgtatgaggcagggcactgaaggagcaacaatccttactgcactgagtaaggcaggaagccttgcgcggtgaaaccaaagatccagtgacgaatgacgaaggcagcctggagtgccggagaagcacccgcgtggcagctgctggcccggcacttcgagaacgaacctattaccatgtccctcttccctgtaccgtggcgcggcgggccaggtggaccaaggacccac

SEQ ID NO: 629450 - DNA, 550 bp, Homo sapiens
  misc_feature (8)..(8): n is a, c, g, or t
  misc_feature (14)..(14): n is a, c, g, or t
  misc_feature (41)..(41): n is a, c, g, or t
  misc_feature (60)..(60): n is a, c, g, or t
  misc_feature (75)..(75): n is a, c, g, or t
  misc_feature (128)..(128): n is a, c, g, or t
gaagcagntgtccntaacaaaagttgagtcctgtctggaanattcgctggttttcttcanaagttgccagccagnaccatttacgtctgctaaagttgcacccacaagcggcttcttccgccaggtcntctgtcccagagaggtgggagttttatctgttagcccctgactggggctgctgcctttctttcagagatgccctgtccagagaggaggaatctagagaggcagtctggctatggcagctttgcagagctgtggtgggctctgcccaattcgaacttcccagaagctttgtttatactgtgaggggaaaaccacctactcaagcctcagtaatggtggacgcttctccccacaccaagcttgggagtcccaggtcgacttcagactgctgtgctggcagcaagaatttcaagccagtggattttagcttgctgggctctgtggcggtgggatccactgatccacttggctccctggcttcagttccctttccaggagagtgaacagttctgtcgctggccttccaggtgtcactggggtatgg

SEQ ID NO: 629451 - DNA, 215 bp, Homo sapiens
  misc_feature (119)..(119): n is a, c, g, or t
tgcaagagaccctcattctgtgtctcccagccacactgcggttcttattgctcttcagggttgcgtcacccatttggttactagagcaatgaggcttgtctgcttgacatagtatatanagccaactactacgggcattcgctttgttggatttatgttgttattcgtttaaggacagggctctcactcctgtttgcccgtggatggacgtgcag

SEQ ID NO: 629452 - DNA, 1407 bp, Homo sapiens
ttggttcttagtaacctaatgtagttacttacttcttttatcctactacatatataatagaaccaaaatagtaacgtcaatgtggttattaagatgaagtctactgaatgcagtttgcttttgtttttttccctgaatgcagtttaagctgtatttttatccttaggccaaatatggtcaatgtagtgtggaaagttagatctgtatgtttttaattttaaagaaattacatattttttaatttaatttttatttttttaaactgcacatttaccttttctctgagatgagggggcacatttaaatctgtgtatgtccagagtccgtgaggattgggaatcagtctaaagctgtgctcgcttctcctcttccattgcgatttgccttctttatccagtcttttggaatgctgaacaaaaatgtttttggcacaaggcaggcgtgaaaacataaagttaataaaaatcgaatgcataagctagagcagattatccacagattcttccatctccatatagattatcaccattgcctgcacctgttttccttctccagcctatctgatggaatggtgcttccatgacatgtggtatttggaaggctcttagctctgatgtaatcagggtttgacccatagtcacctgaaatagttcttctgtttctctttgttctatgaactgaagggtctcagaagcccgtgttatgcaaatacccttccatccccttccctctccccttgcctctatccatgttccctcagcctcagggtgcttgcaggctaagaggattgggtctctggcatcctggagctgaacagctcgtgtcaggaattccccaggcccttgagtctctggggtgagttgtaggggtgtgtagggtgctggggattaagatctgctgagtaggtgcttaccagagttatactgaaggacctgaagacagatcatcttcacataatcagcatgacccataatctgtgatgtcactgagcttcttttatttctgtagtcaaggaatgtgcacaagtaatgcaaatataattacttttagtcctgaggattagggaacttgggggatgttcacattacctgatgatgtcaatattgtgttatgtttaattttttttaaaaaagatgcttatttattactgaaataatctaaactgaataaataactttttaaaaaattacattggccagtattaggttcctgatacgtatttggtgttttgtttgtactgctgggttttttctctccagtattggatgcgttaacggggagccttgagaagttatgaattttggtttgttcggaattgctttttataagttttctgtgacctcatgcactaaatactgatgctaccacactcctgcaagtatgaaataaaagtatgtctcttcaaaa

SEQ ID NO: 629453 - DNA, 298 bp, Homo sapiens
  misc_feature (243)..(243): n is a, c, g, or t
cagttgaaggtctgagtagaacacatgggctgaataagagtgaattcctttgcctgatggtcttgagtggagtcatcagtttttccctgcctttgcattcataatgaaacactaactcttcctgggtgcctaggctgcagggcactggagtggaaccacactgttgtctgtactgggtgctagtttgctgactgcagacatgtgaacttaccagctctgtaccactgtgtgaagccagctccnttaaactctctctaaatacacacacacacacacacacacacacacacggcaacac

SEQ ID NO: 629454 - DNA, 472 bp, Homo sapiens
ccggtcgggatgcagacagaacactattcaagttaaggatctcttgagaatgtgtctactggctgcaaggtctgagttattacgctacatgacaacgtttcgacatttcaccggcaacaaccaaaagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggt
